United States Patent 9,328,346 (POLYCOMB-ASSOCIATED NON-CODING RNAS) - sequence listing, part 138

SEQ ID NO: 191968 - RNA, 9707 nt, Homo sapiens
acucucgaugcgccgcggcugcugcugcgcaggcccagugcugcgcuucgcggcagaggcgucugcggugacagcucagucaguugagcucugugugccaggcgcucgcgaggggguagcucuucuaguagugcucggcgucagacauggcggaggcgauggauuugggcaaagaccccaacgggcccacccauuccucgacucuguucgugagggacgacggcagcuccauguccuucuacgugcggcccagcccggccaagcgucggcugucgacgcucauccugcacggcggcggcaccgugugccgagugcaggagcccggggccgugcugcuggcccagcccggggaggcgcuggccgaggccucgggugauuucaucuccacgcaguacauccuggacugcguggagcgcaacgagaggcuggagcuggaggccuaucggcugggccccgccucggcggcggacaccggcucggaagcaaagcccggggcccuggccgagggcgccgcggagccggagccgcagcggcacgccgggcggaucgccuucacggaugcggacgacguagccauccuuaccuacgugaaggaaaaugcccgcucgcccagcuccgucaccgguaacgccuuguggaaagcgauggagaagagcucgcucacgcagcacucguggcagucccugaaggaccgcuaccucaagcaccugcggggccaggagcauaaguaccugcugggggacgcgccggugagccccuccucccagaagcucaagcggaaggcggaggaggacccggaggccgcggauagcgggggugaggaggcugagcgcggggccucgcggauaucugcgcgggugggguugggaucuuucuccuggcugccuggcguccaucuuggcaucuucgguagcagcgcuuggccccgcccccuguugacauccggguaaauuugcaccauuuucuugccuucucgcucccuuguuguuuauuauuguucuuuuuuugcgaugggucucuguuaccuaagcuggucugaacuccugagcucaagcgauccuccugccucggccacccaaaguguugggauuacaggagugagccaccacgucuggccucucgucguuuuuauuuuuuaauuuuugagugggggcucgcuccgucgcccaggcugugaugcagccgcgcgaucacgaccuacugcauccuggaccuccugggcucaagcgaaucuccggcuucagccucccaaguagcuggaacuacacucccgcgccaccacgucccgcuaaauuaaaaaaaaaauuguuguagagaugggggucucguuguguugcccugacaggucucgaacucuugggcucaagcgauccucccgucucggugucccaaaguguugggauuacaggcgugagccaucacacccagcuucuuggucuaguuuuaauuuacuuuaccauugacuagaauauugacaugguucuauauucaaaaguuacaaaaaguauauagaaaauucucucuuggccgggcgcggcggcucaagcuuguaaucccagcacuuugggaggccgaggcgggcggaucaccugagguaaggagaucgagacgagccugaccaacauggcgaaaugccgccccuacuaaaaauacaaaaauuagccggccguggcggagaguuccuguagucccagcuacucaggaggcugaggcaggagaauugcuugaacccggggggcggagguugcagugagccgagacugcgccacugcucuccagcgugggugacagagcaagacuccaucucaaaaaaaaaaaaaaauuaucucguccuuccuguccaccagcuacccacgggcuaacuggcuucuuguguuucuuuuaagagauauuccacagacuccuuuuuaaaaaagauugcuguuauguucagguagauucaguauaaaggcguaccagacuuacuuuaaugcucuggcguaacugaaugccuauggacuuaagaagguucucggcaguuggaaggucucuuccuggucuugcuuaggugaagugaguuuuuaaugcaguugaauugaaaauugggguucaguaugucuaggauacagaacgagucuguuaagauguacuuggugacguaccuggcauugauaacuuaaaccgauagacccuuuuguuuaaagaggcaugcugcuucuccucccccuccguaauccucccaccuuuucuuugccuguaugacuacuccauuuaacacuugaagucuggggaguaaaaucuuuuucuccuguucaguaugcuuaguaggaauuuuguuuugguaaaagugacauuucagcuucauucauucagcagaaauuugagugccagacauugugguccugcuggaauauaacaauaaauaaaagucccugugguccuggagcuuauaacaugcuagcuggggagugguaagggcuauagagaaaaauaauucagaguguaaggguuggggaggagguuuuuccuauaggaugauaagagaaggucauucucauaagcugauguuuaagcagagaccgaaggaagugaaagagcaacccagguggauaucuggggaagaguguucaggcagaggaagaagccagggcaaucgcccuuaggugggaguauggcugguguguuuggagccacaaagagaacagaguggcuguuaauggaguaggagggagaauuaauuauagcagaugagguuagggcuauguguaugggugaaguaugucaucauguauggccuugcuuuuauuuuuauuuuauuuuaauuuuauuauauaucuugagauggggucuugcucugucacacaggcuggagugcgguagugcgaucacggcucacugcagccuugacuucccaggcucaguggauccucccaccucagcuuuccaaguagcugggacuacaggcacucgucaccauaccuagcuaauuuuuguauuuuuuuguagagacaggauuuggccguguugcccaggcuggucucgaacuccugggcucaagggaucugcccgacuuggccucccaaaagugcuaggauuccaggugugagccaccaugcugugucugggacuugcuuuuaaauccgugauguuggggcuauuggcaagccauuuggaacuugggacaaaauuaagcuguauucauccuacccaucuaaguaaucuuuugauaaucagauauuuaaauguaaaaauuaaaaaauucuaaaaugaguaagagaagauaugaaugaauauaucaguauggugggaguugcucugaaccauuugugguucaggaugcugccugauuugccagaagaaaaaaaguaaaaauauuagcauggugauaaguuaugaagccaaaaagacaaagaaaaaguuuuauauauuugauuaccugaaaauuaagaacuucucaugauaaauaaagucagagggcaugcuggaaaaacauucccaauacacugcaauagacuuaguuucuuuaaugucuaaagagcucuuugucauuaaguaagaagucauuaaguaaaaagaaaacuaauagaaaaaugagaaaaggaaauggaacaggaaguucccagaaaaggaaauaaauaagcggccgauaaacaaaugaagaaauagucuguuauuaaaugaaaguaaaucagaccgagugcgguggcucaugccuguaauccuagcacuuugggaggccaagguggcagaccacuugaggucaggaguucgagaccagccuggccaacaugaugaaacuccgucucuacuaaaaacuacaaaaacuauccaggcaugguggcaugcgccuguaaucgcagcuacucaggcagcugaggcaugaaaauugcuugaaccagggagguguagguugcaaugagcugagaucaagccccugcacuccagccugggugacagaaccagacuccaucucggaaagaaaaaaagaagaagaaagaaaguaaaucagacccugagccuagggucaguauaagcuauacuuugacccaugagaccugugagauaauaaauauguguguuggaauuguuuuguauuuauuugaugaauugagauagcuuccauuauacaaaauagaacaaaagcuccccaaguuauuuauuuuuuuuaacuaaaucagagcaaggagauguuauacuuuaucuauaagauuggcaaaagucaauacaauggguaauauccaaaguuaguguaugggaaaacaaguauacuccuacguuguuaauagaaauugauacaauuucuuuggggggcauuuugacaauaucugaugacauuuauaacguauauucccuuaaacauggcaguuuuguucuaggaauuuaucccguagauauacucagaguacaaauggguacauacugaaaaggcagucucccuauuuacauacccuuuucccuggguccuuuccuaggggcagccucuauuaccgucucuugucuguugcauguccccuuugcucauaguaauacuagcacacuagacaucaacuuaaucugugguuuacuuuuuuuaaacuuaauuauuuaucuugaaguguuugugugucugcacaaagcuuuuccucauucuuuucuaauugauugcacuguauuucauuaugugaaugaacaguaauuuacuuuuuauuauggagaauuccaagcauuuacaaauacagaauaguauaaugaacuauacugcauauacccaucacccaccuucaccugauuuuaguucauggcauuuuuuaaaucuauacuuuucaucccaacuuccuggacuguuuugaagcaaaugccagacaucauaucauuuuaucuauuuuagcauguaucucucaaagauaagccucuuuuaguuacuauuuaagaauuuuauuaaauacauacaguaaaauuaacuuuuuaugguguaaaauuauaugcauuuuaaaaacuuuauuuuuuauugugguaaaauguauauaccguaaaauuuacaguucagauaguuuuuuaaguguucuguucaguggcauuauuaagugcauucacauuguugggcaacugucaccaccaucuguaucuagaacuuacucauuuucuaaaacugaaacuccaugccuuuuauuauuuucugcuucuaggggucagaaacaugccuauuaaacacuaauuccccauuucucccuccucuuagccccuggaaacaaccauuccgccuucuguuucuaugaauucaauauuucuagauaccucauacaaguagaaucauguaauauuugcccuuuugugucuggcuuauuucacuuuacauaauaucuucaaaguucauccauauuguagcaugugucagaauuugauuccuuuuuaaaggugaauaauauuccauuguauguauauacuacauuuuguuuuuccauuaauguaucaauugacauuuggcuuauuuccaucuuuuguuuauuuugaauaaugcugcugugaacauggguauaacuaguaucuguuugagacccugcuuuccauuauuuuagguauaugccuagaaaugcaauugcuggaucauaugguaauuuuauguuuaauuuuuucuuuuuccuuguggguugucaucaugaaauuauauugaauuuuuugaggaacugcuguacucuuuuccaguuauauguguuuuaacauagguaaauuuuuguaaccagcacccacauugggauuuagaacaauuccaucacgaaaaacucccucuugcugccccuuuguaguauguuuuaguaaguagaaaaggagcagaguuaaaucuucagagaacaaaauguaaaggaaaggaacaggauguuuaaauuuaggaggcccuccuuuuuguagaugguauauugguggauugugguacguggcccagaucugccuuuggcugcuaggagagcugccuugcccaaacuccugucuucuuagggcugccaccauccagugacugauauuugcagaguuacaaagucugcuccuuggccccagcuuggucaguucugaagggccuuccuagcuccagaguugcccaugguuuuggcugaggucuuguugaaacucuuugauaagucagcuucucucucugcccacuccugcucuuccacaaagguuuucccaaaaucacuucccaauucuuuaaauuuccaucuccaucucagaauuugcuucccaaggaacccaauuuaugacacauuuuuauuaauuugcaaagucuguaacuacaaagcaaaaaaugaauuaaacuugagcauuuuuauaugucagaguuuaagaauguaucauuguuuggauaguacaucuuuucagaagcaagcauagaaaugggugaaugagcacguccuaggcuuuuuuuacccuucugaaucaagaacagaugucuucugauaguaaaaaaaaaaaaaaaaaaaaaaaaagugcaggcucacuccuggcccagagcucacacagcaaauauauuuuugguuuauguaaaagaggcuauugcuaaucugugcuguucuucucuuuaacagaaccacagaauaagagaacuccagauuugccugaagaagaguaugugaaggaagaaauccaggagaaugaagaagcagucaaaaagaugcuuguggaagccacccgggaguuugaggagguugugguauguuaacuagauuuacucauuauuuuuuucccuaccuucauucuucuuugaaacugguuauccuguacaccuuuuucaucuaccuggggcucaggaaagugagagaggaguucaagauggaaagggaaaauggaaaaugggacugaucugggcuucagacauguugcccugaagcuuuugcuucacaaagcuuuuaguuuuuggcaggacaaguugagggggaaagggagaaaaauuggguagaauagggacaguuguauaaacaguauaaagcaucccacuuugaguacuuuaaugucaauauauuuuucaaaaaguuuauaguaauuguuuuuucuauuuuuuugagccagagucuggcucugucgcccaggcuggagugcaguggugcgaucuuggcucacugcaagcuccgccuccuggguucacaccauucuccugccucagccucccgaguagcugggacuacaggcgcccaccaccaugccuggcuaauuauuuguauuuuuaguagagacgggguuucacuguguuagccaggauggccucgaucuccugaccucgugauccgcccgccuuggccucccaaagugcugggauuacaggcgugagccaccgcuuuuuguauuuuuuugagguggagucucacucugucacccaggcuggagugcaguggugccaucucagcucacuguagccuccaccucccagguuccagcaauucuucugccucagccuccuggguaacugggauuacaggcaugugccaucaugcccagcuacuuauaguaauuuuuuuuaucaagcaaauuuagcuuuuuguguacuuugagcuuuuuaaaaauguuuuagcucuuccauauucagucuagcuuauauuacucuguuagaaucugauauuuaauaauagcuacagagaaagacaggagccauacaauaaugauaaguuuuuuaaagguccaaauuauauguauauauuuuuccaugauaaagcgucuugugaacuaacaaagaaaauucauauuaacaaagaaaaaugguuaggcuucaguccaaacaagggaaauaauuuaaagcuucuguaauuggugagugaagggaugcacaggaauugaagggaugcacaggaauuggcaggauuuagggauuguugccuuuuguagucuguuuuauuauuugauauuugguucauuuuucauaaacuucaaacacucagcucucaaacaugaccuaccuaggccucuucucauauagcaugcuuuguaaucugucuaaccaguauagcuuggaagcccuaauacauucauacagcagugcuuuuugaguacuuacuauguauaggcauugguggguauuggagauguggugaugaacaaaacauacaauuccugcccuuaggagcuuacagucuugagagugaagucaaacauuuaacaaaucuaaugaacaugugugcacauauaugugucucucucuuuauauauacauauauuuuucauauucaauguagcuucuaauauucuauuggaauacuauagucaauuauacacacauauacacauauacucccccuaccccucacacacacgugcacacacacacgcgcacacacacacgcguguacauauacauacacaucugacaugaauaaauguaagaaggaacacagcauauuaagaggaacugaaggaaguccagugugauuggaaugcagagggcaagggggugauaguuggaagagaccagauauuguaagaaaucaagacuuggugauuaggagcugguuuuacucaucauucugucuagguggaugagagcccuccugauuuugaaauacauauaacuaugugugaugaugauccacccacaccugaggaagacucagaaacacagccugaugaggaggaagaagaagaagaagaaaaaguuucucaaccagaggugggagcugccauuaagaucauucggcaguuaauggagaaguuuaacuuggaucuaucaacaguuacacaggccuuccuaaaaaauaguggugagcuggaggcuacuuccgccuucuuagcgucuggucagagagcugauggauaucccauuuggucccgacaagaugacauagauuugcaaaaagaugaugaggauaccagagaggcauuggucaaaaaauuuggugcucagaauguagcucggaggauugaauuucgaaagaaauaauuggcaagauaaugagaaaagaaaaaagucaugguaggugaggugguuaaaaaaaauugugaccaaugaacuuuagagaguucuugcauuggaacuggcacuuauuuucugaccaucgcugcuguugcucugugaguccuagauuuuuguagccaagcagaguuguagagggggauaaaaagaaaagaaauuggauguauuuacagcuguccuugaacaaguaucaauguguuuaugaaaggaagaucuaaaucagacaggaguuggucuacauaguaguaauccauuguuggaauggaacccuugcuauaguagugacaaagugaaaggaaauuuaggaggcauaggccauuucaggcagcauaaguaaucuccuguccuuuggcagaagcuccuuuagauugggauagauuccaaauaaagaaucuagaaauaggagaagauuuaauuaugaggccuugaacacggauuauccccaaacccuugucauuucccccagugagcucugauuucuagacugcuuugaaaaugcuguauucauuuugcuaacuuaguauuuggguacccugcucuuuggcuguucuuuuuuuggagcccuucucagucaagucugccggaugucuuucuuuaccuaccccucaguuuuccuuaaaacgcgcacacaacucuagagaguguuaagaauaauguuacuugguuaauguguuauuuauugaguauuguuugugcuaagcauuguguuagauuuaaaaaauuaguggauugacuccacuuuguuguguuguuuucauuguugaaaauaaauauaacuuuguauucgagucucgucaau

SEQ ID NO: 191969 - RNA, 30804 nt, Homo sapiens
uuauuuaaauuauuuuauugaaggagauaaguuacucagauauuaacugguuguaggcaaagggaauaaacauggugaagucagguuugcugguaaaggggagacaguacuaaacgcccugcccaacaaauacucagaauccaggguuuucauauuucuccaugguucaaucucucacaggucacuuuccauucaaaggauuauggagaccaaauaagacaggauucuuucagguaucaacccagagucuuuaggucuucucucagccaaggcaucgagugaaaauacaauuuauuuuucggauuccucuggaggauuaaaaaguuucuuucgcauugcaaugccaugcucccugcucuugguccuguuuucuacguacugaaaaauaaaagaagggggggagaaaagaaacagcagauuaugucacuauuuauagcaguuuacuauuuagaaauauuugcaaaauauaaauguccuuugagguuaacaggguuuaaauuuuuuaaacauguucuuacugacaaaauucuuaucuuuuauuuaaccaaaucugagauuggaaauaguuaccuuagagaguaucucauaucuagcacaauuucauucaauacaguacagcaucuacaugcuaauagaugcacaaauguuugcucaaucaauuuccucccaaaauuugaauuaaauaaguacugaagaugggcaaauucuguccauguucuccaggggcuugcagucuaacuaguccucuaacuucugcugaguaccucuaguggagaggcucacuuccuugagagguagccugucuaacuguugggacaauucuacucauucccaaguuuuucauuuuaaaccaaaagugcuucccuguaaacuccuugagagguagccugucuaacuguuggacaauucuacucguuccaaaguuuuucauuuuaaaccaaaagugcugccuugucaacuaccaccuuuuauuucuucuugucugcuauaauuuucaaacauuuaauuacagauaacccacuuacuaccuuuugcgcugaacauugcuaguuuccacaacugcugcacagaacacagccuccaucuuuuaauaucuaaccuauaaaaugacuuuuauuucauaaagcacuuuaacauuaaugccccuuaccaaaaaaaaaaaucacaaccaaaauugaauacagugcuccagucacaaugacagacauagacuacagugggccuacaucuuagaccagcucacauuguauuucuuuagacauuaucaagaguaacuagcucuuagcaaccauauuauccuauugacucauauggaaauacauagcucaacuucccaagguuucuucaucacgaacaguuaacaaaccugauacuccucaaauccuauguuucuuaaucagcuacauauaaacacaguuuucaccucaagagguuuucagccuaguauucugaucuggccagcagguuacaacaggagacacaaagccuggcacuuagauuuucuuaaauaguuaaccuacauuuaaagcagaggaccuuaaaaguguuuuuauauguauauauguacaugcuuauaauacauacaccaauccaacacacuuuaaagguggaugaguguguuuuccccugggcagaaggggaaaaggguaaaaguaaauucaaacagaaaaaacugaaaacaugugaacaguuaaacaucagaaucuuuuaggagccacagaucuggagagcgaggccacagaaauuaaagauuagugauaccgagcucaucagggacaaaccccgccacccaagagagaguaaugaggggauucaugacuuugaguuacuucacucuucuggaccaguaacuucaaauauaaggaggugggcuagauaaucuuuaagaaguuuucuaggucaaaaguuuugacugaaggauucuaacauaucuucuggaaugguaguuuucaaacuuuuuauuacuuccuugucaaaaggcuacuucaggccgggugcggugacucaugcuuauaaucccagcacuuugggaggcugaggcgagcagaucaccugaggucaggaguuagggaccagccuggccaacauggugaaaccccgucucuacugaaaauacaaaaauuagcagggcaugguggcaugcaccuguaauuccagcuauucaggaggcugaggcaggagaaucacuugaauccagaaggaggagguugcagugagccgagaucgcaccacagcacuccagccugggugacaagagugagacuucgucucaaaaaaaaagcuacuuuaaauuacacaugaagcaccaggucccuucaaagucauucauuuuaucuaucauacauuaaauuuacucauaaaauuguuggggaaaaaaucaauaaaacguauucuagaacaaggaaggauaccugcucugagaaaaagcuuucauaucuaccuuuaaucacgucuacuggauugcccccagcaaucagguugagaagggucuuaagggaaacucuucagaagauaauacuuuguagcaggccaauaaaauaaguuacaaagcaaauuaaaauauagucuacauuaaaauaugcuaagacaucuccaaaggaaguccagauggucccugaauaaaaggggagaaaaggaugaauaugaaguuacucacaaaacucaaucaaacaauacagacagaaugaaaggccaauuaaccccaaaccaaacaaaacaauuaagagggacaaaagagaaugccacaaaaguacuauuaguguuucuuuucaagaagaagaacaaaaggccaggugcaguggcucacaccuguaauccaaaacuuugggaggccaagaugggagaacuccuugagcccaggagucugagaccacccugggcaacacaacaagacuccaucucucuaaaaaaaagaaaaaaaaaaagaauaaaaggagugacacagcggagucccaacaagaaauggccauacccuuuuucuacuuaaaagcuucauggaggcugggcgcaguggcucacgccuguaaccccagcacuuuaggaggccaaggcgggcggauaacaagcucagaagaucaagaccauccuagcuaacacggugaagccccgucucuacuaaaaauacaaaaaauuagcugggcgugguggugggcaccuguagucccaguuacucaggaggcugaggcaggagaauggcgugaacccgggaggaggagcuugcagugggcugagauugcgccacugcacuccagccugggugacagagugagacucuggcaaaaaaaauaaaaaaauaaaaaagcuucauggaaugaaguaaucagaugacauaugaagcaaacaguagcaggaaagcaucugaagcaagcauuaagaguagagaagaaauacaugagugcagacucagagauuagugaugggcaagcagacagaaaaacaucuacaaauuagagaauaaacaucuacaaauuagagaauaaaguaacauaacuacacagaggacuuagaaaagaauucaaagagaaaacaugagauguauaggaaaacaaacucagacaaaauaagaaaaauaucuccaacggucuaccaaaaagucacuaacagaucucaggccagcugagaagacaauuucauaugaagaucuaauugacaaagcaguggcaaaauuucugaacuauacaggaaaaaaauuuaaaaacaugaaaaaaaccuauguuauacagcugaaaguauguaaaaaacaaauagccauacugaauaaaauaauaugagcuauauuuuuccauaagcuauuuauuuuauuuauuuuuuauuuuauuuuuuuuuaauuuauuuagagacagagucucucacucugucacccaggcuagaaugcaguaaugugaucugggcucaccgcaaccuccgucucccaggcucaaguuauucuccugccucagccucccgaguagcuggaacuacaggcgcccgccaccaugccuggcuaauuuuuuuguacuuucaguagagcuggguuucaccauguuggcuaggcuggucucaaacuccugaccucaggugauccgccugucuuggccucucagaaugcugggauuauaggcgugggccaccacacccggccaauauuauuuuuuagagauagggucucacucugucacccagacugaagcacuguggcgaccuagauagcucacugcagccaugaacuccugggcucaagcgauccucccgccucagccucccaaguagcugggaccacaggucugugccaccacacuuggcuaaauuuuaagagauuucuuugagacagggucucacuauguugcccaaguuggccucaaagcuuucaccucaaaggauccuccugccucagccucccgaauagcugggauuacagaugccagcucacaaguuuacuauuaaagaaacaucacccuagguguauuuuucauguaaacuggcuuuuucauauaaaggacaaacauuuuuaguaaauaauuuaaaaacacuaauaaggcugggaauggugacucaugucuguagucccagcacuuugggaggccaaggugggaggacugcuugagguuagcaguuugagaccagccuggccaaaacagugagacucugaucucuacaaaaaaauguguaaaaccuuaaccaggcauggugguacgcaccugucguccuagcuacucaggaggcugaggugggaggaucacuugaguuugaggcuuccgugaguuacgaucacccuacugcacuccagcuuaggugacagagcaagaaccugucucaaaagaaaaaagaaaaaaagaaacaaacuauuacucuucacugaguacuccaaaaaguucuucaaacaguaaaggugaaugucacaauuuaaagggaauccaggaagggaaaaacagccuaagcagaaaacaaaaucaaaagaaagauguuggacaacuucaaauauuauauuuaaaucuuucaauaugaggcaaaaaaaaaaaaaaguucaaaaauaacaaaaaugauaucugaaaggcaaaauuuuagccaucauauauuuuuaaaaguucuggacacaaaaaaucugauguaugaaacagaaauugaaucaaauuucuuuucaaagguuuaaaaugcacucugcuuauuuggcagugccuggaaaaagacaaugaacuguguacuguggcuauuugcccaaguccaaguugugcccuaaaaucaaguucaggagaugacaguguuccaaaacaagucaaauuagaucccuguggcuuacacaaaccauaacuacaaagaaauucaaaauguuaaagcugaaaacagccuaauucuagccuccucaauuuauauauagaaauugaggcccugagaguuuuaguuaccuaccaaucagcuaauaggugacugauauaagucuuucugccggccagagauacaacuuccuaaaccauuaaauucauccagaugaccuacaguaaucaucauaaggaaguuguuuuccucauuuguguucauggccaaaaagccauguucuaaaacuguccccagaaaagcuuucauuucuuccccuaaacagaggaaguucauacauguaaagucaauuuucuguuacacuaaaaugugggaaaaauucaauaauggcaguaauacacaauauucaaaaauguucuguucuauuguucaaccauauccauccuuugacacuuuucuuaccucauucuucaggcauuuucucaacucccgaucaacaucauuacaauaaccaaaaaauuucagaauguugugcuaaaaggaagaaaaggaguaaaauauuucaucccauaauaugccaagguuuggggcacauaaaauuuaaauacugccacagacaugaguuuacagugucacuuuguuaauaaacaaguaauaguuaaaucacauguauaaaacacaguuggcccuugaacaacauggauuugaacugcaugaguccacuuauaccuggauuuucuuucaauaaauauauugaaaacauuuuugaacauuuggaacaauuaaaaaaaaccucacagaugaacuaccauagccuagaaauaucaaaaaaauuuaagagaaagauacggcauaaauguguaaaacauguaaauacuggccgggcacgguagcucacaacuguaaauuccagcacuuugggaggccaagacggguggguggaucacgaggucaggcgucaagaucggccuggccaaaauggugaaaccucaucucuacuaaaaguacacaaaaaauuagccaggcgugguggugggcgccuguaaucucagcuacuugggaggcugaggcaggagaacugcuuaaacccaggaggcggaggauguagugagucgagaucgcgccccugcacuacuccagccugggcgacggagugaaacuccgucucaggaaaaaaaaaaaaaaaaaaaaaaaaagugaauacuagucuauuuugucauuuacuaccauaaaacauauacaaauuuuaaaaagauaaaauuuaucaaaacuaacacacacacagaacauaaauagcaucauucaaauuugagagaauuguaagcaaacauaaagauauaucaaaucacaacuacauaaaauuaacugcgguauauacuguacugccguaauaauucugaagucaccuccuauugcuauuacacugggcucagacacuacaauuauccacuuauaacacccugugauaccaauaacauacacaguaagcaagucauguuuacuguaauaaccauaaaacuugaauaacaccaugggacccauacgaagugccacuaguaaugcuggaagugcucccaagaagcagagaaaaguaaugacauuacaggaaaaaguugaacuacuugaaauguacuguagauugaggucugcagcugugguuaccuaccauuucggacugacauacaucaucuuguaaacagaugauguaaacuuacaauaucaauaaauacaauaccauaccauaaauguauuuucucuuccuuauuuuuucucuagccuacuuuauugcaugaauacaauauauaauacauauaacauacaaaacauguguuaaucaccuauuuaugcuaucaguaaggcuuucagacaacaggaaacucucagacaaguuuuuggggagucaaaaaguuauauguggacuuucaacugcaugggggucagugccccgaacuuccaagcuguucaaggaucaacuauacaaaugaacaaauuauccugguucuucuuacaaagaaggaauaaauguucugcaaguagaaacaaagauuuaaagacuuuuucuuaaugauagggaagccuacuuacuaacucaccaaaaccucacaaagacaguauaaaaguuuuaucauaaccuaacacccuuuucuuaagggaaauguuaaaaucacagcacaauccauucucuauuacagggaguggugucaagcugcagcauggccacacugccaugggcagaguaacuucacuaccaaacacuguccuguaaaagaguuaucuaauaaaugcuuagugccagagcccuuuucucauuugcccccauucaaaaugucaccaaaauacaucaaauaaguaacacagaugcgcgcaguggcucacgccuauaaucucagcacuuugggaggccaaggugggcggaucaccucaggucaggagcuugagaccagccugaccgacauggagaaaucccaucucuacuaaaaauacaaaauuagccaggcaugguggcauaugccuguaaucccaacuacucuggaggcugaggcaggagaacugcuugaaccugggagguggagguugcggugagcugagaucgcaccauugcacuccagccugggcaacaagagcgaaacuccaucucaaaaaaaaaaagaaaaaaaaacccacuaucauuagaugcccuauaaaggucauauaaauaagccacuaauuuacaauauaaggaaaucugccugaaguucagucugauuuaaaaaauaaaauaacaucuccuaguuguuucuaguccuaugaguauuaucguggcaaaaaguaugcgugcucuaaagcagguuaagcugaagccugaaguuaagaaccugaauuucaguaggaacauaauuaguguguuugcacuucacgauuuucaagggugggucagacagcauggugaucuguuuuauaaugacaggucauaaaugcugaacuugguaguuguaauaauaagcacaucuuuuccuuuucguucuaauuaaggcuuucauggaaaccagacaacacauaauuaauaagcuaugccucaugcuauuucuuuuuuuccugcuucaccaccauuuuaaacguacguuucaauuccacacugaauaaguggucaguuuuuccagaaagcauuuaacauagacuaaagucuccuauuuguuaccuaaugaccuuuccagaauaaauuuuuuaauuaaaaaaacuuuuuguacuuaauuuuuauuuuacuuuuuucuuuccucuaucauucccaaagaauaaauauuuccuguguauuuuacuauacuacuacuuccuugacaacaaauaaacaugacaaugcauuuucaugccuucaagucaaguagacuuuucaaaugugaggcaauauuacauaguugacauuuauucauaucauuccacauauguacaucuuaauucaaaaauccaugacaaaaacuaauuuauaugcuuccuuuuaccucaauauuaacuaagguaaaaugagaauuauacucuugugauguuacaugaaaaauauuagacccaagugccccagagaaauugguagaagaaaugcccacaggcuacaauuuucuuauacuuacauggacugagucucuagugccuggugucaauuucuugagaaccaaaccaaccgaguaacugauugaauaagugaaucaacagauaucugcgaaccuuuuacauaaagaacaaugucccagguaccagggacacagaagugagcaagguggaucuggguccuacucucacaguacauagucagagggaaagaggcaaauaagaagucacugccauaaagcagugguucucaaagugcaguccagagacaccgagggguuccugagaccuuuucagggaagguacaaggucaaaacuaucuucucaauaauacaaaaacauuuguuuuguucauuuucauccucccacaaggguauagcggaguuuucccggggcuacaugaagucuaacaucacaacagauugaauguagaggcagacaugagaauucagguauauuuuauuaauucagacauuuaaaaaaugaaaagcaaugcaauucuuuucgcuuuuuucugguuugaaaaauaagauuuucgugaaaaauaacuaugcuaacaugucaucuuaacauguaaaauuauaauuuaucauuguaauuuuaaaauaauuuuuucuucauuucucagccuucauuucuaauccaauaaauauuguagauaucacccacauaaacaauagcucccuagaauccuaaauaauguuaaaagagugcaaaagaguccugagaccaaaaagugugagaacugccacgaaggagaaaagcuguuauguaugaugcuacucaaacagagugacugcaccaggagaaucuaggccaggaaagggaaaaggaaacgaccaacuaagcugaagaaaaccugaaggaugauaagaccugguuuagcaaacaguaaguggagccaggaggaaugcacuaagcucagcaaaggaaaaaucaaggcuuggaagacagaaauaucauucucccauauaccugcaaaaaaaaaaaaaaaaaccacaggaaugaaggggaaggagcugugggagaguggugaagacuaacagcuacucaaggaugaguuucauuaaggacuugaaacacaaggcaagacauuuauaacgcauuguauaggcaaaaggaucuauuaaaaaggugacaaugagccaggugcgguggcucaugccuguaauuccagcacuuugggaggcccaggcgggcggaucaccugaggucaggaguuugaggccagccugggcuaacauggugaaaccccaucucuacuaaaaauacaaaaauuagccaggcauaauggccugguaccuguaaucccagcuacucgugaggcugaggcaggagaaucgcuugaaccggagagacggaaguuguagugagccaagaucaugccacuacacuccagccugggcgacagagagaaacucugccucaaaacuaacuaaauaaauaaauaaaaugcagauuccuaacagcuacagugagcugagauuguaccacugcacuccagccugggcgacagagugaaacuccgucucaaaagaaaaaaaaaaagguaacaaugauuaaacuuauuuuugaaagaucacucuaaauccaggguggaaaauugauuuaaacaaaaaagaaaacaaaaccgccaggagaccagauagaaguccuuuacagguggccccaauaaaaguguugccauggacuauggcaguggcacuggcaaaggagaacaaugguucaagagagauucggcagagaacacacagcccugguaaggacucacaggaagaggugaggcagauggaggaauuaaagaugacacuggcuuucagccaagaaugacaguggaaguuuuaaaaagagauaagauaaauuuguaucuggacauguugaguuuauugguggaacaguuaaguccacuaucuagcugagauaaaccuggaacucagagaaaaucugagccagagauacagauuugggaguuacugaaaccaggaaagcgaaugauuuuuugcaggaagguguagccuaggguauccugaagaguggccaaaaaaacuuaaggaaaaccagggaagagaaaguuaugguagaagccuguggaagaguguuuugagagggaaucaauugcugcugggagaaaagugagguaacuacugaaaacauccaccaaauuugccaguagugcagucauuagugaucuugaaaguuuugggacccuagugaggguagaagccaaccugaaagaagaaagcaguauucuuucaauagcucugaaagggacgcuaacacaagauaccagaaggcugggauuaugggaaggaaucuuauguauuuauuuucucacgauggaaaaaaagugggcauuucaaaaugcuaauaagaagaagagaaaaagggaaaauacaaaaauuuuuaaaugguggaaaaacccaguacuuagugaguuuaucucuggaugguugaacaaaagguaauuuuuguuugcuuuauacuuuccuacuuuuuuaacacuaucuaaaaugauauguauuauuuacauauuacuuuuauaaaucagaaaaaauacacaaggauuuccaaguagcuuugacgaaauaagcuguucuaaauucuguauuuuaccuucagaugcaaagaauaucuaagucuugcugacaaauuuaggcaaaauaggccaguagaucagaagccacccacagacaccugaaagcuguggaaauaacacuugccugcaaagaucacagcagaacuauaaaagcacggaaagaaugauaaaagcacagcaagguaggcuauuuggagauaaaacacucaugcacuucaagcagguuggagagcacugcagcauuccagcacagacagggguauucaggaagacuaaucaacaaaaaagacuaaaacagaauuacacaaacucagggcuagaagacaucuuagguaauauaauucacucgauuuauuaauuaaauaacugggaucaggccaggcacaguggcucaugccuguaaucccagcacuuugggaggccaagguaggaggacagcuugaagccaggaguuugagaugagccugggcaacacaggagagccugucucuaggaggaaaaaaaaaaaaaauugaauuagccaggcaugauggcacacaccuguacucccaucugcucaggaggaugaggcagaaggaucacuugagcccaggaguucaaggcugcugugaacuuugauugugccaccgcacucgagccugggugacagagugagacauccucccgauaaacuuuuaauuaacuuuucccccccagauauagaccugcagaauuaugguuguuuuaagucacuaagugguggugguguugcuguugagagacauggucucacuccguugcccaggcugaagugccggagugacaucauagcucacuauacacucaaacuccugggcucaauuuaacacuuaaaaagugcaagucuucagaaagaucaguuagguaaaguauuucuugaugacagcagaugucuuuaaaaacauuugucaauuucaaacuugaagaaaaguuccaagaacaguacaaagaauuuccaaauaguaacauuucaccaaauuugcuuuauccuucuagcucuuacauauacacccgagcuuuucuucugaaccgaguaaguugcagauaugaugcacguuuccuaaaaaaaacaaggacuuaaauuuaagucuccauacgauuaccaaaauuaggaaauuaacauuaacacuaguaucuaauuuauagaccuuauucaaauuucaccaauuugccuaauaauaucauucaugcaaaaggcaaaaaaaguuggguggguuuuuuuucccgauccaggauugccauugcauuuaguugucacgucuuuuuagucuuuuuuuuuuccaacucuaaacaauauuuuucuuaucuuuaaucuuuauuugaaacagcuugucucuuuuuucuuucauuaccuuaacauuuuaaagaguacaggccaguuauuuugcaaaaugcucccccacguggguuugucugguguuucuucacaacucgauucaggucgugacuuuuuggcaggaauacccuagaagugauguugugucuucaguguaucacaucaagaggcacauggcaauuugucccauuauugauguuaacuuuuauuaccuagguaagaagcuaccugccaaguuucuacaccguauucguuuuuccucucuaauuauuauggggacacacuuugagaccauuuaacuauccaauuauuuccucaaacuuuucacccacuaguaugaggaucuauuaaugauuacugacuaaaucaauuacuacuacaacaguuaacaaaaagugauuuucuaauucuagcacuccucuuauauuuuaguuggcauucuacuguaagggaaacuuucccuucucauccauuuauauauuuauaugaguuuggacucauggauccuuauucaauugauuauauuauuuucauuacuuugaugcucugccccauuuuuggccagugggaaucccuucaagcuagccccuguccuuuuaacagucccuaucauucuuugauaaaugucauacuuucugguacaagauguugcagguucuucuuguucuuucccagcccuagcccuacaaucagucauuucuccaaggaucccuguuucuguuuacggaagagcgguauuuaaaaaacaaaaucugggcguuacguaugcucauugcuacaggaaaacauauauugaauauauacaugaaacaaacauagacacacauuaucuauucuacaucuuauauauauugaaaaccaugaguucacacugauaccucuaauuccaauccaacaucacaggauacauccuagucuuuccacuucuauauuuaugacaguaagaaaccugucucuuuucgucuacaauauguuuacuuauuugcucagucuuggaauacacagaauacauagaagccagugucagaacugccaauccacacugcugcaaaauccauacuacuaacaacagcucuacuuugucuuuagccuacguucaaauuacuuggguuaguucauuuuuuucuuuaguguaauuagaugacucauuucaaguaaguuuguuugguuuugcuuguauuccauuuuugaguuuucuucccaacucugcucauccuuuuuuucauucccuccccuuuuuuugaguauaugaaacauuaacaaaguucaaacagcaugaauuauacaaaacauauaauuuuuuucuguuguuuuuugagacacagucucacucugucacccaggcuagcguccagugacacagucucagcucacugcaaccucugucucccagguucaagugauucuccugccucagccuccugaguagcugggauuacagggguccgccaccacgcacagcuaauuuuuuauuuuugguagagaugaaguuuugugauguuggccaggcuggucucaaacuccuggacucaagugaucugcccgccauggccucccaaagugcugggauuacaggcaugagccaccgccaccggccaaaagauuuuguaaaagugucacuccuccacucucucugcuuugcuccuaccaaccucucagaacguaaucaaucucauuagcuucugguuaucuuguuucuuuuugcacaaaugaagagauacaaauauguuuugcuaucuucuccuccuuuuuuauacaaacgcuaggauacuauaaauacuguuuuguccuuugacuucuucacgaaauauauccuggaagucauuacauguugguucaaagaaauuuuuuuuucuucuuuucagaggcagggucuuacucugucacccaggcuggaaugcaguggcacaaucaugacuuacugcagccuugaccucccaggcucaagugauccucccaccucaaccucagccuccugaggagcugggacuacaggcaugugucaucuagugacauaauuuuuuuuaauuuuuucuagaaacaggugucucacuauguugcccauguaggucuugaacuccugggcucaagcaauccucccgccucagacucccaaagugcugggauuacaggacugagccaccaagccuggcuuuuuuuuuuuuuuuuaacagcugcacugccaacugaaagacucucaguggccaaagcuggaacaauuugagcaacaaaacaaaguaguauuggauuauaacccaagguauaaaguaaauauacaugaguccauacugacauaaguaaauaaaugggggagaacaggcaacucuccagaacagaauuccacaagauuauguagauacuccaccaccuuggaggaacaggguaacuucccaguccuuacguguaggcugcacacagugacuuccuuccaaagaguuaugaaaagggagaaaaagaguaacuucaaagcagagaaaccuagccacgugcaauagcucacaucuguaauaccagcacuuugguaggcuaaggcagacagauugcuugagcccaggaguucaagaccagccugagcaacauggcgaaaacccguucucuacaaauauacaaauacaaaaaauuauucgagcauggugacguggccuguagucccagcuacucgggagggugagaugagaggaucacccaggcccaggagguugaagcugcaguaagccaaaaugacacuacugcacuccagccuggaagacauaguggacccugucuccaaaaaaaaaaaagguacagaaaccuaacacguaucucagccaggugaucaacgucaacauuaacagugauaaauuauguuguaguaugcagccuugaugaaaauguacuuuaccucuguggucuucauccgaaaacacaugaucccaauccaauuaugaggaaaacaagacaaauucaaacagaggagcauucuaccaaauaccuggccauuaugccucaaaccuuuucgggucaucaaaaacaaagaaaaugucacagauaacaggagccuaaagagugacaagaacuaaguguaauguguauccuggacggaauccuguaacagagaaaagacauuagguaaacacuaaccugaagcaaucugaguaagcauggacuuuaaauaacgaucauguaucaauauugguuuauuaacuguaacaaacaccuuaucaauguaagauguuaauaauaagggacacuagaugugagguauaugggaacucccuguacugcauucacaauuucucuguaaaucuaaaacuguucuaaaaaaacaaagucuauuuaaaaauaaaaauuacaaaacagcuguauagugcuccauuguguggaugcaccauaggucguucaacuacuuuacguugggaaaguguguucccaacauuuuccaagugcaaacaacacugcaguaaauaacucuaugcauacauuuuuucauacuguuagaguuauacuuuuaagauaaauuccuauaagugggacugauggauuaaaaagcaaauauacggcaguuuugcuacaaggcagcaaauuccucucuauaaagauuauaacaauuugcagucccaucagaaauguaugaggguauacaguguugccaacagaaugcgcugucacacuguuuaauuuggccccccugcagauaaguaaugguauguucaguauauuuaauuuguauuucucuaauuauugagguugaacaucuucucauguuuaaaggccaucuuuucuuuuuuuuuuaaauugucucucaugcuuuugcucauuuuucucucugauuuuuggccucuuauucccccuccuuuuuuuuuuuuuuuuuguguaaagacagggucucacuuugucacacaggcugauguguuguacugcagccucaaacaacuggguaagugauccuacuaccucaaccuuccaaguagcuaggacuacaggcaugugccaugcccggccacuuuuauuuuuauuuuuuguagagacaggaucuugcuauguugcccaagcuggucuggaacuccaggccucaaacgauccuuuaucaaucuuugauuuuauugucucuggaauucaggguccuuacuuaggcacacuuuccccacaccuagguuauauaagaauuuauccagguuucuuaguguuuguaucguuucauuuuugacauuuagaugucugccccauuaguugauucauauguaugguauucuaacuuuuuccaaacagcuauguaauuguccccaugcuauuuacuuaaaaaucuauuuuccagacuucugcuucuagccaugaaagaacaaacugaauauauaaaacaacuauuuucagauauugggacaacagacuacaggacugugauaacugaaagaaaaaaacaaaacaaagugaacccuacauucaccuagcuuucuacccacagacaauuuccaaaccauguagcagagaacagaacucaagaggagaaugguaguuucaccgagcagaggaggcaaacgucagaggaauucgggcaggcuggggcagccggaauuugugagguagagauaagcagcaaaagaacuccagaaaucuacauggagcugccuugagucacugacugaguauucacuacacauguauugggugacuuucacaaugccauagucacuacgaagaacaauuacagcagcuacaagcugaaaaacgcagagcucacacagggcugggagucaauggaguccuuauaagccaaaguagagaucucauugaauaugcaagucaaucaguaaagaauccuaauuuaguaauugggcuaagcuaacucuagaguaaagacuaugccagcuaugcccuaaaaauauguaaaaacacgaacugccugcugauacaaaagauaaaauccaagucaucaacaauguucagccucaaaaaacaaaaaaccaguaaacaaguuuuuuguagaaaaugacaagcugauucuaaaauuaauauggaaaugaaaguacuuagaauagccaaaacaacuuugaaaaaagaacaaaauuggaggauuuauacuauaugacugagacuuacuacaaggcaacaguaauuaagacagcaugguacugguguuaagaagagacauauaaaucagugaaacagacuagagagcccagaaauagacccacucacauaugguaaauugauuuuugacaaagggaccaugguaaaucagcagggauagaacagucucuucaacauaugguguugagacaacuggcuacccacaggcaaagaaaaucaacuucaacucacaccucauacuauacacaaaaauuaacuugaaaucucagauaagaauacacaaauaucaaaagaaaaaaaugaaauuaacuugaaacgaaucauagaccaauguaaagcuaauacgauagaacuaaaagaaaauacaggaguaucuuugugaccacagaauacacaaagauccuuaagacacaaaaagcacaaaccaugaaagaaaaaaaaaagacuucaucaaauguacaagcuacucuuugaaacacauccuaaaggaaguaaaaaaaaaaaagccacagagaaaauauucacaauacacuuaucaaaggauuuguaucccaaaugauaaaaagaaugcuuauaacucagucauaaaacaauccaauuuuaaaauacaggcaaaaaauuuuauaugaauggccaaagaagcacaugaaaagcaugucaaaaucauuagucaucagggaaauacaauuuaaaaccaaaaggagauacuacuacauauccacacaauggcugaacuuaaaaaguuuauaauauuaggcaguggugauggacagugguaggaauguagaguaguauaaaauggaaaacaguuugguggccuuuuaugaagguacauauacacuuaacacaugaccuagucauuccauuccuagguauuuacccaagagaaauaaaaugauguuuacacaaagacuugcacaugauggcugggugcgguggcucaugccuguaaucccagcacuuuggggggccauggcagguggaucaccugagaucaggaguucgagaccagccugaccaacauaaugaaaccccgucucuacuaaauauacaaaaaugagccagguguggugacacacaccuguaaucccagcuccucaagaggcugaggcaggagaauugcuugaaccugggaggcagagguugcagugagccaagauugggccccugcacuccagccugggugacagagcgagacucugucucaaaaacaaaugacuugugcaugaauguucauagcagcuuuauccaaaauagcacagcugcaaacuguuuauuugccuaaauguccauuaauagguaaauaaacuguggcauauccauacaaugaacuacuacucagaaauaaaaauaaaugaacuaaugacaugugcaacagcauguuaugacccucaaaaacauaucauggugcaaaauauaggaauauacaauguaggccaggugcaguggcucaugccuguaaucccagcacuuugggaggccgaggcgggaggaucaccugaggucaggaguucgagaccagccugcccaacauggugaaacuccgucucuacuaaagauaaaaaaaauuagccaggccugguggcgcacgccuguaaucccagcuacuaggcaaacugagacaggagaaacacuugaaccugggaggcggagguugcagugagccaagaucgcgccacuacacucuagguugggugacagagugagacuccaucucaaaaacaaaaagaauauacgauguaguguaaauuucuaacaaauucuagaacugcaaaauucaucuauaucaacaaaaaguagugcagugguuaccugggcaagacguaaguuaaggguuggggacucacugcaaaggggcacaggaaacugauagaaauguuuuagaucuugacugugauggugguugcauggguaucuauauaugacaaaacucaucaaacuguauacuuaaaauagaugcauuuccuuacauguaaauuacaccucaauaaaguuaauuuuuuaaaauccaucuuuaguuccagugauucaagaagccaccuuuauuauaagaaauccauuugaaagaaaaaaaaaacaacaacguuuaaauagauuucaauuuaaaaacagucauggaccaaaaagcaauauacaaauauaaacauaaaacaaagauuacuuaaaagcaaggguugaaaaacucugccccuuaauuugauuaaccauggaaauaaauaugaugcgauaauauccuuauuuaugucuaguauuacaaaaagcacaacauaaaucuaaagggcuauacuggcaaaauccucaauaacaagacugaaauguuauuccacagagucucuuucucuccgcugugccucucuguugccagacccucuccccuuuucugucucugacuauaacugaccauauacaaauugaaauauucuacuuuaacacaaauaauuaguucuuguucuuuaaacagugaauauuuuauauaguuuuuacuuuaaaaaucaaaacguuauguuuuauugauguagucuggcucauuugaucuauauguauagugaaauagcccaaaaaauauugucaucaacaacauucuuugaaccaguaaaaauaucugacuucacauuuuauaagcacuacuuaccaccuuacuuuuggucuauaaauuuuacucauuuaagugauacuuuauauuauuauaauuugauauaucuacaguuuguagacaucaugagaaaaacuaugcaaagcuaaagaaaaaacaaaugcuucuuguaacaacggugucauauaucaaacauauaaggaaaagcuaaauauucaacagcuauaaaaaugucagcuugauuuaauguauuccaaauauggaugggcuccuuuucuauuuugguuuuaaccauguaauuuuacuuccauuccacuaacaacuaaacacaucagauuaagccaaucauaaaucuaguuaaugucuaauuauauaacacguuucuauuaccauuaaacacagaaugguagccaucaaagagcagauacuuuuagaauaauuccauuauaaucagaagugucagcgcugaauauaacuguucuagugcccuauaauuaggaaagagaaagcauuuuauuguaagaacauggauuccaacuguuacauaccaguucagacguucccuaacaaacuaccaugucugauuuuuacuaaucauaaaaggagguaguuuguguaaaaaaaagaaaaaaaucgcacauaucaacugcuaaucuugacuaaacucagacuccuuacuaagacauuaucguuuccuucuaucaacggagauaacauuuuacaucaguggguuauaacuaaguuucauuuuggcuguacagucguuuuucugaacucuuacauuuuugugacauuccuuaagcaaguuaaucaagacguugcauucuucagugugcaaguguggagauaagucaggaugcaucuuuaggagaugaggauggaucacagcagugcaaccuguggauacaagagugucuugaauaugcauaaacacauuuguuacgccaccuaaaaguaucuucauaagaaccucuagugaccuuuaucagagaaguauguuaaccauuaaccagcugugugaccucaggcaaauuauuaaacuugagacaaagcuuucuaauucaaugauuuaagauauucagcaaguuaucaguaguauuuagagaaccuacagguucaggagaaaagcaggaagccucaagagacccaaucccggaaauaagcacuaaagcagaaacagcuugcuuauauuaauaagccugacuucaaauauuuucgccacauucucgaaauuaacaacucauuuuguucagaugaaauucuaccaauuaagagaauuggcuuauuauuuuaaaauguauauuauucugaggguuaaagggucauuagucucauauuagugugaauauagauugcuuuuuucuuaauagcuggcugaaaaaaaaacuaaacaaugaaaugaaaccagaaguugugaaaaaaaauuucaaauuuaacagauauagccauaaaacuaauuauuacacugaaaacaugaagcugaaaucccugaacuuaaguuuaauuggaucauccacaagguggaaaauuagcagccaaggucaaaggaaaaacaucaugggcagcuguucuuuuuuuuuuuuuuuuuuuguagucaggggucuugcuauguugcccaggcugguuucaaacuccuguccucaagugauccucagccucccaaaguguugggacaggcaugagcuaccgugccccaccugggcuuaaccuacucuaacucagaaaugauuaccaaaagaaagaaccgauuaccugcuuuaauuuuuuuuaaaguuccaaauagaaaacaggaaccaacccauauccauuaggauggcuacugcugaaaaaaaaacagaaaauaacaaacgcuaaagaggauguggagaaacugaaacuccugcgcacugugggcgggcauguaaacugggauagccacuguggaaacugguauagcaguuccucaaaaaauuaaaaaugaaauuaccauaugauccaacaauuccacuuccggcuauauuuucauaagaauuaaaugcaggguuuugaagagauauuugaacacccauguucacggcauauuauucacaauaauuaaaacauggaagcaacccaagaguccaacagacaauggaucagcacaaugugguauauacauacaauggaauacuauucagccuuaaaauggaaggaaauucuggcauaugcuacaacauggaugaaaugugaggacauucugaaugaaauaagccagucaaaaaacauauauauaggguucaacauacgcaaaucaauaaaugugauucuccacacaaacagaauuaaacacaaaaaccaugugauuaucucaauagaugcgaaaaagccuuugauaaaauccaacaucccuucaugauaaaaacccucaacaaacuaggcacugaagaacauaccucaaaauaagagccaucuaugacaaacucacagccaacaucauacugaacaggcaaaagauggaagcauuucccuugaggaccggaacaagggaacaggaugcccgcucucaccacuccuauucaacacaguacuuauuuccuagccaaagcaaucagucaagagaaauaaaaggcauccgaauaagaaaagaagucaaacugucucucuucacugacgauaugauucuauacccagaaaacccuaaagacucugccaaaugacuugaguaguuucaggauacaagaucaacauagaaaaaucaguagcacgucuauacacuauaagguucaaccugaaagccaaaucaagaauacaaucccauuuucaauugccaccaaaaaaauaaaauacccaggaauacauccaaccaaggagguaaaagaucucuacaggaagaacuacaaaacacugcugaaagaaaucacagaugacacaaacaaauagaaaaacauuccgugcucauggauugggagaaucaauaucacugaaauggccauauugcccaaagcaaucuacauauucaacacuacuccuaucaaacuaccaauggcauuuuuucacacaauuagaaaaaacuauccaaaaauucauauggaaccaaaaaggggcucaaauagccaaaagaauccuaagcaaaaagaacaaaaaccaaacguaucacauuacccuacuucagacuauaaggcuacaauaaccaaaucagcaagcuucuccuacaaaaacacacacauggaccaauggaacauaacagcccagaaauaaagccacacacuuuugaucuuugacaaagucaacaaaaauaagcaauggcaaaaggacuucccauucaauaaauggugcugggauaguuggcuagcuauaugcagaagaauaaaaguggaccccuaccuuucaucauauacaaaaauuaacucuagauagauuacagauuuacacagaaugccucaaacuauaagaauccuagaagaaaacccaggaaacaccauucuggacauucaccuucggaagagaauuaggacuaaguacucaaacacaauuacaacaaaaacugaaaccuaauuaaagaucucaaaacagcaaaagaaacuaugaauagaauaaagacaaccuacagaauaggacaaaauauucacaaacuaugcauccaacaaaggucuaauauccagaaucuauaaagaaauuaauucaacaaguaaaaaauaaauaaucccauuaaaaagugggcaaaaggcugggcacgguagcucacaccuguaaucccagcgcuuugggaggccaaggcaggcagaucacaaggucaggaguucgagaccagccuggccaauauggugaaaccccaucucuacuaaagaugcaaaaauuagccgggugugguggcgggcgccuguagucccagcuacucgagaggcugaggaaggagaaucgcuugaacccaggaggcggagguugcagugagccaagauggcgccacugcacuccagccuagguaacagagugagacuccgucucgaaaaaacaaaacaaauaaacaaauuuuaaaaaaaagugggcaaaagacaucaacagccacuucucaaaagauauacaaguggccaaaaaacaugaaaaaaugcucaacaucacuaaucaucagagaaaugcaaaucaaaaccacaaugagauaucaccucacaucagugagaauggcuauuacuaaaaagucaaaaaaacacagaugcugggggagguugugagaaaagagaaugcuuauacacuguugugggaaugucaauuaguucacccacuguggaaagcagucuggagaguucucaaagagcuuaaaacagcuaccacuagauccagcaaucccauuacuggguauauagccaaaagaaaauaaaccguuuuacaaaaagaaaaacaugcacucauaaguucuuuguagcucuauucacaauagcaaagauauggaaucaaccuaagugucuaucaguaauggauuggauaaagaaaauauguacauauacaccauggaauacuaaacagccauaaaaaaggacgaaauuauguccuuugcagcaacauggaugcagcuggaagccauuauccuaagugaauuaacgcagcaacagaaagccaaauauggcauauucucacuuauaagugggagcuaaacacuggauacucacagacauaaagauggcaacaaaagacauuggggacuaauagacgguagaaggaggguaagggcugaaaaaccauuagguacuaugcucacuuaccugcaugaugggaucaacaguaccccaaaccucagugucauccaauguacccauguaagaaaccugcacauuacuuauauccaaaaucugaaauaaaauuugaaauuauauauuuuuuaaaaggcaaauacuuuaacauuccacuuauacgaggcaccuaaaguagucaaaaucaaagagacggaaaguggaauggugguuaccagagggagguggaagggcaggaggagaugaauggggaguuacuguuuaacaagcaguuuuacaagauaaaaaguauuauggagauggacgguggugaugguugcacaacauuauuaauguaucugauaccacugaacugugcauuuaaaugguuaagaugguaaauuuuauguuacgugcauuucaccaugcgaauuuuaugguauguaaauuauaccucaagcuguuaaaaaaaaaccugugagaaauucaaacugcccauccaccucccacucaacagaaacaaaaaacugucugaacaaauaauuccaaaggauuauagcauagcuacuauuucaauugcaacuuauaaaaaugcaguaggucccuguacuauucaguaacuacuaaacacacacacacacacacacacaccacagcugaagaccacaaauaaagccauugcaccuaguuaaguauucauuugaaacgaaaaaagaaaaugcagccaaguuuaaauuuuguuugccugccacugacuccaagauccuuccaaugauaucaauuuuugccuuagaaaaauuaaguuucauacaguucagcaauuuaaguuauccaauaucguaccaauauucugcaccuacauuuaugugaaguguuaguuuucugguuucugccuuauuuuuuccuaaagaaaacauacacugguauaggccagaugcgguggcucacaccuguaaucccagcacuuugggaggcugaggcagguggaucaccugaagucaagaguucaagaccaaccuggccaacaugccgaaaccccaucucuacuaaaaauucaaaaaauuagcugggcguguuggugggcgccuguaaucccagcuacuugggaggccgaagcaggagaaucacuugaaccugggaggcaagguugcagugagccaagauggcaccacugaccuccagcuuggguaacagcgcaagucuccaucucaaaaacaacaauaacagaaaacagacacugguuuaaucacuagaaaaugucucuaacauuuucuaaauguauuugacaaaauauuuuugcacauuucuaucaaccggcacucaaaugugugccuuuacaauucagaaacaagcuuaugauguacugaaaugauuucuuuaauugacaaauaccugagaagacacuugacugagacaauauuaauagaugcaaagauguauauaagccuaaguacauaaaaugguacauauuuuccucccucuauaacaaguuuaccucaaauacauaugcuauugucaaucaggguaggguaccaauaaaacgucuucccuucuaauucacauuauuuaguuuuacuuugaauugacaaauaauaauuguauauauuuauaaggcccuucuacuuucuuagccuagaugacuaugucaaagaauaaaaugguuuaauuucauuuccuuuuccuauucuugguaagaagcuacuacuuaaccuaaagcucuaaacacucaccuuaucccuuauccaacagauuccuugcuuuccccaucacucccuucuuucuucuaccacauauuuuuagcuagauauguucuuccuccccuugcccucuaccuacccgucaccuaugcucacuuccauccacuuugugucacuuggcuuugccuaaauguuggugcauacacagauguacugcuguauucugggguguaauauguaagguacaacuguaaaaauggcaauguucucucagaacacauguaauuaagugcugaugucuuccagcacucaccuuuaaaagacuauucuaguaacacaauuuaacucaaaauauauuuaacaaacugaagaaacgcuaaauacguauuccauauucuuauucuuaaaauuucuucaaagucauaagaagauaucaacguuauuaguuuagaaaauaauuuguugaacacuugccaagugcuaagcacaagucuuacaaugcaauaaccuuaugaaacggguagccuuuuaaauucaguugaaccaugagaaacugucuuuuuauaggucaaaauaugcacugcccacauuuucauagagaaacuaagccccaggucacacaguaguuagcugcaaagucacaacccaacauaaucucuaaccaugacagauuuuuaauccauguucaaaauaggaaagacaggcauucacagcaguuugugaaugaaauacauucagauggaaaaacuauuucccaaagagcuucugauugacuacaaguucaaaagguagucauucuaggcccaaguuccaaagcagccaacguaauacuauccuguaaguguggaaauagugagucugucaagacacaaaaaaagagaagaguauuguauuugucacuagucagcuacucacaaguuacaucauuuugguuacuaaucugagaccuaagucucucuuccauaaaauggaauuugcucuugaccuauauaucucagugauggcauggguuuaaaauaacuuaugugaggcuggaagcuguggcucacgccuguaaucucagaacuuuggcaggccgaggugggcagaucacuugaggucaggaguucgagaccagccuagccaacauggugaaacccagucucuacuaaaaauacaaaaauucgcugggcgugguggugggggccuguaauccagcuacuugggaggcugaggcaggggaaucgcuucagcccuggaggcagagguugcagugagcugagauggcaccaccugcacucuagccuggucgaaagagugagacuccaucucaaaaaauaauaauuaugaacaucagcagcaugguggaaacgaaagugaaaggaacauaagaccucguucuuggauguuuccagugaaauagagagggauaaauuccauucaaacuguuauuauuugaauagaauaauauuuaauuccagugcagaccccaagccaggcugcuccugggagcgaccccagggacugccuggggaggaaggcuuaacuacucugacuuccaucaguuugucagucucaucuuuacaauggcauuuaagaaaacaucaaaaagguaaacuugucacgauuccaccaccucccuccucaauccagccccauccacuguguaugcacacaaugauaccaaaacaguccacugaaauuccuuaaaauuuucagcugucaaauguguuuugauagcuagcuaaggggcccauaagggcaauuuuaacuuuuccuggggaguaagcugggaggguagaagcgguaggguacucuuagugaagauauaaaaauuauagcuuucuuuuacucacuccuucaaucuuugucuacugacucugagguacaauuuuccucaagaguagucuaagacagauuucaaccaccagguggcacaauuuuagaaaauaaaccaagagccagcgcuguauuaacucuaguauaaagaaaacggguaagcauucuaauaacucacuucagcaaaucuauaaucacaaggaagaacccuguauuuuaaugccaguuggcuuuucuuuagaaagauuuuccuauugugcggcugcacaggaaauuuacacuacaguuguaauuucuaaugcuacugcaaaauaagcaaaaaacaaggccagaaaagucuguugugcagagucugaagaaacuguucuccagaaaaaaaaacuguaaacacuccgcuuucuaaaauauaucuuuuuaggcuaggcgcgguggcucacgccuguaaucccaccacuucgggaggccgaggcaggcagaucacuugaggucaggacaagccuggccaacauggugaauccccgucucuacuaaaaauacaaaaauuagccaggcguggccuguaacccuagcuacucaggagguugaggcacgagaaucacuagaacucgggagguggagguugcagugagccgagaucgcgccacugcacuccagccugggcgacaaaacaagacgccgucucaaaauaaaauuuaaauauauauauauauaaauaaauaacauaaaacauuuuuaaggccuacauuucggcccugguauuaaagaauuauuuuucaacuuuucaagcuaugagccauacugcagcagaggucgcagacacggucggggacggccuccccugcccacuuccacuuaucacaggaccaguucuaaaccgauaccacuaagaaagcgacuggcgcuggcacuguagaccccaugccaggcugcuucugggagggacccgggggugcugccuagggagaagggcuuaacuacucugacuuccaccgaagaguuucucagagaaugcgcccucgcagcuuucccugaauaaacauuaccaggacuuacaaggugccuagcacucugccagaaucaugugaauuucagaggaaaauacucguucacacaucucaaggaacgcacaggcucgugagggagcauucuugccaaugcacaugguaaaugcccaaucgauguucgcggaaugucagaaacugacaacuaguucaggccucaacgcaguaggaaaaggaugaaaaagaaacucauuuuaaaucaacuaaacaagugcaaaagccauacauauaaaggagaggagauacgaauggcaucacaacauaauuccuuugccaucgaaaacuuccaugccuuugagguuuuaaaugaagacuuccaaaacugauuuacuuaagacucuacguaaaacgccugaucuuuaaacgcaagaaaagcaagaugaauguauuacuuuccuggaaaaaaaaagcauuaaaggagaaaaaagaguaaaguguacugauggggcucuugguggguucucacaucacagggcacugcagcugagacuugcuugaacggcccccguuuucuacccgcaaauucucaauugcuagauaaacaacaauaacaacacuuuauugggcgcucaucgugucaaacccuguguugagggcuccauuccucaagguccauuuuaccggcgaggaagccccggcuccgggaggggaggagcgcgcccaaggucaccagccaguugagugaguggcgggcggaucccaaccccgagcgacgcccacggccugucucggccaccagcguguuccagcgagcgcccagccaccucgcucgcagccuccccagcgcagcagcccggcugugggccugcggcagccgggucuuccugguccccaccuccuggggccgacgggcggcaggaaggggcucggcgggacgcgccaucagggaccugaggaggaacaacggaacgcguucggaacggccuggacucccgagacucacccgacucguggccacaccgggagaacugaagcggcaguagccggcggagacgcccgacccgaaggccggcugcuagggagcagacagcugaaccgcuugccagacgccgaaacccagugacgcccuccaccgcuccaccgugcucccggcuccucgcccccgcc

SEQ ID NO: 191970 - RNA, 24988 nt, Homo sapiens
gagcgacgcccacggccugucucggccaccagcguguuccagcgagcgcccagccaccucgcucgcagccuccccagcgcagcagcccggcugugggccugcggcagccgggucuuccugguccccaccuccuggggccgacgggcggcaggaaggggcucggcgggacgcgccaucagggaccugaggaggaacaacggaacgcguucggaacggccuggacucccgagacucacccgacucguggccacaccgggagaacugaagcggcaguagccggcggagacgcccgacccgaaggccggcugcuagggagcagacagcugaaccgcuugccagacgccgaaacccagugacgcccuccaccgcuccaccgugcucccggcuccucgcccccgccgcccgcgggccccaaggcgcaugcgccgccuguccuggaggggcccauuuccguccgucguggggggaggcacagugaguccacuggggcacggcagcgucuaagccacaagccgagcacauaagccagguccuaacggagccuauguguaaguccacuacuggugcaagguugcacacuucuaagaagagcggcguggggggcucggcgaccuucgcuucagucgcucccccgugcaguccccugugcccaagacacagccugaugcuugugcuccggugggcggagcuuggaggcggcgggaacugcaauugguggcuuugaaggcgcggcgagcgggaacagcucuugaggagugagacugcaggagaugugggccgguaagagagccccgggcggcacuggaucgggccccggaggguguggggccuugaggaagccagaucccaggccucggggguggcuuuuucgcaauugucgcacguugugaggcgcaggauuggcgcugggucucgggcucggggcgaggaacuacgguucgggccgaggugagggggcgguggcgcugugccggcugugacgucaccucgcccgcgguggggcggguggagccuuucguaggcucgcgacugcgucaggggagggccguguggucaugugaccaggggcuccgcucuacgauccugggguugcuuccuuucccagaguugggguuuugcuuuucugucaccucggcuuccgucguuuuuugucccuguacccucuugcguugcuccucgcauugccuguuggagcgcagcagagguguguggcuacgggaacguuacuuaaaauggaucuuuuugaucaugcguuccacagaucuugagcaucuacuguaugucagacacuaaaacgcuaggaaguauaaagaaaguuuuaaaauggggccaggcgcgguaguuuacgccuguaaucccaacacuuugggagaccgacgugggcggaucaccuuaggucaggaguucgagaccagccuggccaacauggugaaaccccgucucuacuaaaaauacaaaaauuaaccggacgugguaucgggugccuguaaucccagcuauuugggaggcugaggcaggagaagcgcaugaacccgggaggcggagguugcagugacccgagaucgcgccacugcacugcacccugggcgacaaagcgagacugugucuccgaaacaacaaaaaaaggaaaguuuaaaaauggucacgggguaaacguuuacuaaagggauuuccgucuuaauuggugagacugagggcgcucuaccaaauuucuuuagacuggcguucugcaaacuuuacccggaauaaaucaucugacguacuuuuuaaaagaugcuaaaucucaagcccuccgugcgcccuccucacaguuuaauuugauagggcccaggaaucuucauuuuaacggguagccucgucuguggguuuuuuuguuuguuuuuuguuuuuuugagacggagucuugcuuugucgcccauguuggagggcaguggcacguucucggcucacugcaaccuccuccucccggauucaggcuguucucuugccucagccucccgaguagcugggacuagaggugugcgucacgacacccggcuaauuuuuguauuucuaguagagacggaguuucaccauguuggccuggguggucuugaacgacugaccucaagugauacaccacgcccggcgcgcucccggccccucgcccguguucuuaaugggagagguguugauuugauguuucacugacuguugaaccccaaaccacccagguugucuccucaggcauucauuccacaaguauuuaucaaagacacauuagacuguucuuggccugauuagacuuacugacuauagugaggcaguucuggucuaggaguauagcugugaauaaaaacaucguccugcccuggagcucaauuuuagaaacaagaaaaguuaaaaagauaauuucagauaguucuguaaagacaauuagcaguggauggccuggugcagaggcucacgccuguaaucccaguacuuugggaggccgaggcgggaggaucacuugagcuugggaguucaagaccagccugaccaacauggugaaaccccaucuuuacuaaaaguagaaaaauuaguugggugucauggugcacaccuguaaucccagauacucgggaggcugaggcaggagaaucauuugaaucugggaggcagaggcugcaggaggcugcagugagcagaaaucccacuacuacacucuaaugugggugacccagcaagauuccgucuaaaaaaaaggaaaaaaacaauuagcaguggagaguggggaaguaacuuuugguuggguggucaggauaagucugaggagaaaccaucuaagcuaacaccagaauugcaagaagucacuggagagaacaugugcaggaagaaccuucuaggcaguuguaacugcaggcacaaugguccuucucuagagauuauuuaagagacuaguguaguuggagcucagaaaaccaaggagagggaagcaggggccacgcaacacggggccuuguagaccauggugaaggcuuuagaugguccaguaacuacacaaagaaacaaauccgacuccuguuucaugauccugauucuguuccuacgaccuuaauucaguuauuuuucuauuucuaaaugacuccuaauccuuccucuuuaucuuugucuuacuaucauuuucaguauauuguuaaaauacagucaacuauuucuuuucagaaguggacaaggauaauuuuucaguguucaacaaauaagucacagccaggacucuuguaggaagauacuucuuugucccuggaauucccacaguugugaaggaaacagaugacugacaggcuugucuuaaacacagaugccaaggucugugugugccuuccuagaagacacacuguuaagggacauuaaaguaugcgggugguacccugcauuguauaaaaaucauguuugcagaccacgcgcgguggcucacaccuguaaucccagcacuucaggaggccgaggagggcagaucacuugaggucaggaguucgagaccagccugggcaacauggugaaaccaugucucuacuaaagauacaaaaauuagccaggcgugguggugcacgccugcaguccuagcuaccugggaggcugaggcaggagaaucacuugaaccaggcaggggagguugcagugagccgagguugcaccacugcacuccagcccgggcgacagagugagacucuaucucaaaugaaaaaaauaaauaaauaucauguuugcuugcuuuuuuguucuguauuugaagagagagagagagaugcucacugguguccccaaauaaaguagcagacgugagaucagcugucaccauuggcucacaacuucugccaaaggaaaaugauaaaagagcucagaaucuuccuuccuuauuccugcagccgcuaggucauucuucuggagauuauaucccuugccuauugauaagggaggcacaccagauuuggggcucaggaccuuauagacaauuaaggaaucucacccucaggcaugggcaggagaagugagggaggaaagagcucuuuguucacaggcggugcauuaaaggacuaagagacagcaauccacugcaccacuagcucuuagcauguccuguggagucacagauccagcuguuuauucgguaucuccauuuggacucucaucuuuaucuuaauauuaacagauucagaacagaauuacagaauucuugagcuuucuccugccucucucgcagucuuggccgucucagcuaauaguaacuuugucuuuuaguucccugguaaaaaccuugguuucaucuuugguucuuuucuugaucuaacaccccacauguaauccaucuggaaaccccgugaguucccucuuaaaaguguauccagaaccugaccucuuccccugccucacuaaccuccaaccucugcccucgccuccuuacacugcguucucaguacaguagcgagauugauccugguagaaaagcuaaacaagagcauguccugccugugcucagcaccuugcagagugaaaacagcagugauccccgcagugccuuucaaggcccuccaugaugacugaccucaccuccuucucuaugccuccuuccugucucugcuguccccugacuggaggccacccuucccuguuccucgaaggccccaagcaggcucuugccucaggacuuuugcacaugcuguuccuucugccuggaaagcucuuccaccacaugacuccuucuccuacaaggauugcccccaagucauguucucuaugaugccuacucucuccagcacucccacgcucaacucagccugccaaaauuauuccauuuucuccggcacuccucacuuuuaacauaguuugugauuucccuguuguuucucucuccccacuagaauggaugugccauacuggaacagauguuugucuuuuuggccaaagacauauguauccccagugccuagaaaagggccuggcaugcacagauccucaguaagggguuacaugaaucaguaaaugaaugaaugauuuauauaucaucaccaucaaaacaucaaaauacucuagccagaaaaggagagauagcacuaauuuuuaaacucuaaaacauuuaaauauacauuaaggagaaaauaauuaaaugcucaugcuaaaacacugcaaaauagcugaaaaaguguaaacauuuagguguuggaccuacaaaucaaaaucccagcuaaauaugaugccgauggccaggcgcaguagcucacgccuguaaucccagcacuuuggcagguugaggcggguggauugcuugagccuaagaguucaagaccaacgugggcaaucuagugagacccugucucuauuuuucauauguguauguguauguguaaauaaagacagacaaguauuguauuugguuaauacuuuguugugcuguuuuuguuuuguaaaagugccaaagagauggaugagacuguugcugaguucaucaagaggaccaucuugaaaauccccaugaaugaacugacaacaauccugaaggccugggauuuuuugucugaaaaucaacugcagacuguaaauuuccgacagagaaaggaaucuguaguucagcacuugauccaucugugugagguaacaguguuaaaaaugaugagccuugaacagagugcuacccccuuggguuuuucuuucuucuauuccuuacuccaaaagagauguaagguagcugcuaaacuacuagugaagugaugagggcuauauacaacugcaguggaaaaaaaccuaauuuuuaauugaccuuuucaucuuaaaagaaugcuuaaaaaucaauaagauggaaaaaguaaauauaguagaaaaaacaguacaaauuaaaauaacgagcaguauuuuucgcaguauuuuuuuaaaccuaucaaauuaucaaggaugaaaagacaacaacacccagauguauuggcaaacuuguaaggaaagagacucugucuuucauguguauuuaucucuuuaauugcuuauuguuuuaaaauguuuucagacuaucagaaaaguugcaaauuuaguucaaauaauuuucuuauuccaauauacccgucucuccuucacuuuuauuuauuuauuuuuuauuuauuuuugagacagagucuugcucugucauccaugcuggagugcaguggcacaaacucagcuuacugcaaccucugccucccagguucuagcgauucuagugccucagccugcugaguagcugcgacuacaggcacgcaccaccacacuggcuaauuuuuguauuuucaguagagacgagguuuugccauguuggccagguuggugucaaacuccugaccucaggugaucugcucacuuuggccucccaaagugcugggauuacaggugugagccaccaugccuggccuccuuugcuuuuaaauaaauauacuuuuugaccuagcaauucuacuuacagaaauuuaugaugagaaaauaauaaaaaauaggagguauguauaaauauugauaaauauuuaguuauauaaaugaagaugcauuguagcauuguuuuaaaaacaaaacacguucacauaaagacguguguacuaauguucacagcaacauuauucauaaaagccacaaacuggaaacaacccaaauguccaucagcagguaaacagaugaacagauugugauguuuccauacaguggauauacucagcaguaaaaaggaaugaaguauucauagaugcuaacauauggauggauaucaaaauaauugugcugaguaaaagccagaccaaaaaaaugaguacacacuuauguuaacauucauauaaaccucuagaaaaugcaaacaaaucuguaaugacagaaagcagaucagcguuugccuuaggacuaaggcuugggagguagagacaugggaaccaagaagaguggaaggaagugggcggugauaagaaagggacacaagacuggacucaguggcuccugccuggaaucccagcacuuuggaaggccaaggcaggcagaucauuuggguuaggagaccagccuggccaacauggugaaaccccuucccuacuaaaaauacaaaaaucagcuaggcaugguggugcacaccuguaaucccaacuccuugggaggcugaggcaggaguaucacuugaaacugggagacaaagguugcagugagcuaagauugcgcguuugcacuccugcuugggcaauagagcaagacucugucuccaaaaaaaaaaagagacacgagaaaaucugggaggcagugcugguggauauugucacugucuugauugugguagugguuuuguguguauauucauaagucaaaauguaucaaauuguauacuuuaaaaauauacaguuuaauggaugauaauuauacuucaauaaaguuaauuuuuaaaaaaucaaaaaguuaaaagugauaaaugaggaauaaauugugagagaagguuguggacuaagacaugaaucagaaagaauguccauugguuaacaggagaagagauuggagauggguugucaguaaaguacugagaaugugcuaauagucuguucuaaccaauccuaaaauguguuuuaaacgggauagaaccaaaccuauaaccacaguuacuaaauaauuuguuuucucuuuuaggaaaagcgugcaaguaucagugaugcugcccuguuagacaucauuuguaagugucagugauuuguauuuauacuuaaccaaucaguuuauuagaggcaauuuuguuucuuucuuugugagacagggucucccucugucgcccaggcuggagugcaguaacgccaucucagcucaccgcgaccucugccuccuggauucaagugauucuccaaccucagccucccgaguagcugggacuauagcagugcaccaccauguauggcuaauuuuuuguauuuuuugccacaagguuuugccguguugcccaggcuggucuccagcuccugggcuaaaguguuccuccuaccaaagugcugggauuauaggugugaaccgcuguacuugucccagaagcaauuuuguauauaacgccucagagucuagaguucaggagaccuuguuucaaaucccaguaugucacucagccguauguucuuugacaaguugcaucaccuuucugagccucagacuucaagcagagauaauaguacauuaucuacuucacgguauucuuguuaggauuaaaugagguagugcccgagaagcuguuagcaugguaacuggcacaucagaaacacaaaguaaauguuuggcuuuguauuacucagguugccaacuuacaacagcucaacuuaaaaauuuucaacuaguaugaaagcagcagacauucaacagaaaccauacuuugaguuccuauacaaccauucuuuucucacuuucaguacagcauuuaguaaguuacaugagguaugcaacaguuuaugauagaagacucuguuggaugauuuugcucaacuguaggcuaauguaagugcucugagcacacauaagguaggcugggcuaagcuaagauauaugaagguuaggugaauuauuuucaccucaagguggauuuaucaggcauagccccaucauaagucaagaagcaucuguauuauuauuaaaggauuugaaaauaucuuucugaaaauuuguuccuauuacaguguagcuucucaccucuccucccuuccauuucauugauuuuugucuagcuuuccugucuguacuuuuucaagaugucuguuuuuuuuaucagaaggcagcauaauauaggggcugagaacacaggcccuggggccagaccucuuggguucauuucauggcuccguuacugccucccugugagcccuggaggaaguugguuaacaucucuguggcauaccgacaucucugguauuaucauuugaccaaucuguauaauagugauaauaucacauaagguuauggugaggauuaaauaagaguacauguuaaauacuuaaagccugguauuaacuaauugcaaucauuauguauuagcuguuuucuguaaguguaacaaaaauuaucuuuauuaauacuuugcuccaacucauggcaugcuccaauucagcuauugcugaauuuggagcaucugccucugauuuaguuugucucauuuucagugguuggauucucucaagcauaaaagguggauccacaccauucccauuucucauacauugauucaaaaauucauuaagcaccuggcuggacgcaguggcucacaccuguaaucccagcacuuugggagaccaaggcagguggaucaccugaggucaggaguuggagaccagccuggccacuauggugaaaccccaucucuacuaaaaauacaaaaaauuagccgggcaugauggcagguaccuguaaucugcuauucgggaggcugaggcaggagaaucauuugaacccaggagacagagauugcagucagccaagaucacaccacugcacuccagccuggcgacaccgugagacucugucucaaaaaaaaaaaggaaaaagaaaagaaaaccuggucugaaguccagaggcacagacagaggucagugcagagacaauuuuaagccagaaggaugaagggauaugguugaacuugcuaacuuccuagguccauuucuacuccaagacacuccaaguuuguaacuccugaaagguguuuucugucauauacuuauucauucauucguucaucaaacauauacugaagccuggugugguggugugggacacuugggaggcugaggcaggaggauugcuugagcccgcgaguucaagucuagcccaguuaacauagugagacccugucucuuagaaaaacaaaacaaauauugagugcuugcuuuaugccacgcaguuaaguuuagaccugggacuacaacagugaacaggucccucauuuccaucagagucuaacuggaaagacaggcaguguacaaaugaacaucuaaauaaauaauguggcugggcacgauggcucacgccuguaaucccagcacuuugggaggccaagguagguggaucacccgaggucaggaguucgacacuaaccuggccaacauggugaaaccucaugucuacuaaaaauacaaaaaauuagccaggcguuguggcaggcauguguaauuccaguacucgggaggcugaagcaggagaaucgguugaacccgggaggcacagguugcagugagcugagauugcacuauugcacuccagccugggcaacaagggugaaacuccaucucaaaaaauaauaauaauaaauacacacauacauacauacauacauaaugugacaucagguagugaugaguccuccgacaggaacugggaacuaacgcaggguguuugggguagggugauccgggcggggacuacucugaguagagagcagaaugagguggggaguaggguguguaaggagcuaggagaagaggcuccaggcagaggaacagcuggcucaaauguggguccuguggggcacagcauucccugucgugccagauuaauguggcauucuguggaauggaauaaauggaauguggaaauggaauaaaugggcuaacauagaauaaauaccaaaacucaacuguauuaucuaagucaguugaauuaaguaauuaugauuugcuuuauuuauaugaaguacuuuaauccauauaaaguuuauauuuugaauacaaaucuguauaacucaauuugugaauuacuguuacuuuccccaguuuuaaaguauagaaauaucuauaagcauauuacuucaaaguucuaugauaugcuaguaauaaagcuuucuucccucucucagauaugcaauuucaucagcaccagaaaguuugggaaguuuuucagaugaguaaaggaccagguaauauuuucuguuuacaauugaauauuugauaguuuggcuuggacucaggaagcagagguuacagcgagcugagauugcaccacugcacuccagccuggguaacagagcaagacucuauauccaaaaaaaaaaaauagcaguauguuccucauuucuuucaaaaugaggugauuauuuauuacucacuuuuggaaaaugagaaacauacuucuuggugccaugucagaaguacuagcaccauuugugugauuugaucauuauuacucuggaauuauacaaaaugcuuaguuucaugguacuuuacgaauguauuuacugaagacauuguagcucccuugauuuuucuuuauuuuuuuuucacuuuggcaggugaagauguugaccuuuuugauaugaaacaauuuaaaaauucguucaagaaaauucuucagagagcauuaaaaaauguaagaauaaaauucaucuuuuacauaaaauucaaugucaugacgucugugcacuuaaaauuugcuacuaucauaguuuuuuuuuaauuuguaagaaauucaguuaguaauaguucauacgguucuacuccauaucagaaacacacuguaaauauuaugaaaacuucccuuuccucucuccuguccauucagggccugaggcuucuuuuuccagaggagcucaguccaacagagcuuucugcagugauggaaaugcucuguauuggcacuguucaguucagccacauguagcugcugagcacuugcggcuagugugacugagcagcugaauuuuuaaucuuuuuuuuuuuuucuuuccuugagacagagucuuacucuguugcccaggcuggagugcaguggcgagaucucggcucacugcaacugccuccuggguucaagcaauucuucugccucugccucccgaguagcugggacuacaagcacgcaccaccaugcccagcuaauuuuuguauuuuuaguagugaugggguuucuccauguugaccaggcuggucucgaacuccuaaccucagaugaucugccugccucggccucccaaagugcugggauuacaggugugagccaccgcacccagccugaauuuuuaaucuuuuuaaacuucaaugauuuuuuacauuaaauagccacauguagcuaguaguuccaguaauagucagugcaaaccugaagcacccuugauuuuacagauguuuuugcuuuuuuaauguaaaacaaagaagcuauucagaauaagacaaucuuccauucaaggcaguagaggcccacugagcaugugacuggguccaagcucuaugaugcucacucaggaaagucagacagcugugugccgccauacccuggacuggggagacuuucuugucuccugcacugagggaauuuggaaaagcugcuaaagaaugagcagaauuugcuagugccacuguaacaacccacuuuuccuagaacaagaucucagagggaggaaacagagacgugggcaagcugagugcaucucacucaagucccuccuuucuaggcucagagcuuuaaagggaagcugaaucagaggggagcugauaauccaggagcagccuauuaaauuccagaccaauuggcaaccauauuuaaaaguuuggaaaggccuguauuuuauccaugaaguggauucaagguaguaccucuggucuugccauguaacauucuuuuagaggaguuuuuagcuucugagcuaaaugcauaagagcauuaggaauaguauauuuucaagcccauuauuacauagaaaucuucuuuaagcccauuaugacauagaaaucuucuuuuucuucuucuuuuuguuuuguuuuuguuuuuuuuuggaaacguggucucacucuguugcccaggcuggaaugcacugacaugaucucggcucacuauagucuagaccucccaggcucaagccauccucccaccucagccucuugaguagcugggacuauaggcacaugucaccgugccuggcuuuuuuuuuuuuuuccgguagauacugaguuucacuauguuguccagguuggucucaaaacuccugggcucaagcgauccuccuaccucagccucccaaagugcuaggauuacaggcauaagccacaacacccagccuaauuacauagaaaucuuacuguuaaaguuuauagcgugugcuaggucuggguuagaugcuaagaaggcuucauuauaaaacaaguaucucauuuguaaggcugccuuaccucauaaauucuuacguaaggaggaacaguuuucaggacaagcccaagaaauuauugaaaaaacaaucaccucuacaaaaaaaaacuuuuuuaaaaaaauuagccaggcaugauggcacgugccuguggucucagcuacuagggaggcugagaugggauugcuugagcccaggaaguugaggcugccgugagcaggcuaugaucaugccacagcacuccagccugagcaacugagcaagaccuagucucaaaaaaaaaaaaagaacugaaaaggauuuuuuuuuuuuaaaaucacaaaauguuuucccaaagauucucaaaauacucaugaaaagcagaaaagacugccaggucucaaccugcauacaagaguauagggacaucauuguucaccccuaauaagcaccuggaguuggugccacagugaaauuuuaauuaggaaauuaagccuuuuuuuuuuuucuuuaauaaggugacagucagcuucagagaaacugaggagaaugcagucuggauucgaauugccuggggaacacaguacacaaagccaaaccaguacaaaccuaccuacgugguguacuacucccagacuccguacgccuucacguccuccuccaugcugaggcgcaauacaccgcuucugggucagguauggaaaaaauuauuacaagcuauaauauuuuauuauccuaucucaaaggucuauauagauuuuaacuguugaauaaguauuugauagagaauacuaggccaggugcaguggcauguaccuguggucccagcuacuugggaggcugaagugggaggauugcucgugcccacgaguccaaggcugccgugagcugcgaucacaagacaaagcaacaccccaccucuaaaaaaacaaaaaaaagauauagaauaccacauguaauucuuguucuccuaaaauaagaaacagaguguuguuaucugcagaugggaacauggcauaagauauuagauuggagcuauauuuuauuguuuuuugaucuagaaauaaugcauacuuaauauaaaaaaaugcaaccgauacagaagucucuaaagauaaaaagucuucaaagcuucauaccccuuuucccuauuccguucguucaaaauaacuacugucaaaguuugcuauuuccuuugacaagaugguuauuagaaaagccaggguaggccaggcgcggugcucaugucuguaaucccaauacuuugggaggccgaggcagguggaucaccugaagucaggaguuugagaccagccuggccaacaugguaaaacccugucucuacuaaaaauacaaaaaaauuagccaggcgugguggugggcaccuguaaucccaguuacuugggaggcugaggcaggagaauugcuugaacccgggaggcagagguugcagugagcccauaucgcaccauugcacuccagccugggcaacgagaaagaaacuccgucuuaaaaaaaaaaaaaaauuaacauaacauuuccacgugguuacaaaugaauauaccucauuacuuuuucauaauuguauaauuugcuuauuaaugaacauuauuuucauuuguaaccauuucucccacauuccauacacaaggagacugcuuucacauaagauguagccucuguuccgagccugcuucucuuuaugguucugccuuuaauaucacaggcuuccuagcaucuuuccccaaaguuaguucucccuaaauuggccuggcacuugcugcuaccacuguuagcauucacaaccucaguggcaccuucaauugguuccagagcugccacaucagcugguuguaggcgagcagcuccaccauccuggcugcaucauguccugucacuccacagcagagugggguggaggugcgguguggaguaccaaggacuccacuguugugaccaggcgagcccuagguaguaaaugacuacuugcuugucauuuaaguuuuuuggugguuuauugaaauggcaaagacugcuacucacuucuauuuccuuaaaacacuucuuuacauuuggggucuccugcuccaugauacauaguggucuuucauccacuuauagccaggugaguacaccuugccacagguaguuuaaacauuaccccaaaggcuaauguucuuuuuuuuuuuuugagacagggucucacucugucacccaggguggggugcaguggggcgaucuuggcucacugcacccuccacccccaagguucaagcgauucuccugccucagccucccaaguagcugggacuacaagcacucaccacuaugccuggcuaacuuauuuuucuauuuuuaguggaggugggguuucaccauguugcccaggcuggucucaaacucccgacuucaagugauccaccugccuuggccugccaaagcgcugggauuacagccgugagccacugcgcggacuaauguucauuucuauuguguaucuuaaggcaaacuugucuguucucuagaucagguuaaacaucuuauccuaucauaguaauucuguuucagucuucuuuuccccuaaugacaggaaacucuuaugagcuguauucaauacacacuuauuucuucaguauuugccaaaaagcauacauaucugcguuuuuguauggcaauaucauuaugguauuagaugacugauauucaaaaacaguaacauuuugaguauuuauuguuuauuccaaagucugaacuugauuuauuaguaacuccuaacuuuaaacaggaucgcuuuucuaagaaaugauacaaaagacugcauuuaucagaguauuaaugccauuaaccacuuuguuuuugaagcucaguaacaggcuaucagauguuuuucuagacuucuuuuuacacuuacggggaaacuauucccuaauugcagcucuuacauuuuacuuugacaaguauuauaaacacagaggcaguaauccuaguaauagucuugcaaauuuucauuucaaggcgcugacaauugcuagcaaacaccaucagauugugaaaauggaccugagaagucgguaucuggacucucuuaaggcuauuguuuuuaaacaguauaaucaggugagccaaucagugacucucuuuaaagguaaaucuuuauuuucucuuugacacaggaguuagaagcuacugggaaaaucuaccuccgacaagaggagaucauuuuagauauuaccgaaaugaagaaagcuugcaauuagugaacaugaaaggaaaauaaaaauuccucacagucaucuuuuuauaauuguauuguguuuuauaccacucauuagucacuggagucuguguuguagaucucagcuuccaaaucaccugaucacacuagaauuuguuuucucuuuagagaaacuucacauuaucuuuugaagcuaaauauauuauucuaugaaacaacagagaaguagaauuaacuuuuugucccaucacucaagcagguuauacaggcacuggaauuaaagggaaaagcagugguuuuuuaaaucccaaaguucauuuguuaaaauaauuugaauguaauguuccccucuaaugacaaauacagaucuguccuuacagaugcagggguguuuuuucaaacuaugcauggcagaugucugcauauguguugacacuccugugaguggauuguuaaugcucuguguauaucuuugagccacuagagauguuauacuucuguauuuucaucuguucuaagcagaaagaagugacagcucucugcaagcagucccucuuuaaggaaaaacuaacauuaagaaguuauaucaugaggccaggcacagugguucacgccuaugaucccagcacuuuaggaggccaaggugggaggaaugcuugagcccaggaguuugagaugagccugggcagcauagggagaccacaucucuacaaaacaaaaaauaaauaauauauauuuuuuaaacuuagaucaugauuuucuucucuagccauccccuccuaccuacuacccucucaccaaauugauauaaacuguucugcuauaauacgacaguaguggccaggcaccauggcucaugccuguaacccuagcucuuugggaggccaagaagggcaaaucccuugagcccaggaguucaagaccagcuugggcaauauggcgaaaacccgucucuacaaaaaauacaacaaauaaccaggcaugccgggcgcgguggcucacaccuguaaucccagcacuuugggaguccgaggcgggcggaucacaaagucaggagaucaagaccauccuugcuaacacggcgaaaccuugucucuacuaaaaauacaaaaaaauuagccaggcaugguggcgggugccuguagucccagcuacuugggaggcugaggcaggagaauggcaugaaaccgggaggcagagcuugcagugaguggagauagugccacugcacuccagccugggcgacagagugagacucugucucaaaaaaaaaaguagccagguguggugccgcaugccuauagucccagcuaccugggaggcugaguuaggaggaucuccaaagcccagggagacugaggcugcagugagccaugaucaugccacucacuccagcccgagcaacagacugagauauugucuaaaaaaaaaaaaaagacaguggcauucuuacgaaaauccacguugucaagcacagaacuauaaaaacaauggauucagugggugaagguaggagaagggguucaagagauucagacuuacaguaggaaaguuauuuuuccaaucucaguaaguuuuuuaggguuaugaagauugagcacugacgacgcugaaauaccacagugcaaaugcuuccguagauucccugggcucugcacucaccagauccauuucuaugauaaagcacagagcuccucaaacagaacagucgaguugcaggcucagcagccuccuugucaguguccugcucaacucagccaacucagccaggauauggcuuuggaucuuucuguuggaaaaaaauaaacauuugacauacuuuaauauacuaaaaaaaaaauuaauaucuguacuucaagaugucaagauuaguaaaauauucacuuuuuuuucccuagaccuuugaaacucacaacucuacgacaccucuacaggaaagaagccuuggacuagauauaaauaguacguguguguuaauaugaaacugaauuuuggaaaugcaucauucccuuauagauuucuuucacuugguaaaacguguauaguaggauccuaauuuaaaacuuuuauuguuuucagaaaaauugaaaaguaaauaucuguugaaggaggaaagcuaaucuaccauaguucuccuuuagaauuuacuagaauaacaauaaacaacaaaacaauaauuacaaaaacaaaaguuagcuaauaguuguugagcauuucuugugugccaggcaccacacuaagauguuuauauguauucuuuccuuaaucuucacaguaguccugugaauaagcgccauucaucaggaaacuggguuucagggagguaugguaacucucuaggcaaagucacacagcuaaggaguggcaaaacugggaguaaaauccagguacgucuggaucuggagcccaugcucuuaaugcgcuggauaaacuucuagaacaaugagaaucaugacuguauugcuacucacagaugucugaagucucucacuagaaaacccaagagaaaagaguacagaacuacuaaaguaaauuuacaaaaguggugggguaaaauaaaaauucauaaaaaaaugaaaacuuuccuaucucuuaguagagauuuggcaaugaaaugaaacagugccacuguuauaaacuaaacacuuuuaugauuuuccagugucauaggaacugcuguugaucucaucuuagguaaagaaaucaggauauaaaauuguguguaucuuacgauuccaguuuuaaaaauacauaggugaggcuaggaacaauguuaugcaucuguggucccggcuacuugggagguugaggagggaagaucacgagcccaagagauccaguccagacugggcaacauagugagacccugucucucuuuuuuuuuuuuuuuuuuuuuuuuuuuuuaagacagagucucacucuauuuccuaggcuggaaugcaguagcaugauuucagcucacugcaaccucugcuucccagguucaagcgauucucuuuccucagccucccaacuaucugggacuacaggcgccugccaccacaccuggcuaauuuuuguauuuuuaguagacaugggauuucacuauguuggccaggcuggucuggaacuucugaccucaagugauccucccgccucagccuccugaagugcugggauuacaggugugagccaccgugcccagccgagaccccaucucuuaaaaaaaauacauauauaggcugggugccauggagauauauauauauauauauguguguguguguguguguguauauauauguguguguauauauauauguauauauauguguguauauauauauguauauauauauguguauauauauguguauauauauguguguguauauauauguauauauauguguguguauauauauauacacauauaugcaucuuuauuuuuauucacuguaaaaagagcuaggcaaaaauauacuaaaaugcuaacagugcuuaucucugggugguagaauuaugauuuuuauuuucucuuuuaucaaccuguacuucacuacccuaagaaacuucccuacacuaagaaauuauuacagccaagagaagaagcaguaaauauuauuuuaaaauuauacaaacaauucgaaggguuaggaaugaaaggaggauaauuuaaggaugaaauauauuccuaacggcuguuuuauuugaaaucuuccacccauaguggauucaaggaucauucaugaaaacauaguagaaaaagagagaguccaacgaauaacucaagaaacauuuggagauuauccucaaccacaacuagaauuugcacaauauaagguaagaugucguaauaaauauuaaguacaagauaucaacauuguuuaaaaagaacaaaaaccuuaaguggaaaacagaucuaagaaacuguuccuuuuucacuugucacuuaaauuucauguaauaaauuuaugaauuaaauagaccucuuuauuguauuuauaaguuccucuguuagcaaaagagaccuuuagaaauuaugaaucugggcugggcgugauggcucacugcaaccucugccucccagguucaagcaauucuccugccucagccucccgaguagcugggauuacaggcaccugccaccucaccuggcuaauuuuuuuuuuuggaguuuuaguagagacgggguuucaucguguuggccagacuggucucgaacggcuggccucaggugauccaccuugccucggccucccaagguguugggauuacagacgugagccacugcgcccagccauaaguugauaauuauuuuaccugggugaugugcacauggggcucauaccgugcuccuuacuuuuguauauguuuaaaaucuuccauaauuagaaguuaaaaagauaucucaguugggcacaguggcucacaccuauaaucccagcacuuugggaggcugaggcgggcggaucccuugaacccaggagacugagaccagccugggcgacacagcaaaacccugugucuacaaaaauucaaaaauacaaggugugguggcauguggcuguggucccagcuacuugcacugaagcgggagaauggcuugagccagggaggucgaggcugcaaugagccauguucguaccacuccaacuugggcaacaaaguaagacucugucucaaaaaagaaacaaagaaagaaaucucagugugacucaaaaaaaaugugguauuuuuacauugaaguuacagauugcaaaagauagcacuaauuuuccauuaagaaugcaaacuguaaagggcaccugaggguggaacugacagucaguaucucccauguagcaggcacugugcaugcuggcauuuugccuuggauguuguuugauacaccaguugcccucuauguuuuguuuuguuuuuuucugagaugcaguuucacucuguugcccaggcuggagugcaguggcaccaucuuggcucacugcagccuccgccuccuggguucaagcaauucucaugccuuggccuccuggguagcuggaauuacaggugcccaccaccauacccagcuaauuauuguauuuuuaguuaagacgggguuucaccauguuggccaggcuggucucaaacuccuaaccucaagugauccacucgccuuggcuucccaaagugcugagauuacaggcaugagccacuuugcccgaccugcccucuauguuugcaguuagcagauuaaaugguccccaccccuguuaauuccuguauuucuuaauggcaagaauuaaugaaacguaucauuaugauuucauuauauuuuaccauucguauuuauacaauauguuuaauagucauuuauaaauguuuguugacagcuugaaacgaaauucaaaagugguuuaaaugggagcaucuuggcugagagggaagaaccccuccgaugccuaauaaaguucucuagcccacaucuucuggaagcauugaaauccuuagcaccagcgggugaguggucagcuuacucuauaagcuagaaaaauuaacaacaugccuccauuccauccuuauaaucugcuaauuacuucugagcucacccaucacccuagucugcuagcccauccugcucucucuugcaucuucugcuucuguacuuaauagggaggaggggcaucuaugauccacccucuaaucucagccauuuuuaaacugacucaaauccauccuccugugaugacuuuuaauuuucuuuuucccuuuuuuuuuuuuuuaauuucagguauugcagaugcuccacuuucuccacugcucacuugcauacccaacaagagaaugaauuauuuuaaaauuagagauaaauaagacgugcgugguuucuuaagcacagcuccuccuucuugauauugcacaugcacuucaguucauggcuagcuguauagcuuccgucuguaaacuuguauuuucaagaauccuugguauugaauuuuuagaaaugcucacauaauuguugggacugauucauuccuccacgauaugccuccucucucugauauccugcuaacuguagccguuguggcauuugagaugacaggacauauauauauauggccccacacuugaccuugagugccugaaugcucugaaaucaagcauauggcacagcgcucaagacuuuuggguuuguguccuuuuuucuauggcugucucuucucaauucuggagaggucugguuccaguggcugguuuccagggauugauucuuaagcucuggaucacagagagaagcaacaaggaacuauacucaacucaaaacuuuuuaggagaaucaugaaauuggucuauucaaaggauggaguugaguccauucuguuauuguugcaagagguugcauauuuggugagucaguuauauaaaauaguguucuuauuguaaauaugauacuucucauaaucuauuuuaucauguguauaacauucaaacugacaaauauauugacuuaugaauaaaggugucaaaaaacuggcacaucaguuaauuuugaucaaaguacuucagugaucaucacuaaauacccuaucuuuuuaaaaauuuuuuccuuucuaauuuuuuauuucuuuauuuauuuauugagacagggucucacugugucacccaagcuggagugcaguggcaugaucauggcucacugcagccuggaccucccaggcucaagugauccuuccaccucagccucccgaauagcugggauuacagacgcgcuccauccugcccagcuaauuuuuuuuuuguuuguuuuuuguuuuuugagacaagucuccuucuaucgcccaggcuggagugcaauggcacaaucuuggcucccugcaaccucugccuccuggguugaagagauucuccugccucagccucugaguagcugggacuacaggccugcaccaccaugcccagcuaauuuuuguauuuuuaguagagacaggguuucuccauguugcccaggcugaucucaaacuccugggcucaagcaaucugcccauuuuagccuccuaaaaugcugggauuauaggaguguauuagucuauucucaugcugcuaauaaagauaccuaagacuggguaauucacaaaggaaagaggcuuaacugacgcacauuuccacguggccagggaggccucacaaucaugguggaaggcaaaugagaagcaaagucaugucuuacauggcggcaggcaagagagcuugugcagggaaacucccauuuauaaaaccaccagagcucaugaaacuuauucacuaccaugagaauaguaugggggaaaucguucccaugacucaaguaucuccaccuggcccugcccuugucacauggggguuauuacaauucaaggugacacuuguguggagacacagccaaaccauaucacaggcaugagcuaccacgcccgccagcaugucuuuuuuaaacauuuuaaaaucuauucuuuaucuuguuucagagaggauuuggaguuacagaaacacauuagacugggcaugguggcucacacuuguaaucccagcacuucaggagguuucuccuaguguacucucacacuucugauaccagauaugugggggaggggguuucccccacacauuaagcaagugugaaacaugauauagaaaaaugacuucacucugggccggguguaguggcucacgccuguaauccuagcacuuugggaagccgaggugggcagaucacccgaggucaggaguucgagaccagccuagccaacauggcaaaaccuugucucuacuaaaaauagaaaaauuaguuggggguaguggcagccgccuguaaucccagcuauucgagaggcugaggcaggagaacugguugaaccggggaggcagagguugcagugagccaagaucaugccacugcacucuagccugggugacagagugaaacucugccucaaaaaauaaaauaaaggccaggcaugguggcucacgccuauaaucccagcacuuucagaggccaaggcaggugggucacaaggucaagaguuugagacuagccuuagcaacauggugaaggugaaccccgacucuacuaaaaauacaaaaauuagcugggccugguggugugcaccuguaaucccagcuacuuaggaggcugaggcaggagaaucgcuugaacccgggagacauagguugcagugagccgagacugcaccacugcacuccagccuaggugacagagugagacuccaucuuaaaaaauaaauaaauaaaauaaaauaaaugacaucacuuugguucagagcucuaaaauggagggaggaagccauucuaaaaaggacucccuacaugaccugcaacuugaaaaaaaauuaaaagcuccaaaaaaaaaacaauacaggagcuuaccuugaaccuuugaauugggccaaauugcgaugaccacugcauccuggaaaauuuuauuucaccagcacuacaacuccucaacagcaccaaccaauaaacuauggauuuuuguacuaagccaguugccucuuucaaaacaacuugucaacuugucuaaucacccucagcuuuuuuuaaaaaccccuccucuacccucucucuucagaacacaaguggcuucuagcugaaucugucucccaaauugcaauuccuaagaccucaauaaaaacaccuugucuugcugc

SEQ ID NO: 191971 - RNA, 11494 nt, Homo sapiens
auuaaauaaaaucauuuuaucauauggcuuucaaaagacaaugagugaaaacuuaaggcaauacaauaagucauauuuaugaguacguucaagaauucacaaaaaaggguacaauucuggcuucucuuuaaucauuaaauuucaguuuuuacaaauaauucagguucagguuuugagggggaaacaguucuuguauuauuacaugcucauuuuucuucuguaaaugacucuauuggcuagauuuacaaacauugucacagaaacaaauuuuuuaagccauagaucacugcauuuauauuuacaaaaaagccauaaacaugcauuucuccuuuauuaggacuuaaauagaugcuugaauauuaaggcagugaugauucuaaaacauaaugaaauucuaaguuaaggcuuuauguuucuuuugaaacccacacucauaggcaacugugaccaaaccaaacucuuaccuacuagguugagcucaucugcccgggauauguuauuuauccauuaccaacacuucuuuugugucaaauguaugggauaggaauuaguagcaaaaccaucaauuuacuuuaaugaaucauuaguccccuuacuagguuuugaggauuuagcuuucaguaauacaggcaugugccacagaaaggagcaugucgugugugugugugugugugugugugugugucaauguggagaacuuacaggcugcacugauuccuacuugacuggaacuuagccaacaauuaagaauccaggaucuccuaaauacagaaaauccccaaagcauacuugaucaugcuccuaccucaaaacacacaaagcauucuugauuauugaagcaauaggucuucaccuuguuuucuuugaagacugguauuauucacuuaagaaaaaaaaccaaaaugcagaauaccauauuuuagaugaaucuauccuauaauugcuagccucaaggcacaaguaauauccuugcuagauacuuuuucuuauucaaagaaaagauaaagaauggugaauggaaggaaauucacuuuaaaauaauuguagauugcacuccugcccuaucaagcuuaguagaagugcaaaguauugaaaccuaaugggggaugcccuuuucccacuuuuuuucuuguuuaauuuuagagugacaaaacucagauccagcuuguggaugcacuuggggaaacagcuccagagcccccaacucuggccuacuguggagaccagaaaggaucuucauaggacacaccccaagaugaagucauaggcauguuuccauaacucccuguucccaagguuuggauaaccuacgcucauuuagcaggaacacuacacuacgugcuuguugcuggcgacuuuuuuuuuuuuugagauagggucuugcccuguuacccagguuggaguacagugccaagaccauggcucauggcagccccaaucuccucgagugauccucucaccucagccuuccaaguagcugggaucacaggcgcaugccacugugccuggcuaauuaaaaaaaaaaaaaaauuccagagacacggucuucuuacguugcccaagcugguguugaacuccugggcucaagugaucguccugcuuuggccucccaaagugcugggauuacagggguaagccaccacaccuggcccgcugcugcuucccuagccgauaauuuuacaucaauaaaccucuuguguguaaagugcuguacacuuguaugcugguaucaauaguaguucauguagcgaagagguggcaaugauuacaugaaaacugcuucaaagcuaaagacaguuguaguuuuccuuggugucuuuaaaucagaaaagaggugucaaagcugacgaagguccaggcagcaggagucuuaagagcauggaagcacuacugcuuaaauccuacgguggcagcauccgguuucuuuagugauuaguaacaggaaucaggaauuucuaacaagcagugccaaagauauuuuaggugcaguuuaaguauauuacacuuugacuaaaauguuuugaagauuugagaaguuuguacccuugaaccugguaagcugggcuucagcuaaauggcuauauagguuuuauagauaugaaauacauuuuuuuuuuuaacaugaaaagacuagcugugaaaaggcaaauguaggcaacacaaaaacaauuuagaucaacaucucaaacuuuauaauacacucacauuuauacgcaaauuucuguuuacaaguacaaaaggcaaagaaacacaaagaagcuaagcaacugcaucaucagccacauucaaucgaauuaauacuguuguccccaguccguaguuuuaauccagaggaaaugguagaugccauuucacacauggacuccaccguuaguuuuagaaguuggagacugugugugguuccgcagaagucuggguuucuacagagcugaacugagacuccaucguguuccaggccagaucagccagaagaaagucauccauugcugucugaguuucguugcuggugaagaacaagcuccccaggguuucaaacccagaacucauggucuguguuucuguacuguucaacugaacuuugcuuucuagagcagguauauuuuuagcaguggagacuccuucaguuugggucucugugucagaugaaucaguacucacggaaaagcuggaguguuucagaauacuucccagaggcagaugagggcuacugucuaagaaaaaguuuaagucugucugugucugugugucaaacaucucaaggccuaagaaguuagaauuuccccuacacccauaggacugagcagagguaucugcgaguaagaaguccguuugagucucuauguccagugacuccaagacuggcucgguggucauggugcuaaguucacucucuucaguuugagucuggauauuugaggccgaaaagaacucuucgauaucaaaaucgauuccgggguucugggcugggccagaugggagcugggugucagguccaggauuugugucagacaaaagacuacgaugauccaaugucugagcaggcagauuacuugacaagauguuuuccaaaucacuuaauaaaucuaugguuugggucugauuaucugucauguucugugaaggaagcauacuauucugugcacugaaauuuauaauuggugcagauuucucaauaucuugauuuaaagucuuaggcucauucugagguaacaaacuaugaguuacugucucugcuacuaaacuguugcuuauaauguuaccuguagcaacauuauaugaugaaugaacacucucaaaaaugucuccgcacauuccagcuugguccaucuguacauggucauccguuggacuuucuaucccacugguuugaguuucucuggagaccccaccugacuggaaacagguguccauaaaugcaucagucugagcagcuauagaugaaguuaccuuagagcugggcaaaaaugucugagugugaacacuaaugggaagagacacuugagaaucaaacgacaaaucaguuugagaacaagacgacacagaggaaucagcaguggcccacugugcagaagguauaaaguuuugugaggcauaagacagaucugucugcacguugauugaagaaaugcuauucuuuugacacguguucccuaguucuuguaaaggauuagauggacuuuuaccaaaguucacuugaacaccaguacuuauuggcucaccagcaauaggauuagcaauuuugaaaagagguaggcucuccuuaagagagcaagccucugaaucuaggccgaggaucaggguuccuacugacaagggcauuaagugcacagccccuguggcagagcccugaucaacaccuaacaccacaggcugggcugaggagucggcuguaggcacaaagacaggcaugacagaaaacugcaucacggguaguuuaaccaaagccacuuugggcuuugguaaaagcaacuucugaggauaucucggugguguuguaagagucugcuugucaguguuagagccacaagagucuucaaaagaugguucuagcuuuauuucugaagcuucuaguucuugagugucuggucuagggauugguugguuguucaaugauucaauggucuuguuggauaacuucugguuuugugcacaguuuuccauuuuccuuuucuuacuaggugggucccugaaaacaaugacagagcaaaaagaaaaccuuaaaauacaacuuucuucgaccaugacacucuauccucacuuacaaaugccauuucccccaucuauagcagaggucauguucaacccagacaagauaaauccauucuuucgcaacucugggaguugguccuauuauagcaggugaacuuugagaaacaugcaaacagagaaggaggaaacauaccuuuuguuaagcucuaaguacuagaacucaacucagaucuuuaagccaaaagaagcuaaaagacuuacauaaugcaaguuuuaucauuucuaaggcaggaagcuaucacacuaaaugaaaauuugaccuuuaaaugaaguacaguuucaugauaaaacuuauuuguuggcaguuugguucccucugauagaaaauucuggaagcugagauuuucaaauggaaauaacaagggacucucaaagagggcuggcagaaaaaaauagggggaacaauugggucaagauuucaggcccagacaugugucauuugcaagaccugcuuccauuuucaaaagcuuccuucuuccacgucacacauuuucuaagauuccuuuuuccuccccacaccacuggcucuccaggauguuucaucugaaaugcuucccauagcuacugacuucugugccaucauuucuuucccuucaccuguguucugcagguaucucgugcccaguucgguagaugugagacugcagugcuguucuacuggcguagggacagccgcaugugcaccggaaggucuugccacaguccucugcaugucuuuucaggucccauucuguaccguacgaauugcugcacuuacuacauuugugcuucuucucagcaugcauuuucauaaagugcuaggaggaacgcagaagggacuaaggugaaaaacagcaacuggucaaaacauuucagaaaccaucauacacccaaauuaauaaugauuuuacacuauuaauauaaauaacauaaaauacagcaguccaagucaaaagaauguaaaagcaggaacaucgcaguuaauuauauauaugccucuucuuguugcuuuugcuuugugaaaagugaggagauuguuuuggaaacaucuauggucuccagcauuuacacucugaucuguaagugcugcaggcaggaaaaaaaugucuuuacaaugcucuucucaggacgcccuccagcagacccucaggggaacauuucagaugccaaucucuuccaguucugaaucaccucuugucccagucacuggggcccucccuccucuuaagauugcggcuuccaaaacucuucuuuuccuggauucugcagguucuuauuccccugggagaacaguuccuuugugccuuugcgcugggcccuuggagguaugcagacucacacaggagaucugcgagcaaacauuuucucauucuuugcugaacugguuuacucucucucucuguauuuuaacucaguucuagacauauucccuccagaccgugccgcuuuucccuccacuuguguaacagcauacucagguuuauaccaacugggagacacgcaggcaucuccccucacaagcagcugucuacucaauucuguaguuaugucugcuaaguaaucagaaugcacaauagguuuuuagcaucuguaucucauccucagaguagagaguaccuguuuuacgagagaaaacugagaaaacggucucucagggccucuggggcagccuucaauuggacagcaguagaauuucgguccaguuuucaaaucuuuucuuauuguuggauugacuaugccauccugcaaaaggaaaauuacuuuaaauuauuauuucaaaaaaacaacacaacaggcuggaguggaaacggaaugacugaaaacgagcacauuuugugaaauacuuuuaauuaagaguuuuuccaucuagugucagcaguaagagaaaaagaguaugaguagauuaaacgaaauguggugagaauacuaagcaagacucuaaaauucugcauucauuugaccauuacugaauuccucuuagucaauuuacauuccagggagaugccccccuuguauguuccuaggcugugaaaugcuccagaaaaccacggauuaggaucacuacaagauuccugcucauuucaaacacaucgucagugaagcucgguaauccuuucauuaucuuuuccaaccucccucaugcuccccuguagugugugcucucaucauugaaugccuuuuacuaucuccuguccucuucuaagugccccuucguucaaguccuccuauuuauguggauuuugucauuagccucaaucuaauuucuagaccuucagucucuuuuucacucauacuuuaucagauucaccuuucucaaguauagcuucgaucaugucauuaccucccucaaacguuuucagcagcacccccguacuguucaagucccaacuuuuugagccugggauacucaaagucccuuacuccauagcuucaaacuacuuuuucuucucucauuacuucauuacaccgaagagaacgccuucuaaugccccccacaccuuuacaugggcagagauuuauuuguaucuucuguugccuuugggaauguuuugaacagaauaaauguucaauaaaaacugguagcauuauacugaaucucuucagguagccaucuaagccaaaacuaucaugccuggguaagagaccacugaagacagucuaaguggauguuaauaaccucacugucauggcaacaagcugacacuguccaugcuccuguuuucugagagccaacaccccaccacucaccagcacagcagccuccucccacccccacccacugcuucuggggccuucuucccauuucuguccucagagaauaagcucaaggguaggauggcucagaugagaaauggcaauggcacgauaaaauggaagugcagugagaaagugguguuuucauucugaaguucuauauacuuucaagaauaaaaugcacuggacuuuuuguacuguaucuuuugugcgcauaacugaaaagagaaccuaugagaggaaacaauccaguaacaagacagaaagaaaauauacaagaggaaaaguaagacacaguugaagaguagagggugaaaagaaacgauuguaagaacuguagcaaaaacuaggaaaaacugucugucuagcuacucuagcaccaccugacugccuuccgagaaagcauccaagaaggaaacgguuugcuuugucaucuuauucuaaauuuaaaauuagaaaucuuuguacaguauagucuauagaguaacuuggaaccuuuccuuuccuuaaaaaauuucuggcaaaucauuaaaaacaaaccucuggacuaaaaauaacacaaaauccucuaagccauguuuuacaauauaaauguugcuugauaagagguucuuuaagugccugccuguccccuccacugcuuucacacacaaggaacaaaagaaucucuaggaauaaaaaaauguacauuuacuucugcucuuccugccccugaauccucauggcuuucauuucuccaugaaucccaccauacacaaggcugggcuagauuucuggauuuccuuacaggauauggaauauggccauauaccuuaggcacccacaucaaaccagaaggcggcacauacucuacaguuugcaauccaauuccucauucucacccauccucguugcucaucauuuauguuaagaagggaagauuugguugggggugggguguuuugggaagaaagauuagaauaaaauaagaaccaacagcaacuaguggggaggggaagaaaauauaaucuagaaaauauauaaacaaugaaagaaauuaugcaagcagcuguaacuaagaccgaaaauuuccacugacuauaagaaaaccugccaauaagauacucagggcagaaaguggauggagucucuggucaacacagcucuuaaaaccuaagauagcuucccagccagccuuccucccgguuccuuguccuuaccccuaccuucuuccaguacuuugaaaacagguaucaacauugauguuugaggccuggcgcaguggcucacucuuguaaucccaguacuuugggaggcugaagcgggcggaucacuugaggucaggaguucaagaccagcccgaccaacauggcgaaacccuguuucuacuaauaaaacaaaaauuagucgggcgugguggagcaugccuguagucccaacuacucgggaggcugaggcaagagaacugcuugaacccgagaagcggaaguugcagugagccgagaucaugccacugcacuccagucugggcgacagagugagacugucucaaacaaacaaacaaaaagaacaauguuugaggcagggcaugguggcaggagccuauagucucagcuacuggggaggcuaaagcaggaggaucacuugagcucaagagccugacagcaaccuggguuaacagagcaagacccugaaaagccuucuauguaguaaccagacaagguacagaucuccauacugggcaccaucauauagauggcuauugcaucacacagacaaccuucauuaaaggaagacaccaagacaggagcugcucaggggccacugggcacugcgguuagaaagccaggacaagacaggaaagucagucugcuugucaagaaaaaaaugauggaucuggugagguauaauuccugcuaaaaaaaaguuugcccuggcugggcacaguggcucacaccuguaaucccagcccuuuaggaggcugaggcggguggaucacuugaggucaggaguucgagaccagccuggccaacauggugaaaccccaccucuacuaaaaauacaaaaauuagcugggcguggugguaugcaccuguaaucccagcuacuagggaggcugaggcaggagacucgcuugaaccugggaggcagagguugcagugauccaagauggcgccacugcacuccagccugggcgacagagugagacucugucucaaacaaaacaaaaaaaacccaacauaauuagaaacaaaccuacuguauacuaaccaguccugaaaggcaaaugguaucuuuauguucaacagauguuuaccagggucuuuaaagagcuagagcuccuaacaacaacuccacagaaaggaacaacagaaacuauuaagaaauaguucauccaccuaaguuaugauuaaauaaaggauuuaggucggucgcgguggcucacaccuggaaucccagcacuuuaagaggcugagguggguggaucaccugagggucaggaguucgagaccaagcuggccaucauggugcaaccugucuuuacuaaaaauacaaaaaaaaauuagcagggugugguggcaggugccuguaaucccagcuacuagggaggcugaggcaggagaacugcuugaaccccggaggcagagguuacagugagcugagauggcgccacugcgcuccagccugggugauggagugagacucugucucaaaaacaaacaaaaaaacacaaaaacaauagggaagaaaaggauuuaguuaaaauuuaguaugaaaacaaaacaacagguugaaagccauucccagaguuacacuugagugcugaaagaaacccagagcuuuucaguccaacaauucggccccaccugcacggucuuccucagcauaccucagguacauuuccugacuggcucccugaucuucaauugagaacguuguugcaucccgguuuagauggugguaagagcagaucacucuucauuggcgacacaucuguccuacuagagacuacaaccucagaguuuucugcugugaaauucuuaucagaagccugacuaugggcagacagaacaugcaauauucuggguacucuaaauuuacuccugaucaucaaaagcuacauauucgcagaacugcuuucaaugacuugcgcuuuugaauuaugucacugcuggccuagagugguggaaggaaacuugccauuguaaugacugagagauugugacuuaacagguccgggguggggcuggacaucuggauuuuuaauaagcuugucacagaugugucccaagguugaaaaugacugcccuguuuugcauaacguggaggguuguugagacuauugucaugguguauuuacugugucccccucuuaaagaagagccacaggggcaauuucccuuaggucucaguccugagcugaucuuaccaacaccgugaaacugacugaugguguuuagaggcaaaccuaccgcuccuuuaaaacauuuuuuuauucauaaucgacacacaguaauuauuccuacugauggggugcggugugcagcauggauggacauauacauugcauagugaucaagucagaguguuuaacauguccucgaccucaaacguauugucucuugguggugagaacauuuaaaacccucucuucuaguuauuguggcacauacaguccacugggcaggacccaagggcggcauugugggugucguggcaagcacagggcuuuagaaccagaggccccgguuuaaagccccgcaucaucuagguugcauaaucuguuucucauuaauauaauggagacgaugcgucccucgccaaaacgccguuaagaacucacaggcaaaaaaguguaaaaagccugggccggcguccggcacgacacucggggccagggagccagggaaccagggaacuggcgcguacggcggacccggggcucccagcuccuccucccccccagaggccgcaccugcggcgccugccgcgaggguucgagagccgccuccggccggggagggcagaggccgguggggcagcggcagcggcagcgcgcagggcgcucguccccccgaggccggcuucgcgcgccggcgccgggcgcuuuguuggagccaggcccggccccccgggccgccggccgcgucgggcucaccugcaggcgguggcucuugacuaggugcauguugagcgcggggcuguugggcaggaucuugccgcagccgcgcacggugcacaggauguugguccgcacggcccgggacagcucgcucaccgacggcuggaucagcucccccgccggcggcgcggggacagcgggcugcugcgucgcccccgcgggccgcggccggcugccccucagucggggucccgggggcacccacgggcccgaggcggcggcggcggcuccugucguggccgccgggacggcccgggcacccgccgccagagccgcggaccccgccgccgccgccgccuccgaggccgccauggcucccgcacggccgcc

SEQ ID NO: 191972 - RNA, 50081 nt, Homo sapiens
augagugcagugggcuugguacuccuggugcuugcucugaggcuuagggccaccacuguuaagccagaggaaggcagcuuuugcucuaacagccagguggccuucagagaugcuugcuaugaauuugugccacucggacgcaccuuccgugaugcccagagcuggugcgaggggcaaggaggccauuuggucuucauucaggacgaaggcacccagugguuucugcagaagcacaucucccaggacagggaaugguggauuggacucacguggaacuuggcacggaauggaaccacggaggguaggugccgugaucgcuguuuuaugagaaacuuguguuugcaauucuugccaucacuucucacccaaagaaacauggaacaaauuaauacgaccuaauucucaugguauggauacccuucccuuugguuguguuguggauuaaauaauucaugucuaaugccuagcacagaaucuggcacaucaaauucugacccucuagaaauguucgcuucuuugccuguuccuaauaguaauacucugacugcuuugauucuugcuaggauagugccaggcacuauccugagugcuucguugucacuaucauguugaauucuuacaauaacaaugagaaaaaucauguccccauuuuuuauuuauuuauuuauuuauuuauuuauuuauuuuugagacagagucucucucuguugcccaggcuggagugcaguggcacgaucgcggcucacugcaaccucugccucccugguucaagugauucuucugccucagccucccaaguagcugggauuacaggcagaugccacuaugcucggcuaauuuuuuguauuuugaauagagacgggguuucaccguguuagccaagauggucucgaucuccugaccuugugauccgccugccuuggccucccaaagugcugggauuacaggugguagccacugcgcccggccuuauguccccauuuuacagaugagaaaacugagucucagaaaauaaugacuaagcuauuuuuuaaagugucccacuugucuuuccccacuugcucugacauuaaagcagaccaagugcuuagcauaguuccauucacagucuaauuuuaaugguccugaaagucuuaguccuccuuuauucucugaaggcuccuucccccacccagugcagucaggugagucguucucuacgagccugcagggcccuguucacacuuccaaggcaguacuuuugcuguggcuuaaacagcuaaguugucugucucccuccuagacuacaagcccuucaaggaaagaaccauacccuggccauuuuuguuuucccagugccuagacacaauugagaauggacaaggaggcugggcguggugggucacgcuuguaaucccagcacuuugggaggccgaggcagguggaucacucaaggucaggaguucgagaucagacuggccaacauggugaaaccucaucucuacuaaacauagaaaaauuagcugggcaugguagcacgcaccuguaaucccagcuacucaggaggcugaggcaggagaaucccuucaacccaggagacagagguuccagugagccaagauugugccauugcacuccagccuggacaacacagagagaaacugucucaaaaaaaaaaaaaaaaaaaaaaagagagagagagaauggacaagaaaacauuugcauuuaagccucacacggaucccaugagguaagcguggcuacucuccuuucacggaggaggaaaaugaagucuagagagaaaagacgugcucaacaugacauagcugguggugcacaguggggucucuaccagucagagcaaugcuaagccugacuuuccuacugggcaccuugguacccagagguucucuuugccccuguagaagcuacuggguuugagaaaugagacauggccugugccgaacagccacagaacaacaccagcguggauggaaguguuuuaauaaaugagcuaccgggaagcucauuuaagaaaacccacagccaaggggauuugaauucuuaagacgccccugcagacaaugucuccugaaugguuucuugagguguagaugcaacaauugccgauuucuguguauugaacauccuuucacauccagcuagaggaggugugccuauuaacaccucuccagggauaccguguggcuguugcagaaaaugagguaguucuaacuaggcugauaggcaacaaccuccaauauuuaaugucauuuaagaagcaagggccagauacugugugcaaucacaugacauuuauguaaguagauuucaggcacucauagaugcugauguguggauacaauucaauucauccuggaaucauuuaugagaaacauaacaaugauggagaagcccauagcuuggagagggaagauacuuucauuuuagacccuuuggauuuuuuaaaaccauuucauuugcaugagucucuuucaauaaauuaauaauuacguuucugaguacccauaauaaauguuuguuuuuugagacaaucucacucuguuucccaggcuggagugcaguggcggcaccaucuuggcucacugcgaccucugccucccggguucaagugauuccccugccucagccucccuaguagcuggaauuauggcuaauuuuuguaauucuaauagagacaggguuucaccauguuggccagucuggucuugaacuccuggccucaagugauccauccaccuuggccucccaaagugcugggauuccaggcgugagccaccaugcccaauccauaguaaauuuugauauuuaguguuuucuagcucucugguguccucgacaugguucuguuuuacacacacacacacacacacauaaacacacacacacuccuuuuaaagaguuacaucaguauuuucaaggaucugaagaggcccaaaguaacaauaacugcucauguuuuaacucagcacugcccagguguacuuggcaagggacacagcuuaugaagaagaugauauguuaaaacaucccuuagcccacuucuggacuuuauuauuauuauuauuauuauuauuauuauuauuauuauuuugagacagggucuugcucugucucccaggccagaauauaggggcacgaucauggcucacuguagccccaaccucagcucaagcaauccucccaacucagccucccgaguagcugggaccacaggcagcaugccugacuaaauuuuuuuuuuuuuuuuuuuguagagacaaggucucucuagguugcccaggcuggucuuaaacuccugggugcaagugauccucccaccuccacaauguuaggaucacaagcaugaaccacugggccuggccccuggcucuuccuuagacugugcucagggccaggugugguggcucaugccugcaauuccagaacuuugggagacugagguggguggaguuugagcucaggaguuggaggccagccugggcaacaagacaaaaucccugucucugccagaaauacaaaaaaaucagccaggcauagcggcuugcaccuguggucucagcuacucaggaggcuaagcugggaggaucacuugagccugggagguggagcuuguagcgagcugaaauggcaccacugcacuccaaccugggugacagagcaagaccccaucucaaaauaaauaaauuauugauuaugguuagacagagcuggcagccucauuuauuuaaucaaagcaccuuuugcaagcucuccaauuugguguuccaguucuuacauugaguguuugaugaugacagugaggaagagaacuuuauugguccuggagagagaggucuccaucccaucaacauuaauugcugaccugcugcccagcagcggcagagcaggcgugaguccugcauuuguauaaauggaguuugaagacaguuacugaguccugguggucguguugcccuuccagggccggggacuugguuggacaccuccaaugugaccuacagcaacuggcauggagggcaggccgccgcugccccugacaccugcggccacaucgggagaggcccuuccucugagugggugaccucggacugcgcccagaccuucgccuucaugugcgaguuccgugaguggcccgugccccugaguucccaucucccacccugucucccugccugccugcaggccucucuccaggcucgccucucccuccuguuccugccuccaucucucugaccuucucuuucucuugccgccuccccugucucaguuuucucugggucuuucuuccccuucuguuuuucucuaacucuuucucuuucucucccuuggucucugacucucuuccugccucuguggucucucugucucccucucgcucuucagggccugccgguuucuguccccaucucccugcugaagagcugaccuguguguguuuuucugaccuuaccucuguccgcagcuuucucucccugucucuaugcaucucucucugcccacgugaugcuccgucacucaucccugcccuguccccauccaccugcccaccuuccugccugcccaccugucucaucucuguuucugucuuucccgcuuuuuuuuuuuuuuuuuucugagauggagucuugcucugucacugaggcuggaguggugugaucuuggcucacugcaaccuccgcuucccagguucaagugauucuccugucucaaccucccgaguagcugggauuacaggugcgagccaccauccccagauaauuuuuguauuuuuuuuaauagagacgggguuucaccauguuggccaggcuggucucgaacuccugaccucaagugguccgcccgucucggccucccaaagugcugagauuacaggggugagccacggagcccggccugcaugagguuuaguaugagagugggggcacagagaagcuaacuaacuugcugaaggucacacagcagcaguguguggcugggcuggaucugaucccagggaaccuggcucagcacaaugcugccgacaaucauauucaauuuaucaccccugccaagcggcuccuaucggguucuugcaucucagcccaacccccgggacccuccucuucccgugaaccggcacucaccugucuguaaccgugagccccccuaaugucuugccuucccuuugccucagggguuggccagagccuggccugcgagggacucaaugccaccgugcacuguggcuuggggcaggucauccagguccaggaugccgucuacgggcgccagaauccccauuucugcacccaggaugccgggcguccuucagaucuggagcagggaugcagcugggccaacgucaaggaggagguggcagguagggcccaagggcucugcagcucuggcggccagcagagggcaguugcugguauucugugcucagcaaaggguuccggaagccucugauaaucuucaucucugaccgugggccuccaacaugggggaaaacuggccagucccugcccaucgcacggagcaaggaagcagggggcugugguccacccuccccgacaucaaacacagccauggaucuggugggcauggcgugccucgaccccugcuggaugcaggaaacaucacuuuuuuaacuuaauuuuuaaauuuuugaaauacuccaaacguauagacaagaauagaaaauacuguaaugaacucccacagaucuacuacccaccuucaucagaucugaacaccgugccucauuugcuuaagauucccucguuagaaaaaucaauacagucgggcgugguggcucaugccuguaaucucagcacuugggaggccaaggcagguggaucaccugaggucaggaauuccagaccagccuggccaacauggugaaaccccaucucuacuaaaaauacaaaaauuagccgggcugguggcacaugccuguaaucccagguauuugggaggcugaggcaggagaaucgcuugagcccuggaggcggaaguugcagugagccgaaaucagaucaucgcacuccagccugggcgauggaacaagacucugucucaaaaaagaaaaaaagaaaagaaaaaggaaaaagaaaaaugaauacaacacuaggagacuccuguggaucccucucuuuauuuugagagagagucucacucuugcccaggcuagagugcaguggcccgaucuuagcucacugcaaucucugcuuccuggguucaagcgauucuaaugccucagccucccgaguagcugggauuacaggcaggugccaccacuccuggccaguuuuuguauucuuagaagagacgggguuucaccauguugaccaggcugaucucgaacuccugagcuuaggccauccgccugccucggccuccccaaauguugggauuacgggcgugagccacugcgccugcuuuauuuucaccuucuaggcacguauuccuaaacacuacagacuguugcuuuugcagggcuuuuuuuuaaaucuauuuuuuuaauuuauuuuuuauuuauuuauuuuugagacggagucucagucugucacccaggcuggaaugcaguggcacaauuucuuuucacugcaaccucugccuccuggguugaagcgauucuugugccucagccucccgaguagcugggacuacaggcgugcgccaccacaccagguuaauuuuuuauauuuuuaguagagacgggguuucaccauguuugccaggcuggucucgaacuccugaccucaggugauccgcccaccuuggccuuccugggauuacaagugugagccacugugccuggccacuuugcaggguuuuaauguuuauauaaaugguaucauauugugugucguucuauagaaugcauuuuucuuuucauuuugguuccuguguuuugcucaacaucuuguuuuugagauguauuauccgucuugauacauguugugcugguuuauuuguuucaucuguuguguaacugugccgccauuugucucuucuccuguugagaaagguugguucuuaaucucugugacugugaauaacgcugaagccaagcuccugauagaugguaucuuguucacgugggagaguuacucuagggcuuuguuuuucuaaaucagauuaaaucuacuucugaguugcgcuugcccagugacuaggauucaauuuccgggauuauggggguuucuugcacccugcuaggagguaaaaacuccucagagacuucccugguccaggacaucgggaaacccucuucuuucugcugcagucaccacuguccccgcuggaggguccaggaaagcaaguggccugcugcuucuuggcuaagugaggacacagccccguguggccaggcugcaagccucagguccugggggccagccuccccaguugugccuuuuggcacucuccucugagccucugcuucugcccaaagacccuuugaagauucagggagggacgccaguacucccagaacuuucuccugccucggggaacugagaauggcuccucuguccuccugccuuuuggagcaggcauggggaaaggaaacgcuaaaaucagcuggcugguuuucacugacucuucuuacuccagcguuccugaggcuguggccccugcaaggagaaagggccccggacgggagaauggauguaccuuccucaccaaggcacugcuggggcuuagugagcuguuuccucaaaggcucagcugcaaguuccugaaaugugguacccacagcucagagagcacguuagaggggagcccuguugugggagucggaggaggagcgcagagaggaucccgcggggucuguaucuaagcacccuggucccucauucauucaguuagccaauaaacacuugguuuuuuuugguggugcuuuuuuuuuuuuuuuuuuuuuuuuuuuuuuugagauggagucuugcucuguugcccaggcuggagugcaguggcacagucguggcucacugcaaccuccgccucccgggcucaagcgauucuccugccucagccacccaaguagcuggaauuagaggcaagcacccucacacccagcuaauuuuuguauuuuuuguagagaaaggguuucaccauguugcccgggcuggucuguaccuccuggccuccagugauccacccaccuuggccucucaaagugcuggaauuaccggcaugagccaccgcaccuggcccaagcucuguuuuucaaagagcuugcggcggaguggggagacagugauauacaggcaauuaacuaaugcugugauaaaugccgcaacccagaagagcaaacacuaucuauuuagucaugcaaaacuuauuuuguaccuacuaugugccagguacuguucuauguccuggagauguugcagugaaccaaaaauuuuuaaaaaccuccgacuugauuuccaacucacucccaagugaugccacuuaggaucccaaaugucuuugggccacauucugagccucaaggcaucuggggaccugaagggauuuuaaauuuugucugcaaggcguguuaaauccuggaauuagaucagauuuaguuuuuuuuuuuuuuuaaguggauuauauguggcuacgaagagucauagaaaaaacucuguccucaaguucuggaauuagaccucucuuugagucuguuuaaucugagaacagagauguggugguggcucguguucccuuuugaucagaggggccccccagaucacgggguggagguggggcucaggaaagcuuuacgggggcggcaucaggagccuggcugugagggaagugcaggauccagccacgagaaagacugggggacaagguggugaggacaugagguggcaggcucagguguggacugcaguaugaaccgugaugguggagagagagcccaggauggucucgcuggguaacaacaguauuagaaaaaaaccucagcagggacguggccucugcgucuugaggcaguuuauccauuacaaggggauguugaauauuaugcgugguuuaauuugugagcuggaaggugagcccugcugccacccccaguuugucuaagcaaacugcuuagaccgaguccaaggauggggcagaacccccugggaugugggcagcaggguacauggcaaaagggcggcagguugggguucaaaucccagcucagccccugcugccugggugauccaggcaaguugcagaaucuuucuaaguuucauggggcuccugugagggucaggagaaccugggggaagaguguagcaccuuguaugcacucugcaaaugggguugaaauuucugcaugcucuguuccagcuggcucugggccagcaguaucgggaucagcauccccugggagcuuguuagacgugcacacucuccagcugcaccccauacuuacugaaucagaauccugggggguagggucugagucuaguuaaaugcugacagcugccaguuaauuggagcuuccacugggggaacugcugugucaagggagaagagaugcuuaaaaaaagcaagaggcuggguacgauggcucacaccuguaaucccagugcuuugggaggcugagguggguggaucaucugacaucaggaguucaaggccagccuguccaacauggugaaacccugucucuacuaaaaauacaaaaauuagccggguauggugguguacaucuggagccccaacuauucaggagggugaggcaggagaauugcuugaaucugagaggcagagguugcagugagccaagauggcaccacugcacuccagccugggugacauggcgagacuccguaucaaaaaaaaaaaaaaaaaauggccaggggcagugacucacaccuguaaacccaguacuuugggaggccgaggcagguggaucaccugagguugggaguucaagaccaggcugaccaacauggagaaaccccaucucuacuaaaaauacaaaaugagcugguugugguggcacaugccuguaaucccagcuacucaguaggcugaggcaggagaaucgcuugaaccugggagacagagauugcggugagccgagaucgcaccacuacacuccagccugggcaacaagagcaaaacuccaucucaaaaaaaaaaaaaaaaagaaacacagcccugacaccuuggugucggcccugugauaugagcagaggccagcugagcccacccagacuucugaccaccauacagaauugugagauuuaaaaaaucugugcugcuuuauuuuuguuuauuuuaguuuugagacaaagucuugcucuguugccuuggcuggagugcaguggcgcaaucucagcucacugcaacguccaccucccugguucaagugauucuccugccucacccuccuaaguagcugggacuacgggcgcgugccaccacacccagcuaguuuuuguauuuuugguagagauggaguuucaucuuguuggccagucuggccucgaacuucugaccucaagugauccaccugacucagccucccaaauugcugggauuacaggcaugagccaccauaccuggacaaaaaucugcguuuuuguuuguuuguuuguuuugagacugagucuuguucuguaauccaggauugggugcaauggcgugaucucugcucacugcaaucuucaccucucaggcucaagcuauucuccugccucagccuccugaguagcugggauuacaggcaugugccaucacgcccagcuaauuuuuguauuuuuaguagagacaggguuuugccauguuggccaggcuggucucgagcuccugaccucagguaaucugcccaccucugccucccaaagugcugggauuauaggugugagccaccacucccagccaaaucuauguagauuuaagucauuaaguuagugguaaguuguuacaacagugauuggaaaugaauacaccacccuccagucuuucaguagugccggccauuggccaagccuaccugggagccaguggccaagggaguuuggaaaauguaguucgcugugauacaagcauggcagggugaggguggcucugugggcccagggccaacugcccagaagaagugggaccuagcagguaacugggagaagcacagguggguguucuggaccuguuucuuucucccaggcuucccugugggcaucuaacagaucucgcugggcaggagggagaggugcuggaugacccugaagcuucuggaaugggcugucccugcuccucccuucugugggcaugugguaccaugauagacgcaggauuccuaaucuugccuccucugccgguucucuggguguagauuucuauuuugggccaucucucuagacgcugcuggaccagugguucuugaaguggggucccugggccagcaaugucaggaucagcaucccauaggaacugguuagaaaugcauauucuccagcugcacuccauaccuacugaaucagaaucgcugaggguggggucuggaauaugguaucuucacaagacucacagggggaucuguugcaagcugaaguuugagaccaggaugcuagacccugaacuacuugaggacagaaauccuacuucucccucaccugaguaccuagcccaguaccuggucuucaggagauaucaaaagcuauuuguugggcggaugguggguaaaugaaugagugggugagaggccauucaucucuguacagcucuguugaauguauccucuuuugucuugcacaccauuccugcuuccgcugggaugugcgugcuucccaggccagugccaggagcuacagucaugccagguggcagcagaugagaccuacuuuggaaaccuguguccgacucagggcaguuaccugugggugcaguaccagugccgggaaggugaguccccgacuugcuugagcauagaaaugucccucugauuuuauggcauguccagcuuccccugaaaacagagacagcagccacccacgugggcugaucucugugugcuaagagacucccucauucaaaguugcuccccuuggcuggacgcgguggcucacgccuguaaucccagcacuuugggagggaggaggauagucugagcccaggaguuggagacaagccuggacaacguggagaaaccccgucucuacaaaaaaucuaaaaauuaggcugggugugguggcucaugccuguaaucccaggacuuugggaggcugaggggaguagaucacuugaagucaguaguucgagaccauuggccaacauggugaaacucugucucuaccaaaaaauacaaaaauuagccagccguaguggcaugcaccuguaaucccagcuacuugggaggcugaggugggagaaucacuugaaccuagcaggcagagguugcagugagcagagaucaugcuauugcccuccacccugggcgacagagugaaacccugucucaaaaaauaaaaauaaauauuagugggugugguagcacauaccuguagucccagcuacucagucucuacugaggugggaagaucaccugagccuggaaagaucgaggcugcagugagccaugaucgcaucacuguacuccagccugggugaaagagcaagacccugugagaaaaaaaaaaaaaaaaaaaaaaagacccacauaaaaauacuggacagguagccagaagagagucgguuauaaacagaaaugugcaauuuugcuucacaagugcaugcagcauuuuauguuuuaauccacagcccugcagcugaugguguccagugagaguuucaucuuugacaaugucaccaucucccugacguggcuccucucacccuacauaggaaaccuguccuguauaauuaguacaggagacagccacacuuuugaucccuacaacccgccgagguaagagaaaucucugagccuugagccagguuguaucaucaguuuuuuugccacauaacaaaccaacccaaaacuugguggcuuaaaacaauaguuaccauuucuuacgguucuuuggagagcugggcggcuuuucuugucugaguggaguuggcugggguaggcuguccgggaagaccucacucacucacaugccuaguggucagcuggaugucagcuagaagcauaugcugcucaucacucaacagguuagccuaggcucauucacacaguguuccuagcagcggagcccaaugcgcaaacauuuuuucaaaucucugcuuguguuacauuuucuaagauaccguuggccaaagcaaguuccauggccaagaccagauucaagagguggaggaauagaccccaccuacugauagaaggaguguggagccacacugcgaggugcuucuauaugggaugggaggaacuguugcugcuacuuuugcaaacacucuaccucauagguuuucuuuucuuuucuuuucuuucuuucuuuuuuuuuuuuuuuuuuuuugaggcagggucuuucuccaucgcccaggcuggagugcaauggcucgaucucggcucacugcaaccuccaccuccuggguucaagcgauucuccugccucagccucccaaguagcuagaacuacaagcaugugccgccaugccuggcuaauauuuguauuuuuaguagggacaggguuucaccacguuggcuagguuggugucgaaccucuaaccacaagugaucuacccccucggccucccacagugcugguaguacaggugugagccacagcacauggcccccugucacauuuguguucguggcugccuugaauguuucauggugucaaaugagaaacuauuuacagugauguuuugggggcaaauaucugggugauacaaauaccuaugccacuguucuguggguuucuuccugacugcuaugaguuuguaaagaaaacgacagauuguaaguuacacaaucuuucagcccccaaaucuuguagaacuugaauuuggcauaagucaaaauugccuaaauguagccccgcuaugacccacagcuacacaggacuuuucagugauaaacagugguuuagaacagaagcaaaugggaccaaauguuaauguuuguuaagucuggauggcgaauccaaggguguuuguuguauuauucucuggaaguuuuugugcgauuaaaaucuaagacacagcacuguuugacauuugcagucucucugggcauuagcucuaaacaacaaucacugacauuuuuuucucuuucaaaggaaauagaugguggcaccuccuccaccauugccccacccaaauaguccaucuuccuuuacauuaaagauuuguuggaccuugaaacuacccacccaccuuuuuuuuggggggggggggggcggguggaggauuggcagagucuugcucugucacccaggcuggagugcaguggcaugaucucggcucaccgcaaccuccauaucccagguucaagcgauucuccugccucugucucccgaguagcugggacuacaggcaugcuccaccacgcccagcuaauuuuuguauuuuuaguagauagaggugggguuuugccauguuguccaggcuggucuugaacuccugaccucagaugaucugcccaucucggcuuuucaaagugcugggauuacaggcgugagcgauugugccuggucaccacccaccuuuuaaaaaucauuuuuauaaacacugggaaaugccuuucugaugccuucuuaucaauacuagcagccacagaacucagguuaugauagggaaaauagcaugaauuuugauuuuugaauguacggaagccacauuuuuuuguguaaauaucacugugcuuuucucuuauguguuggugcagccuccuuuuucuuaacucaucauuagucuaagaggugagauguuuaaaucaaacccuucguauccauuguugauaaauaauaagagcuccugggaagaauugcauugcuuaggagucagaagacuucucuguuagaagcuccuuuuuaccuugccuuauauucauuugcauggagggccuuuuuuuuuucuguguuugucauggaaaauuuuccacauuucugaaacuguauuacgggccuuacagaacaauuugcuuuuggugaaaucugugugaauccagcguugguuagcugagcgccaccuucuggcaaaucuagggauugacauuguucuuccguuaaucggcugcuucugcgcacagcugauauugggcgugcagagauuugucugaaacuaauaauccacaaaacagcaggagccuuagagugaccuagagcuaaaguccucucucggggaaccagaauuauaaggcaagagcaauggaucuagagaaaagagaguagcauggaccugaaagcauguggcguauucaaauaacugcaaggaccucgccaugccuggaguucaggacucuguggaagaaugaaagaugcugaaaaacucagcaggagccugguccugaagagcuguugaugcuagccagucuaacguagguggggucugucaacuaaagaaaaaucaagcuuuuuaaauaauuaaaguuaguuuuguucaggacgacagacugagaacuacagccugggaggucuuucaaagagguucugccagacugcuccaaaacaguguuucagcucacagcuucuauauggguuguggagguucaguccacguaaaaucacaucaaaguuugggugcaagagugcaucugccucuagaugacuaaaguauaucuuguuggccggcuucgguggcucaugccuguaaucccagcacuuugggaggccaaggugggcagaucgcuuggggucaggagcucaagaccagcccggucaacauggugaaacuccaucucuacuaaaaaaaaaaaaaaaaaaaaaaaaauuagcuggacgugguggugcaugccuguauucccagcuacacaggaggcugauggaggagaaucgcuugaaccuggcaggcgaagguuucagugagcggagauccugcuacugcucuccagccugagcaacagagaaagacucugucucaaaaaaaaaaaaaaaaaaucuuguuguagauugcagaagcauaaucaccagccaucucagauguuaucuuuuuuuuuuuuucuuuaagacggagucuugcucugucacccaggcuggagugcaguggcgcgaucucggcccacugcaagcuccuccucccggguucacgccauucuccugccucagccucccaaguaguugggacuacaggcgcccgccaccacgccuggcuaaauuuuuuuuuuuuguauuuuuguagagacgggguuucaccguguuagccaggauggucucaaucuccugaccucgugauccgcccaccucggccucccaaagugcugggauuacaggcgugagccacugcacccagcgagacauuaucuuauauguaagaaaaggaccagucauuuaucuuuuuagggauauagugacucaggcuagagacguggaagccgagcacucuauucuguuuugucuucaaaguguucuggagggcugccugucacugcagucaggggcuuccugugauuaugcuggcuaacagaaaugagcacaccuaucuccuugaguuugcuacuuugucucacaggaaccaggaaacagacucuguuguggagcaugggaagggaguaguaagauggggcaagaggagaguugaacugggaugcaggggccacagagacccugacgauccugcagaaaccucugagcagagauggcccucagaguugcuuccaguugaggccagagagccagaccauuauaccccggcacugagcacucguggggugcagauguccaugggaggggagguagguuugagcgaggcagcucccuuuggcuaaaagggacuccuggacauggauucagcuguaagcccucagccacagcucacagguguacugggggaaugcaugcucaggcuugaaggguggaaucugggggauucccuguagcacccacuacagaggauaauaggaggguuuucaggccaggaacgacauagucuaaguuguuacuauuauugcuaguguuacuaguacucgcuggauuuuuuuuuuuuuuuuuuuuuuuuuuuuuuuuuuugagacaggcucuuacucugucgcccagccuguaaugcaguggugcgaucucagcucacugcaaccuccgccuucuggguucaagcgauccuccugccucagccucccuaguaccugggauuacaggugugcaccaccacgcccagcuaacuuuuguguuuuuaguagagaugggguuucgccacguuggccaggcuggucucugucuccugaccucaagcgaucugcccgccucggccucccgaagugcugggauuacaggcauaagccaccaaggcuggccagccauacacuuuuaaacaaccagaucuugugaaaacccacucacuaccaagagaacagcaucagggcgauggugccaagccacucgcgagaaaacgccccuaugagccaaucaccuuccaccaggccccaccuccaacauuggggauuauaauucaacaugagauuugggcaggagcgcagauccaaacccugucagugcauguguaaaugcgugucuuuguguuuccccaacacuggucaugucccugacuguggccggcaauguguccagcaaugugacccaccaguucacaucuccuggggaauucaccguguuugcugaaugcacaaccagugaguggcaugugacagcucagaggcaggugaccgugcgagacaagauggagacgcucagugugacugcaugcuccggccugucccagucaggagccggcccucucugccaggcugucuuuggggauccucuguggauucagguggagcuugauggaggugagucugcagaauugggcacaucaaggcaagcuauaaaaucacugauuuccuccaaaucuauccaacucccagaccuuaauaaauagugggcugggugcaguggcuugagccugcaauuccaacacuuugggaggcugaggcgggcgcaucgcuugagcccagaaguucgggacaagccugggcaacagggugagaccccauuuguacaaaaaguacaaaaauuagucagguaugguugcacaugccuguaguugcagcuacuuggguggcugaggugggaguauggcuugaacccgggaggucgaggcuguagugagcugagaucaugcuacugcaugccagccaggacaacagagugagacccuguuucaaaaaaaaguaaauaaauaguaacaaggaucaccuacugaguucuuuuuuuuugagauggaguuuugcucugguugcccagguggagugcaacggcacaaucucagcucacugcaaccuauaccgccuggguucaagugauuccccugccucagccucccaaguagcugggauuacaagcaugcaccaccacaccuggcuaauuuuuuguauuuaguagagacaggguuucaccauguuggucaggcuggucucaaacuccugaccucagaugauccaccuagcuuggccucccaaggugcugggauuauaggugugagccaccacaccugaccgaguucauuuuuaaacuaucauuuauucauuuauuuagcaccuagugugugccaggcacuguucuaagugcuuugcauaaacuugucuacucauuacauaguaguauuaucuucauguuacagaugaagaaaugaagacacagaaagguuaaaacauuugcccagagucagaaggcuaguaagguagugagugcuccuagccuuccaaaggcccuucuuugcaucccuguagaaccgaacuuccgagucacuuccuuuugggaauuuaacuaggaugagguggcacugggacugcuaccaacugggccugagcccaucucaguacagccagcaucgacuagcuuggcacaaucaaguugccccuggccaaggccaguauucagcugcacccacugguauagccaugccaacuguuauggcugagguccauucucauuggucacaggguguuuucugauuggucacagagacugcucugauugauugucauguccauucugaucggucacagugucuuuucuuuuuuuuugagacagagucuugcucugucauccaggcuggagugcaguggugcgaucucagcucacugcaacuuccaccacccggguuccagugauucucgugcuucagccuccuggguagcugggacuacaggugcgugccaccaugccagguuaauuuuuuauuuuuuucuauuuuaguagggaugggauuucgccauguuggccaggcuggucuugaacuccugacaucagguaaccugcccaccucggccucccaaaauguugggauuacaggcaugagccacugugccugcccacaguguguuuuccuuuuuuuuuuuuuuuuuuuuugagauggagucucgcugugucccaggauggagugcaauggcaugaucuuagcucagugcaaccuccgccuccuggauucaagcgauucuccugccucagccucccaaguagcugggauuacaggcgcccaccaccacacccagcuaauuuuuguauuuuuaguagagacaggguuucaccauauuggccaggcuggucuugaacuccugaccucaugauccacccgccucggacucccaaagugcugggauuacaggcaugagccaccgcgcccagccuguguuuucuaaucggucacagagacugcucugauugguugucaugucuauuuugaugggucaggguguccauucugauuggucacagcaucuauucugauuggucauggcaucuauuuguuggucgcagugucuauucugauuuaucagagcauccauucuaauugguuggcgcccaugcugugcugguuguuaaauauuuuaaauuaucauccuuucucucaauagagacucuccuggcuaagacucauccucacccagggcagcguuuuuccugaagcccaggaccaguuugagauuagaauagaggccuguugauguaaacagggcagcagagagcuagugcaaugagcagguggcucgguuugaccucacaucccaccuggagcccucucauagcaauagcuguggaagucauaauggggcuuuaacacagcccucaggaaaccccuucuguucuugcauguuuguuggaugaagagggcucauauguuccccugaggaaacaaaauaauccuucauuuauuuacucauccuacuaauauaauugagugccuacuacucugccgggugugggcgaggcagcaguaaauaugaaagucaggguucccauucucauggggcuuauaucguaguuaucaucaucaucacccagaugagaacuacgcuagcuugguuuuuauuggaaggaauccuaauuuguugauuuaagucagauuuuaagagucaaccgcaauauuuaucauccaguaagaacaaccaucugcaaccugcaagggagcccccaucuucccgugaacgggcugaguucucauguugguuugcaggguucugggcggucaccaguguaggaugaaggaauggcuuuacuugcuccugcuuaaaacaagacccaaagcuaauucucaugcauaaaaaucagcccccacccuuaagaaaugcucccuuuuaguccuccuccuccucccccgaccaggacaucccuggcaacuaaaugugguaauuuuuuaauuacaaauauuuagguucucggguaagacauguauaguauaaauaaguuagaauaugcaaaugaacagagcggacccccagaugacaaaaucacggccgggagcgguggcuuacgccugucaccccagcacuuugggaggcugaggcgggcaaauccaaggucaggaguucaagaccauccuggcuaacacggugaaacccugucucuacuaaaaauacaaaaaauuagcugggugugguagcaggcgccuguaaucccagcuacuccagaggccgaggcaggagaaucacuugaaccggggaggcagagguugcagugagcugagaucgcaccacugcacuccagccugggcgacagcgccagacccugucucaaaagaaagacgaaaucagucauuaaccuaauacucagggauaaccaccauuaauauuugagaagggggcauauccuuacauauuucuuuaugucugcaucuguauccaaguuuguauccagaaucaggcuucagagacugacucugagcugccauaguauuaucaaccgcaugguuguuaccaacauucuuuaauuuuucuuaccccacuuaggaacaggagugacuuacacugugcuuuugggugacauaacccuggccgaguccaccacccaaaagggcucgcuaccguacaaucugauccuggacagagaaacccagaaacugaugggcccugggaggcaccgccuggagauccaagccaccggcaacaccaccaccucuacaaucuccagaaacauuacaguccacuugguggagcugcugucagggcugcaggccuccugggcuucugaccauuuggagcuuggacaggaccuauugaucaccaucucauuggcucagggcaccccggaagagcugaccuuugagguggcuggacucaaugcaaccuucucccacgagcaagugagcuuuggagagccauuugggauuugccgccuggcuguuccgguugaagguacaugggguuaguggcuccccuucugaugccccuccucuucccuuugugacuuggugcccaggguccugccggccaguuuuccaguguguccgggacauagauuugguucacagcauccugccugggucauaagauaaggaacagccagauguaaucugccaucguugaguuaucagcucuccacuucggcacuucugacauucggagcuggaucauuccucguuacaguugggggcugguacugaaggaguuuuagcagcaucucuggcuuuuauucaccagaugcuaguaacaccagcaccccaagucaugaugacaaaaaugucagacauugccaaauguccccuggggggcaaaaucacccccauuuagggccccuguaagagaccaggcauauucagauuucuucaaacaucucuagagaagagugugguuuggggaacugcaggugaugcccuagcgggaaagagguaaaaaccaagaauggcagagauggggauggagagaggaaguguugccgaccauggggucuuaggcucugauguacucaaacuuuccuggacgaggcuuuuguuagaggcuuauguucaaacauaaagaaggcagcacuggaguggagguucaggggcugacuccccaaaaaguccagaaggcguucuuuuuuuuuuuuuuuuuuuuuuagagauggagucuugcucugucuuccaggcuggagugcagucaguggcgugaucuugacucacugcaaccuuugccuccuggguucaagcaauucucgugccucagccucccaagcagcugggauuacagacaugcgccaccacgcacggagaauuuuuuugguauuuuuaguagagagggguuucaccauguuggccaggcugcucuugaacucccaaccucaggugauccacccaccuuggccucccgaagugcuggcauuacaggcgugagcccucgugcccggccugucuuuuuuuuuuuuuuuuugagauggagucccacucugucacccaggcuggagugcaguggcgugaucucagcucacugcaaccuucaccucccugguucaagagauucuccugccucagccuccugagucacugagacuacaggcauguaccaccaugccugacuauuuuauuuuuaguggaaacgggguuuaaccauguuggccaggcuggucuugaacuccugaccucauaugaucugcccaccucgaccucccaaagugcuggguuuauaagcaugagccaccacucccggcauucugaaaggagguaggaugggaaaagggcgauguuuaagcauguggagguggggaauguucagcgccugugcagucuggucacaugcuucuugaugugugguaugucucauuagcauguuaaagcuccacccucgggcaugauuuuuaguauuauaaugaggcaaaggguaaagauggucauuuuucuggucuucugugugugcgggcuauaggguuaacucccuugaguaagauuuaaggugggagcuguuuguuuucguuuccucaaggucugcacucagugggcauggcaccuugagcaagauuuguggugcaacgucuggaugaucugacuggggucugugccugccaugggccacccuccccaaccagcuuguaguagaguccucgaugaggcagggcagggguccaagucccaucucuggucuaucucagaaguauuugcaaugaugcugacgggaggacagacuggcaggcaccagccaggggagguggccacagcgcccauuugcauuuaaucuguaaggaacagagaguucuugagggcccggaugagaucagcaggcagaaaugugaugagaauggcagagucuccagcccauccaggaccugcccguagcucccccuggaucucagaaguguguuagaaaacgggugauacugugcaggugugggguuaccaugcccucugcaagcaacuccacaaaccagauagcagaagggacaauagguuugagaagaaaaccauccgggcuuugccagauaccaaggguccagcuuggaagagggaaagucuagaggcugcugcagcuggaaaaucacaccacgcguggguuauaagccagaugcagguuuugcuuugucaccuauaaaaauuacuccugccaugaaagucgcugcuauaaaggucacuccacaggggaagaugaucccucucugauaaaauauccaugugcuuugugacuuuugcucacuauuagaugauuaacagacuguuccugccccuaaggccaacagauuuggaugacuccagggguggcgggaguggaaggauggaaagggaacgggacagggcagggacauuugcacuugguggugcuggccgaguccuagcuggccuggcucuugagggcuagcagauguuucaagcugccucuuucuuguaggagcuucucuggguucuuggggcccccagcugggccuuauaggccuuuguuccugggguggugggggaugccuccccuuuagcuggucacacgcccuggcugcuucucccuggccaccuccccucucuguuggacucuccucauucucccuccccucgucagcauccgucuccccaaggcacacaucugguccacagaacauucugacccaugucuuggccgacucccagccaaaugcaauuauuucccagacgcagaaauggagccccuuccucccguccccuucccacccgcacgucuucccgucacagacuguuccuucaagggcaugaguaugaagccuguccaugcggaccccaaacagacacauaccgggcuuuccaaggaaggcuccucucucaagcauuucucucugggcuugagaacacagaagguagccccuacccauagccccuuccccaugagggagaagggaugggacacacauguaucuaaauaaaucuuacaaauccuucuccaagccuggccaacacggugaaacccugucucuacuaaaaauacaaaaauuagccuggcguggugacaugagccuguaaucucagguacucgggaggcugaagcaggagaauugcuugagccugggagguggagguuguggugagcugagaucgugccacugcacucuaguuuggaugacagaguaagauccugucucaaaaauaaaauaaaguaaaguaaaauaaaauaaaauauccuuuuccacugucuccacgcuucugacaauccugcuaugugucucccucuugggaaucugcagucuuaucuaucgagaaccuacuucuccuuuggaauuuagcuccagcccuggcucuauccugugaaccauuucuuucucuccugagguugaagcgggcccacccaaugcccacugugccccaugccgauuccucccgugguuuggcguucacuguccuaugugucuacuacaugauaaggcccuugaggacaagaaccaagcuccuucaucucuguguccccagagccuugcaccaugccugacauacagcagggauucauuaaaugcucagaggugaaagauuucguuggaggcaucgguggacuagagaagcaagcugggagaguuuucuuggucaaguucaugacaauggcugugacucuggguccuuuguauugcaggcaccuuucuggucaccaugcuggugaggaaugccuucuccaaccugaguuuggaaaucgggaacaucacuaucacaggcaagguguuucugcaagggagcauaaaaccuuuuaccaagaguccagagcauugcaccugcuugggcuccagugaggggccuuuccaaacacggcucugaauauguaucuuguucuacagaugguuagaauucuccaguuauucuaaggaggcaaugauguuuacaguaaaacauuucaccacugacacagaauucuuuuuuuuuuuuuuuuuuuuuuuuuugagauggagucucacucugucacccaggcuggagugcaguggcaugaucucggcucacugcaagcucugccuccuggguuuacaccauucuccugccucagccuccugaguugcugggacuacaggugcccacuacuacgccuagcuaauuuuuuuguauuuuuaguagagaccggguuucaccauguuagccaggauggucucgaucuccugaccucaugauccgcccgucucagccucccaaagugcugggauuacaggcgugaaccaccgcacccggccaaccacugacacagaauucuaaaacaagaguuugcguucauuaugaugcuuuaagcugcaaguaacagaagguccaaccuaaguagcuucagauucagggcuuucuugacucacauaagaaguuaggagguaagcacuuccaggguugguucgguggcucagugaugccagcgagaaaccaggcucagucuaucuuucucgucugccauccuuagagcuuuggugcugccuuaggcuuguugcucaaggaaucaaagugacugcugcaguuccggauauuacaugucaacgcagcguaccagcagcgggagcagggguuuccuccugugcaccucuuuuuauuaggggaaaaaucuuucccacucacucuaagcaaucaucaccucagauaccaugaccaaaguagggucagguccgcugcuauaaagugcacuggaaaagcagauacccagcauuuucaguuucugugggagaagguggauucuggcugccaggaggaaggcugggguaauggcuguuggggaacuagcugagaguagccaucacagagguaggguucacuugaauguguuugcuaggacaauucaaguagcaagggacagaaacgaaggugaaacuggcuugggucaaaaggaaauuuuaucagcucagaaaaugaaaagccagcugggcaccguggcucaugccuacaaucccagcauuuugggaggccgaggugguggaucacuugaggucaggaguuugagaccagccuggccaacauggcgaaagccugucucuacuaaaaauacaauaauuagcugggcgugguggcacacaccuguagucccagcuacuggggaggcugaggccaggagaauugcuugaaucugggaggcagagguugcauuuagccaagaucaugccacugcacuccagccugggugacaaagugagaugguguccccaccccccgaccaaaaaaaaaaaagaaaaaagaaaaugaaaaugaaaagcccagggaguagaccuguucuuaaacacagcuggaugagucgcucagacagugucuucagaaaccugccucuuuccuccucugguucuguguugacuucuuuuggauucucucuucccagcaguagcaagaugaccccaggcuuugaucuuuaaccccagaggagaaagaguacgucuugauggauauuucuaguagaaguccugaggcugccucuugcuggcugaagcucaguucaugguuucuccuggaccagcugcugagaccaggggaagcagcagucaguuuggcaggucagggucucacgcccacgcuggaguacaauguagggucagcuucacccaaaccaaggccugagaguuggggagggaugguucuuagggaaaauaucacccguagaugcugcuaccaagggaggggaucauagaugccuggaaauucgacagccagaugugggauuugagacccagaaaguuuaauugacuuugcagaagucacauggcugauucaugcaggaucaaaggcagcaaauguuucuccuaauuuuuucauucagggugauuggacugccuuccuucuuaagguuaagaaaguccccuuucucuggcaucuuagccuugauuuguacaguuuuacaugccuuuggaauuauaguugugugaaugagaauucacugggagagaauuuuuuaaagaucagugguacucagaccuuaauauauccagggccuuagugaaucacaugaaauaacucuaaguuccuacuuuaagcacuacacuuuaauuagauauuaaucauuaauauuucaauauuuucaguaggccaggcacaguggcucacgccugugaucccagcacuuugggaggucgaagcggguggaucacuggaggucagagguucgagaccagccuggccaacauggugaaacccugucucuacuaaaaauacaaaaauuagcugggugugguggugcacaccuauaaccccagccacuuagcaggcugaggcaggagaauugcuugaacccgggaggggcagauugcagugaaccgagaucacgccacugcacuacaggcugggcaacagagcuagacuccaucucaaaaauauauauauuuucagagacaucaauugauuguaucuuuuuccauuguuuaaacuugaaaaacuagcguucuuuguuucuuucuuucuuucuuuuuuuuuuuuuuuuuuugagacaggaucuugcucugaugcccaggcuggagugcaguggagccaucuuggcucacugcaagcuccgccucccagguucaagcgauccuccugccucagccucccgaguagcugggacuacaggcgcccgccaccaagcccagcuaauuuuuuuguauuuuuaguagagaugggguuucacuguguuagccaggaugacauucuuucuagauguauaguuuacaaagcaauucuauaaacagcaccacauucagucuuccuggagcccugagaaauggggauggacuccagguauuuuuacaaaugaggaaaccaagacucagagaggauaacucaccugcccgguucacauagccaaugggaggccaguaagaggaucugacaacaggguaguguguggugccgacuccacccacuugccagaggugagcgugcccaucucuccucacucuauauucaguagcaucaggcuuauagauuggugggaacauuuauaccauggaaauugacaaacccuacaaaucagggcuucucacucccaccuccuuuacugguaguuaaacauuagcagugcaggcugggugcaguggcucaugccucuaaucccuacacuuugggagguugagaugggcggaucaccugaggucaagaguuuaagaccagccuggccaacauggugaaacgccgucucuacuaaaaauacaaaaaauuaucuggguuggccgggcgcgguggcucacgccuguaaucccagcacuuugggaggccgaggcggguggaucaugaggucaggagaucgagaccauccuggcuaacaaggugaaaccccgucucuacuaaaaauacaaaaaaaaaauuagccgggcgcgguggcgggcgccuguagucccagcuacucgggaggcugaggcaggagaauggcgugaacccgggaggcggagcuugcagugagccgagauugcgccacugcaguccgcagucccgccugggcgacagagcgagacuccgucucaaaaaaaaaaaaaaaaaaaaauuaucugggugugguggugggugccuguaaucccggcuacucaggaggcugaggcaggagaagcacuugaaccaggagacagagguugcauugagccaagauugccccacugcacuccagccugagagacagagcaagacugugucucaaaaaacaaaaacaacaaacaaaacaaaacaaaaacacacauuagcagugcauagcugcaucugucugacucuaaaucuuguguuuuaucugcacuggcagcugccucuuucucaacuaccaaaggggugucuuuaguccagugguggacaagaugacucacuuuuaauccauuucccuaggaccugaauguuugcuauguucccuuaaaccauuuucaaagacaggcugacgccccugguggcauuuuccacaugacucucugacucuauauuuugacagccuuuuauaagguuuccaaccaaagcuugauacccguucccacuguguucacagccccuuccggucuccaagaaccaucugggaugaaugcugaaggaaagagugugaguauugucuuuaaaaaacguuuaaccucacaaggaaaagauguccaagcacucuguuuuaguuuugaguuuugguuuuuugguaccaauacccagagcacuaggaaucccugaggcuucuuccauuugagaagaggcccaaaaugacugaauucaaacaaagcaaguugucuaaucacaacagaguuauguuguaaaucuauaaugagcuaucuaggauauguagauaucuguuagauaucuuggcaauuaaacagcacacuuguaaaaaaaucaauaggucaagaagaaaucacaagggaaauuagaaaaaauuucuaacuacaugauaaugacaauacaaccuaugcacauuuguggaaugcagcuaaagcagugcucagagagaaauuuaucgcuuuuaaugcuuauauuagaaagcaggaagaaaagaaaacagaccaagcucuucaguuuuuauaacaagacugaguucagcuccuugcuguugacguuguucgugcgugcacuuauucuacaacaaagacuuacugugcaucuacaacauucaaggcuugguaucaggggcugggaaugcaauagugaauaagcacauauggucuccgccuucaggaagcuuacugagugauacuaacgaacauaucggcccgguacaguggcucacgccuguaaucccagcacuuugggaggccaaggugggaggaucacuugagcccaggaguucaagcaagaaagugagacccucaucucaaaaaaaaaaaaacaaaauuaaaaauuagccaggcauuaagguacaugccuauggucccagcuacuugggaggcugaagugggaggauaguuugggccugagagguugaggcgcagugagccauggccgugccacugcacuccagccuggguaacagaguaagacucugucucaaaaaaaaaacuccaacaaacaaauuaucauagaauuaggaauugugguaaguaucuaauaagaaccaauagagugcaacgauagcaacgaacaggguggucuggcugauguggucagacauggccucuccagaggugacauguaagcggacacaugaagauaagccagccagccaugccugaaagcagaacaagagcuuucugagugggcagaucugagaggcaggcgauggccugaagccagcguggcuggagccuguuggagggagggauguaggagauuauggacacguggacagaggccagaucacgcggagccuuaguugccaaggcaagaaauuuggauuuuauucucaggccacgggaggccacuggggcuugaguuccacuggagcccuguguuauuucaggucaggacuucggggcuugagcaagaagcuccacagcccaagcuguuuaacaagucccaccagaacuuacuccaggaacaccccguguaccccgagccaacacucagaauaacgugacuugcccagggauccugagcaaccaacuccacgccccaugaggggaaggaagccagggggauuggccagggucugucuccaccccacgccuuacacugcagcugcucuuggugcagacugcucuggggugaaaggggaaugccaacagcaccccacagugagccugagcuaacuguaguuggagucucaccagcuggcugcuuuuuuuugcagaaagauaaaggcgauauggagguguacauccaaccugguccauauguggauccuuucacgacagugacccugggcuggccagacaaugacaaggaguuacgcuuccaauggucaugugguaggugacaauagaguucuuuuuuuuuuuuuuuuuuugagauggaguuucacucuuguugcccaggcuggugugcaacggugugaucuuggcucacugcaaccuccacuuccuggguucaagccauucuccugccucagccucccaaguagcugggauuacaggugccugccaccacgcccagcuaauuuuuguauuuuuaguagagacaggguuucacuauguuggccagguuagucucgaacuccugaccucaagcgauauacccgccuuggccucucaaagugcucggauuacaggugugagccaccgcgccuggccaaugauagaguucuugaauuguccuguuucacuaagaaguggugagcaguggucagauuuugcuguucuuuuucuuaaucuucgcaccagcuuucccuauggccuacauuuuguauaacuuguacaugccagagcuugcaaauuccauggaaauaggagguggggccgggcgugguggcucacaccuguaaucccagcacuuugggagaccgaggcagguggaucacuggaggucaggaguuugagaccagccuggucaacuuggcaaaaccccgucucuacuaaaaauacaaaaauuagccaggcgugguggcgcacaccuguaauuccagcuacucaggaagcugaggcaggagaauuguuugcaccugggagguggagguugcagugagcugagauugugccauugcacucuggccugggcaacagagcaagacugcgucucaaaaaaaaaaaaaaaaaaaauagaaggugggagaaagcagugacagaccaaggguggcccugaaugcaggcagcaaggggaucuagagaauuuuaaaacaauaaugaaaccugaaaagcugguccauacgcugacaauuccaaacaaaagugauaaagugcuccucuucucugguguggacuccuccccuuuccccagcccuuugguauaucccuagggagagaaucuagaagggggaagugagucaggcauuuuccaacaaaccaagauggcagcacuagcgcucacauuguagaaaugguauccuccuuuuuacaggaauauagccuagcuacauacacauucuuuuagcuuuuagacauaaaauaaaugggccaggcacgguggcucaugccuguaaucccagcacuuugggagguugagguggggggaucacuugaggacgggaguucgagaccagccuggccaauguggugaaaccccgucucuacuaaaaauauaaaaauuagccagguaugguggugggugccuguaaucccagcuacucaaaaggcugaggcaggagaaucgcuugaauguuggagguagagguugcagugagcugagauugugccacuacacuccagccugggcgacagaguaagacuccgucucaaaaaaaaaaagaaagaaagaaagaaagaaauguuauucauacuguuuucuuuacccuuuucucauugaacaauguaaccugcauauuugcauauuauaaugucgugguaucgucucuauauugauuuucuuaauagcugcacaauagaccauaauguugaugugugauuuuuuuuucuuuuuugagauggagucucgcucugucacccagguuggagugcaguggcgcaaucucggcucacugcaaccuccaccucccagguucaagcgauucuccugccucaggucccgaguagcuggaauuguagacacgugccaccaugcccaacuaauuguuguacuuuuaguagagaugagguuucacuauguuggccaggcuggucucgaacuccugaccucaggugauccaccugccucggccucccaaagugcugggauuacaggcgugagccgcagugcccggcugaugugcgaucauuucuuuacccucuuuuuggacauuuagauuguuucacauuguuugcucuuauacaguucaaucucuauuuacaacugugguuacuuucauaaauaaauuuguagaaauggaauaacugggucaaaagucaugcaacauuuuaaggcuuuugauguuaauuguuacgugguaaugacaucccucugaauauucauucuccuuaucugaauacagaguaugcaaguccagaguuuaggcgaccgagcugaugagccugaacccugaacauauuuuggaaauaugcucagggaacauaucuugggacuguucucccagggcuguagaucuagggaaucuuggaauucuuggaauagucccaggaaucuugggaauauucuccuggggauuuagaucuuccuggccucucugcugcuauaugccugucaccauauuggagauggugggaggugagguauugaugaguaaacaucugucaauagaguugaagggcagaggauacagaaacuuaggaagcugcuaacauaaagcaggaggugacacagcagccucccagauggcaguacaaccucccaggccgccguaguagcccacagggacuuggcgcuguggacagccucauccacauggaaugacaaauauaccgggauaagaagcugcccuggaccuucucccagggccacagauccuccuggccccucuccugcuacacaccuuccugagcaccagugcaacacaagccaaccacauccugcagauuugcucagaguuugggugaagcaugguucuuuuucccaaaagcauccuuccauagcaccauuucugcaaccugcauuaaaagugacguuuuggccgggugugguggcucaggccuguaaucccagcauuuuggaaggccgaggugggugggucaccugagguuggaaguucgagaccagccuggccaacguguugaaaccccaacuccaguaaaaauacaaaaauuagccaggugugguggugcaugccuguaauccuagcuacucuggaggcugagacaggagaaucauuugaacccaggaggcggagguugcagugaggcaagauggugccauugcacuccggccuuggcaauaagggggaaacuccaucucaaaauaaauaaauaauaaaacugacauuaaaaaauuaaaaugucuauuuagagcugauguuauuauucaugaccccuuucaaaaccagaagcuagcagugugugccacguucagggcuccugauggaucauagugucuguccauuucucucagggucuugcugggcucuguggagcagcuguguugagaggcagcugcuucgcacagaccagagggagcuggugguuccagcauccugccugccgccgccugacucugcugucacccugcgccuggcuguucugagaggccaagagcuggagaacagggcagagcagugccucuacgugucugcgcccugggaacucaggccucgagucagguggggcacgugggcaguuccuccaggguccugauucauucguucagccaacacuuacugaggacccacugaggcuggggcugccuuggggcaaggcuugcugugguggucucuguugucauagggguuacuaccaccuggugaucagcacuucuggacacgaaugaagaaggcagagagcgcaccucuaugaaaacugcccugacugggguuagagagacuucucucaggaacugcagcucagcagagguguucaggagaaauucacagggcagggaaggggcagcuggagcaggaacagagcgggcaaagggagggagcagagaaucaucagggagcgaaagaggccaauguccugaggauggagaagagaagggugggaaggagcugguaguguaggcagggccuggcucaaguggggccuugccggucauaucaagauuuuagccuuuuuccuaagagugauacagagaaaccacccaagaguucuuuauuuuuauuuuuauuuuuuugaaauggagucucacucugucacccaggcuggagugcaguggcaccaucgcagcucacugcagccuccgccucccagguucaaacauuucucgugccucagacuccugaguaucugggauuacaggcacacaugccaccgugcgcagcuaauuuuuguauuuuuuguagaggcaggguuucaccauguuggauaggcuagucucaaacuccucaccucaggugacccaccugccucggccucccaaauugcugggauuacaggaaugagccaccaugccaagccaagcaaccaagaguucuaagcaugugacuucaauaugcucugguggcucaguggagaaugacuuggaagagggcaagagaagacccagggagauugcccaggcucuugcaggagucaagguaggaggucaaguuugcuuggacuaucagccagucccugcaggaagcugauggcucagccaaaccaggaaugaauggaagagagcugaugaagggacuauuuacaggugagggcagguauaaggcaaugaagcaggggcgacaaggcaggacuacaaccaagggaagccauuaucacccccaggaaugcagagguaagauuaggcaggacuacauacguagggagcuguggccuugguuggagaagcacagcaucucucaccugcagcccaucagggaaaagagcagggaaagccgugaauaaauuccccaaacucucuccucucacccuccaauccucuaucaaugguucccauuggcuggacccaguuagaagcuggaggguguggcagcuugggugaugcaguguauagagcucagucucccaggucagagccgcacgugggaggagacuggauuggagaggcagauagagaauguccugcacacuuggacuagggcagacaugaggagauaaguaggaaguucaagagcugucaucaaguucagaccaaaggggaaacugggggaccguccuguggagggcaggucuaugcaaaccuucccgcaaaguucgaggaagcagagaggccagagaaagaagcugacaaauuuaguuucuuagaaagaaacauuuaauugagacuugcgaacagaaaccaugaugucuagggcagcugcaagacaagauggugaaagccagcgccauuacccgccagaaccagggcuuauauaccauaggaaaggaauguguaggacagucguagggaaagguaagaauacuaugugaaucucuuucagggcagcacucauaguaaguacaugcucuuacacaaagaacuguagagagaauagaaaucuuagaggcauuccuggaauugggguuaaucaguagucaacguggcagauuagcaucugaaauggaguugcuuuggccuucacagagacauuauagagaaggccaagaguuuggauccagacacgaugguucacauucuaucugcccacuuagaaguuacaucacuuaggacaaaucacauaagcucucggggccugguuagcucaccugugauguggggaugcuaauaugucacucauagggcuauugugagcauuggacaagcuagagacaauggaaguaaugugugcauggcaggcgugcuguugaaccacagcauuaguuuacuauuaucugaacuaaaaagaaucacagaaauuaucuaggcuauccccucauuuugcaggugaggaaacugaggcuuagagaguuuaagugauucggcugggcaugguggcucauaccuguaaucccagcacuuugggaggccgaggcgggcggaucaccugaggucaggaguuuaagaccagccuggccaacacagugaaacccugucucuacuaaaaaaauacaaacguuagccgggcaugguggugagcgccuauaaucccagcuacucgggaggcugaggcaggagaaucucuugaaccaggagguggagguuguagugagccgagaucgugccacugcacucuagccugggcgauagagugagacucagucucaaaaaaaaaaaaaaaaaaaaaaaaaguuuaagugaugcacacaaggugacccuucauaagugacaaggacaggauuagaacccagguccugucucagccucauucaccuuccguaucauuacgcugucagugaaugacaugggaauucagucaggccaugacucaguccaucuucacaaccaaggcuacgucccaguguugguuggggcaggggcggcuuuuauuccaucuuuaauuugaaaaagggccauuuccuacccucucaaaggacuugagaaggacuggacaaaagaccaggccaguggucacaaugccugucugaguccguuuugcauuuuuuuuuuuuuuuuuuuuuuuuuugagacggagucuugcucuuucacccaggccggagugcaguggcgcuaucucggcucacugcaagcuccgccucccggguucacgccauucuccugccucagccucccgaguagcugggacuacaggcgccugccaccacgccuggcuaauuuuuuguauuuuuaguagagacgggguuucaccguguuagccaggauggucucgaucuccugaccucgugauccaccagccucggccucccaaagugcugggauuacaggugugagccaccgcgcccggcccauuuugcauuguuauaaaggaauaucugaggcuagguaauuuauacagaaaaaugguuggcugggcgcaguggcucaugccuguaaucccagcacuuugggagguugaggcggguggaucacuugaagccaagaguucaagaccagccaggccaacacagcaaaacgcugucucuacugaaaauacaaauuaguuggguaugguggugccugucuguaaucucagcuauucaggaggcugaggcaggagaauugcuugaaucugggaggcagagguugcagugagccaagaucgcgccacugcacugcagccugggcgacagagcgagacucugucucaaaaaaaaaaaaaaaaagaaaagaaaaagaaaagaaagaagaaaagagauuuauuuggcucaugauucuuaugguuggaaaauccaagacuggacaucuguaucugauaagggccucaggcugcuuccacuuacagugaaagaugaaggggaccuggugugugcagagaagggugggaggugccaggcucuuuuuuuuuuuuuuuuuuuuuggagauggaguguuacucugucacccagguuggagugcaguggugugaucuuggcucacugcaaccuccaucucccugguucaaaugauucuccugccucagacucccgaguagcugggacuacaggcacccaccaccacaucccacuaauuuuuguauuuuuaguagagacaggguuucaccauguuggccaggcuggucucaaacuccuaaccucacaugaucugcccgccugggccucucaaagugcugggauuacagacgugagccacugcucccggccaucuuuuuagcaaccagcuccgguggugacuaauagagcaagaacucgcucccgagggaggcauucauccagucaugaggaauccaaccccaugacccaaacaccucccaugaagccccgccuccaacauuggggaucauauuucaacaugagguuucaggggacaaacauccagaugauagcaaugccucggggagcuuccucacucuguccucugucugccuuucagcugugagaggaacugcaggccaguuaaugccagcaaagacauucugcucagggucaccaugggggaggacucuccaguggcuauguucagcugguauuuggacaacaccccaacagagcaggugagcacagugacaaccacucaagaauggaaaucucccuugcgcuuucagcacacccgugucgcaugcccgguacugggccaggguugggucaauuccauucagagccuguggugugggacucaggguauugggcuggggagaaaaucagggaauugacagcagggcaaaugggcacaaaggagcauaagcucuggagaaacuuugcagcgggugcucuuggcaucucagcaaaaguccugcuucccaggcggacgauccuaacuccagcuuuuguggccugaccauuggccaacgacugauggguggagggucuaauagcccagcuucucuguccccagguagggugauuucaguugugcaacuuacacuucagggcucuccgugugaccaggcagaggcuggaugccuccaguaacuguuuuuugccuuguuuuguucucugcuguuucccucucugcacugcuuuucccugugaauccuccuuccaucaauaaccugcacacaaggcuggauaugguggcucaagccuuuaaucccaacacuuugggaggccgaggcaggcagaucaccugaggucagggguuugagaccagccuggccaacauggugaaaccccgucucuacuaaaaauacgaaaacauuagcgggguauggugaugcgugccuauaauucuaucuacuugggaggccgaggcaggagaaugacuugaaccugggaggcagagguugcagugcacagagaucauacacugcacucuagccugggcagcagagugagacuccgucucaaaaauauuuucuuuuuaauuuuuuuuuuuuuuugagacagagucucacucugucacccaggcuggaguacaaugacacaaucucagcucacugcaaccucugccuccuggguucaagcaauucuccugccucagccucccaaguagccaggauuacaggcacauaacaccaugcccggcugauuuucguauuuuuaguagagacagaguuuccccauguuggccaggcuggucuugaacuccugagcucagaugauccacccaccucagccucccaaagugcugggauuagaggugugagccacugugccuggcucaaaaauaaacaaauaaauaaccugcacacaaauccccaucucaggcucugcuuccggggagcccaaucuaagacagacaccgcagugaggcuggaaaguguauauuccaggugacuucuuggggagcuggggcugccuguccuccguucaucaguaauaaaucugaaaggcugucuagcacccagaagccacuguccugcugcaguccuguggccuggcuguagcgucagcagcccugggccauccugucuuucaggcugagccccuccuggaugccugcagacucagaggauuuuggccaagguccuuaacccuccuccagagcaacaccuccacguugcuguugaacagcucguuucugcagucccggggagaggucauccgaaucagagccacaggugcgaaaccucccuuuuaucuccucucagggaacccagauaaacccagaaacacucagauauugggugucaguuuauuuuucuuuuaaauauugaaauagagagaugugaucucacuauguugcccagucugguccugaacuccuggagccaaacgauccuccugucccagccuccugaagugcugggauggcagcugugagucaccauacccagccagggcaucagcuuagugcagaggccacagcgcaggcucugguguaaaucgcaccacuuccgcuuucuacgugggagacucuaggcagaggauuucgccucucuaugccucaguuuccugacauauaaacugggauaaucgaaaugccugccucagaaugguuauuuugcaggaugaaugagauaaccccaguguuacaagcaggucauucuggggucgugcaaccuguacacccugccaggauuguucagggcuucucguuuaaaacaagcccugugugagaaacauagauucucaaacacacaaacaauggaggugaugauucuuuuuaggaaggauugcuuugcuuccauuuuucccgaaguggcccacagaccaugcacaucaggauaaacaaggaauuaguuaaacaugcacacucuuggguccaccccaaacuuuccgaauugggucuaggccaaggaaugaguuuuuauggguucaaauucucuuuaugcccagcucuuccaggcaugcgcucucugaaaauguagguggcuacuccaggugaugugggaugugacugcagguccacucguggcucuuaacagugaucucggcgccugggaagagugugggcuucggggugggcucagccuguuuccggauccugguucuggucuuuccuggcucugugaucuugagcauuuucccagcauacucccaccucacaagaucuuugugcggaagcuauuaucaucagccucauucuacagaugaggaacugacucucaaaaaggucaaguucucagcccggguccaguggcuuaugccuguaaucccagcacuuugggaggcugaggcgggaggaucccuugaggccaggaguucaagaccagcccuggcaacagagcgagacccugucucuacaaaaauuagaaaauuagccagccguaaugguguacuccugugguucuagcugacucgagaggccaaggcaguggaaucacuuaaguguaggaguucaaggcuauaguaaguuaugauugcaccacuggacucuagccuaggugacagugcaagacccuaucucuaaaaagaaaaaaaauuaggaaaacaaaauuggaaaagaaaaggucaagucugaggucacucgguuaacaaauggcagaacuaaaauucaagcucaggucugucuaauuaucuuccccuaucucugcccaguuucucaaagugaggcccugggaucccuugcaucagggggaguuguuuugggguuucauuguuuaauuguuagauauguacauuucugggcucuucccagauccagagaugucugaaguucuggguuugaaguagagcccaagaaucuuuguguuuaaugagcucagggggcaaucuaacagcaggauggaguuugugggccccacguggcccccugaacaugaucucucuuuacucccagcacugaccaggcaugccuauggggaggacaccuaugugaucagcacugugccuccccgugaggugccugccugcacuauugccccagaggagggcaccguucugacgagcuuugccaucuucugcaacgccuccacagcccugggaccccuggaguucugcuucugucuggaaucagguaccggcugaagacucugcucuucccucagcuccugggcucaucuucuugcagaacaggggccuguucucucugggagcugcaaagaauauguuccgugugcgagagagguugguaggaugagggcuccccuaaaccucaaccccuagccucaagacacugacucagccaucaguccacagagacaugagaagaaggucucaucaauagcucuuccacaacuggaagccaaaauccauugcccuggcgugggggacagugauggagugaaaugaacgaggauacccaaaaguaugaccauguggggccaccaccaagacaccaucccccaaccccugcucaccacacacacacacacacacacacacacacacacacacacacacacacacacacacacacacacacacuuguaguagcugggacucccagaagccuggagcuauucaggaagacagagaugggucugguuaacagaaucuucaacaauuucauugacgcugcuuugcaagcagccccagggaaugggugauaauugcaggacuagcugaacugaaagaacauuuuugcaaagguguacaggugacaaacauggaagaccccauccacaaugcauaaaacccuacacagucucccugcuuucacccuaaccacucacaccccaggacagccacagggcauuagcaggagagaugagggagccacucacauugcauuuauucuuccauuuggagagugauugguccuuggagggcucaucugagcccugaucuccacccacugggcuuuggcuucuucuuuuuuuuuuuuuuuuuuugagacagaguuuugccuuguugccaaggcuggagugugguggcacgaucucggcccacugcaaccucagccucccggguucaagcgauucucuugccucagcuucccgaguagcugagauuacaggugcccgccaccacacccggcuaauuuuuguauuuuuaguagagaugggguuucacuauguuagcccggcuagucucaaacuccugaccucaggugaucugccugccucggccucccaaagugcugggauuacagauguaagccacacgcccgggagagcuuugucauucugugcucugaaaaugcucuaaucagauuguaaauuuccaccaaagucagccaccaguaguguugccaggauggucccccaaauccagcaucaaacaucacaacggcauaaacacuacaccuugauuagggaaagugcacgucagcuauuguaauaccuaagagaguguaguuuucacgagcgcccugucuaauagauguggaaaugcaucaccguuaagagggcugugaauggggcugagucugaaaggaaaaaguucaagcaagguaaguggauguuauuucaaacugcgucccgccagagggaaaggccaggacagcugcccuaauuccaauaggcuauuccucuuuaguaccucucccccaucauccaagugagcacggaggcaggaaaguguggcuacauaaaaacgagucccaggcugggcgugguggcucaugucagucaucccaggaacuuugggaggcuaagguggguggaucaccugaggucaggaguucgagaccuaauuuuuacuuuuuuuuguagaaacaacgucuuccuaauuugcccaggcuggucuugaacuccucgccccugagcuaaguuuuaaguugucauuguugcuccuccuccuccuccuccuucuuuuucuuccucuuauaauuugguuuaccaccuugacuuuuuuuaaaaaaaaaacuguaaaugggauguuuuuccugcaauuuuuuauggauuuuaguaaaauuuuuccaaaguuacagcaaccugcaguugcuuagagaagacagugaaucagcauacgugacugucucauacuugaaaguguggaaucccgagagccuaccaugccuucaagagcuguggcuuuugugucccugucaccagccucuaccugaguggguugcagucuaccuggggcuuagcgaugcccccucaucggucaauuucugguuuugccagguuccugccuacacuguggcccugaaccugcccucccaucaguguaucugccacuuggagaggagaacaaugacuuugugcugacaguaguuauuucugccaccaaucgugcaggggacacgcagcagacccaggccauggcuaagguaggugguggcaguggucacuguuucuuuacugagaaaaauucuccacccauaugaaccucacuaaaaggauggccggauggaagauagccaggggcauagccagauaagucagugauucauccauuccuuccacaaauauuuacagagcaucuacccugggccacguccuggggguauagccagggacacaacagacauggucucuaccuuuguagauguuaugauuuaguggccagaauagggggaggguccugggagcuggugggugggugagggggguuggagaaugacucuggcaugaguuaggccagcaccuucagagagcucagaagaaguaggaccaagauuagccaacaaggacucaaggaagagccuggauaagauuccaagaagauuucaagcgucagaggccagguggggguggaagagguugagaccaagagaggagggcggccagugguagagcaaugacuugcgccaggcuggagccaaccaaggcuugguuuggguggcugucagcugccuggugcgagcaggucugggugcccuccagccucaggaagugcucgagagcccacaggccaggccaaaggcauccaagccucucugaccccacaugaagaccccugacuucagaggccagcuucuuccuagcagguucugagcauauuucugauuuccuaacagguggcacucggagacacauguguugaggauguagcauuccaggcugccgugucagagaaaauccccacagcucugcaaggcgaggguggccccgagcagcuccuccagcuggccaaggcuguguccuccaugcugaaccaagagcaugaaagccagggcucaggacagucacugagcauagacgucagacagaagguacccgugggaagcuggggggcuccuuucauucccuuccucuggggccccagggucugcgugcggccauuugggcuguggaucaagguucauggaucaggggagaaaccuguggugucucccaagcggcugacaccaccucccucucuggucuuuugggugagugacauaaagugaagaaaaugccuucuuccuugguaaccugcuuucucggcuggcccucauggaggcacaggccucugggauggggggaguuuagaacacaucauccccugcuuuucauguuucagaugacaaggcagagccccagagcagaaaggggacuguccucggucacauggguagcgguuuggaguuggaccacagauggcgucccggcuuugucacuuaccauucgcauugucacaggccagggaccaaaccucucuaagucucaguuuccccauauagaagaauacuagucuccucauacaauuguaguaagaguuaaauaagaauuacgaucacugcaacuaaaaaacuagauaagaccgucaacauucaaucaguuuuaaucuacaaaaauggccguuccauuguuacaaccuaguaugauaaacuauugcagaacguaugauuguguccacucccagcaugugccacaugaguuuguguucgugugugugcaugcacacacccacacacacaccccugugggcacggagaagagaagaaagacuucucuuggcucccugaaagguuugcaggaagguacugaguguggugcuagaggccugguagguacuuaauacaggaagccggauugucauuguggucgcuuaccgagagaaacuaacauguaucaagcaccugcuaugagcugccaggcccugaauuagggcuucauggaucuguaauccccacuacaacccugggacguaaauggugaggccuccaucuauguuacagcugaggaaacagaggguaagagaaucagaggugccugccugugucccugugucugguaaguggugaagccuggguucaaacccaguuuagagguucccccuccaccuccagcccucuuaccccagacccccugccacauacauacacauuagcucucacacaucauacauacacacuuucacacacacucuuaugcacacacacacacucaaacauguucacacacacacacucacaaacacauucacauacucccacacacauacucacacacuuauacgcauauacauacaugcucacacacucacucauaugacucauacucacacacauacacacacugacagaugcucacacacacacacucauauacacacauacacaugcacacacaaacucacacacaugcucacacacauacacugacacgcugucacacacacacauacucccacacacaauuaugcuuucacacauacacauacauacacacucacacacuuucacacacacacagcucucauucuuggucacauucacucugagaaguaccaaugggaagcuuccccuggacauccugugguccccaagcacacagaccacacagccuaacccaaggucuccccaugaaaugcccggggccuggcacaagacagaugucaaacucucacugggaagcugagaagauguuaacaagggcucuguugagacaggugugugcagggcuuagggaacaaacuagacagcguggaggaccccagaggcccggccugccgugagcaggauccagggggcggcugcccacagagggacucucugguaggagcuguggcuuuugaagaaugaggcggccagcccccggugaccuggccgagggcaucaggagaaugaccccucccagcucucucuccuccugccaucucguccccugcugggcuccugcugggugaguccauuugccggaggguccagagccggugacaucuuuacccaggguaggugacaaacgauggggucagggccugcagaagcaaaugugagauuacccauuaucugaguuucccuucuggaauauucugcaaagagucuccugccacacugaccuauucuuuccucaacccaagacacagccgggauggaggccuggcugucccuggaauggauggcagaugcacucauacuuggaagcuucgggaaagccugucaggcugagccaggugugagcaacaggccacggugucucugccccaucaaaaguggcugcugcuuaaaucuaagucauuauuaaaauuaaauaaaguuacaaaugacaguucuacugggcagugcugaaaugauguucuuaguuuuucucugcuccuaccaaagccccucaccagccccucauuagugcuuuguaguguagaaagcacuugacccugaagcccguggccuggcccaagacaggaguggagggcuggguagggggguucuuguccccacugcugcaaaggcacacagggaccccaagccuccggugagaccucccauccaugccagaccaacagucauccaguuucugaauuucaugccauucuggucacaggugccacgcugagacacaauuuauuuucaaauagugccaaauucuacagauucaauuugaagauuuggagaaagcuugagacauccuauauauguuugcuagggcugcuguuacaaaugaccacaaagaucauggcuuaacgcaacacgcauuuauucacuuuauaguucuggaggccagaaguuuaaaaugggguccacuaggccaaaaguaaggugauggcagagcugcaaaccuggaggcuccaggagagaagccauuccuugccuuuuccggguucuagaggccgccugcacuccuugacuccuaucuucaaagccagccacgcagcaucuccaaaguccucuccucucccucugucucuccccacccuuaccucauccucuuucccucucuuuuucuucccccuaccccugccuccaucacccaucuccuguucugauuaacguuccuaccucccucuuagaagggucguaugaugacguuggucccaccuguucggauaaucucuccaucucagaauuuuuaacuuaauugcuucuccaaaaugacuuagucaaagugccuuuugccacauucaguaacauauucacagguuucagggaugugaaugugggcaucuugagggggcuguuaucugccuaaucacacaucauacaaggcagacagaggucugcagggcuuuagaaaccaccagugaggccaggugcgguggcucacgccuguaauaccugcacuuuggaaggcugaggcagguggaucacuugaggucagaaguucaagaccagccuggccaacauggcaaaacccugucucuacuaaaaauacaaaaaauuagcuggugaugguggugcgcaccuguaaucccagcuacucaggaggcugaggcccgaacccaggaggcggagguugcaaugagucgagaucaugccaguguacuccagccugggugacagagcgagacucugacucaaaaaaaaaaaaaaaaaagaaagaaaagaaaaagaacccccuaauaacccuggucacuccugacccugcaucuuccugacacuacuucauggagccacagaauuacauuuccucucccugccuuucucccccgugccaaggucagagagcaugugcugggaucacugucugcagucaccaccggcuuggaggacgugcagagggugcaggagcuggccgaggugcugagagaggugaccugccggaguaaggaacucacacccucggcccaggugaguagcucccaucuacagaggcuaacaugggacacgcuccuucacagcaggugggugaucagcauagguugaaggggucccuuggucacagggcuauuuuggggcugccaagaccucugucaucuucuuuccagggguccugcaugggcgauucaugggaaggugccccuccugcugcccauguaucucacgcuaggugagagggccuguuugcccagacucucacuccugcaucugcuggugagcaaguugagggaguaacugaaucucauuaauauuuggguggccaaaugugaguccagacacugcuacugacugcccauguucucaacuucaguacaugccagccugacaucuggcugccagcuccugugcuuccuuauccuucugggggucuucucugacccucagagccuacuguaccugcccauauggcugugaauucaugcaguguucagugacuaaugaagcuggcuuauaaacaccccagcuaccucaccccucuugauggauaaucccaagcaggagugaaucccagguaaugggcuugaucacacuccuguacuggcuuccacccuucccugucucacacccccuacuccccacaaguguuucuugggaucauguccaaauaaaugacuugcucucaa

SEQ ID NO: 191973 - RNA, 179001 nt, Homo sapiens
aguagcgagcgccggcggcggagggcgugagcggcgcugagugacccgagucgggacgcgggcugcgcgcgcgggaccccggagcccaaacccggggcaggcgggcagcugugcccgggcggcacggccaggugagcugcccggccgggagcgaggcaggcagggcgcccagggaccugcgccccgcggggaccggcucccagggcgcugcguccgagggggucugcguccuggcucagccggagcgggcagggacggggcgcacccucggggaccccggcccgccgugcccgggguccguuuggugacggcagggauccuggcccagccgcuggccacuuccucaccccgggccggcgccaccucuccgguccgugcgguggggcggccccagcuuugaauggggaccgggaggaaggucaggggucgugugggggcuggcguucaaaacuccucuuuucgagcggcucugcgugggguggcgccgucucucuugacggcccuugugcccagagcucgcggacgcucggagccacacuucccugucucacuucggugguugcggguggcgggugggagcgauaccgcgggaggcgcaguccuucccggagacuuuuggagagcuugcaggacacucgcgaugcccgcuccgcagcugucugcguaauuaugcgugugucugugcguguuguguuuuguuguguuuuggaaucccaaagagggcauuacccgcacagcgcaagaguucagguuaaagacgugccccguuuggacggggagcuccuggauuccagcaggacgguggggcggggcucucuugguacccuaaucuugaacuagggugagaaacuauggggggcggggugguaaaggggugacauggcgcgagggaaacagguggccuugcccgucggaacuuaauuugaauuucaguuccaucagugggacccugggcaaguugaagaaccuuuuugagucuguuucccccucuggauacuggagccacccaauuuuccagggcugugucgagaauuggggcuuauugcuguuccacgagguucgcugagaaucggggcgcauccauggagaguccuugggcaguuccugacucucugguucaagggcauucucuggggcaugggcccucguccuugacuacaguucugcggggaaguuuuacagaauuuugaagucuaugccagccucaagcaguuucucuugcaaaggugugugugcagucacguguauaccagcucagggacaaucgucauugugagccucacugauguuuaagucaccuaaugaugcagcugccuucccccaccagcgacuggaguaugggcaguuccucuggaaguggaaaagcacagaccccaugaauagcccuuuugcacucauuggguagagucaaugaaaagcugcuggugagaaaacuuuugaaaacauuucuuggucaggcacgguggcucacaccuguaaucccagcacuuugggaggccgagcugggcugaucacuugaggucaagcguuccagaccagccucaccaacauggugaaaccccaucucuacuaaaacuacaaaaauuaccugggcguggugguggccgccuguaaucccagcuacccaggaggcugaggcaggagaaucacuugaacccaggagguggagguugcagugaacccagaucaugccacugcacuccagccugggugacaagagagacuccaucucaagacaaacaaacaaacaaacaaacacacacaaacacuucuuaauuuagaaaacagcaagaacacaaagagaaaaauuugcccguuacaucaucaguuaauauaaauaaagucaaguuguauccucuacccucucccagccuccgauaaauaguaaccacucuccuggauuuaccagaagaucaccuuuauaaaaagggaauuguauuauacucauacaguugcaacuauugucugaagcuauuuuuuuauugaccucacaaaucuuuccagaucaaauugcuuaucuaucauccucauucuuucugauggcuacugagcguucuucagugcaugugcaccauuauuuauccaggaggccccccacauugaugagcaguuguuuucuguuuuuuuuucuuuuuuuguauuucuauugcaacuauugcuuccgugauuuucugucguacauauugcaucuuugugcaugucuuucuuuacauguacaauugcaggaucgaagcauaugcguguuuugcuuuuuaguagcugcucacagguugcccuaaaggagcagggguggaauuuacacucucacuugcaguggcugacaccauuccuuugaaaauaguguauucccucuaaugcugcaggguggguguaaggugcagcaguaaugucccuugaacuguuggaggggcccuuaccacucaaguauuugccugugcuccauuuuaacacaauugucuugugggauuuuuggaugaaauccuguacuggcuuaccaugcacagagcacugaagagacaaaaacuuccuugauuucugguuuuggguccucgcaucucauuucauguccuuuccccccccccccccgcccgcccccgagacggagucuugcucugucgcccaggcuggagugcaguggcgcgaucucggcucacugcaagcuccgccucccggguucacgccuuucuccugccucagccucacgaguagcugggauuacaggcaugugccaccacacccggcuaauuguuuuguauuuuuuuuuaguagagacgggguuucaucguguuagccaggauggucuugaucuccugaccucaugauccgcccaccucggccucccaaagugcuggaauuacagucauaagccaccgugccuggcccauuuuaugccuuucuaaauaagcuuaugagauacaagaacaugaaugagcuuaugagauacaagaaaaaccuuuagaaggacaugaaauguaaaaauggcaaaaaucaguuauucaaacucagccauauuuguauuuacaaaauaagucauuuuauagaauuacccauuaagaaugggaaacaggaacaaaaaagggauuucaaggcuuuuuuuuuucuuuuuuugaaaaaaccaaaaaaagcagaagcaaaauggaaguugcugugguggcuggugcucucuccugggcucaaggucuuggagaccucccugccauaguugauaaagcguggaacgcuggagaccugagcugggugcuggcaggauuugaaugguggacuccagggaucuuuuggccgugaagaucuguuuccaauugcaucucauaagcucauucauguucuuguaucucacaagcuuauuuagaagggcauuucgugagauacaagaaccccaaaccagaaaucaaggaaguuuuucucuucagugcucugugcauguuaagccaguacaggauuucauccaaaaucccacaaaacgauucuguuaaaauggggcacaggcaaauacuugagugguaagggccccuccaacaguugaauggacauuacugcugcaccuuacacccacccugcagcaucagaggggauacaguguuuucaaaggaacggugucagccacugcaggugagaguguaaauuccaccccugcuccuuuagggcaaccugugagcagcuauuacaaagcaauuggugagacgcagcauggaagucugguguuuauggcugaguugauccacugggcuucgaagcuggaaguaacugggacccuggggaagguuaaguccaaggcccucccagagugagggcuggaaagaacugaggagccuggucccuuguccugguuucugucuaauugaagguguuauaauggggcuuguguuuccuacuuauguuccaguggacuauggccuagagaccugggaguggggaacuccaggaugcauggcugggaacagucaacauagugaagagcucugugguuggcagcugggucaaauccaguuucagcuacuuuuuuaaaauuuuauuauuauauuauuauuaugcuuuaaguuuuaggguacaugugcacaacgugcagguuuguuacauauauauacacgugccauguuggugugcugcacccauuaacucguuuugcuacuuucuaucugugugaccucggauaagucccuuaaccucuuuugagaguggcaaguacuggcaaaucaguuaauaucuggccagaugcugccacaggauucuggacuaggggcuugggacucaggugaggguuuugaucuuugugcugcugcuggucuacaugacuuugaucaaguaaugugaccucuugggauuucaguuuuccgcugccguauuucccauugagauaaaugagacgaaccagacacaacaggugcuuggcaccuggggaagggcccaauaaauggcugcuuaacaaggaugaaauggaccaugggggcaccuuguucaucccuuuguccuggcuaaugaucaggaggucauuuuggguuucuccugauaagguaagaugcacauuaacucucagcaggguuuuuuuuuagcauacucuguucugccuccuagccuuugcuuaaacuuaaagccaguuccuccugcuucaucuuuuuugaaagauugaguucagaugccugcuuuuuuccccugaaagcuuuuucugagcccuuuaagugccuagccacacuccagauuaaauuuaggauuccuucuugcugcucucugcccgccgugcccccagugcaugcuucugcugcugcacuuguaacuacauuagaauucucaguugauuagucuguuuccccaugggcagagagcagguguaauuaucuccugcugcuggcauggcugaccgaggaggucccuuugguaugggugugcaguagagggaggugggggcaaagggcaaauccugggccccuccccauuccccucauuugcauccuaguccccaccucagugccuggcauagaguugacauuugauuaaugccuuccccaauggcugauuaaugcuaacugagacccugguaaaugcugcaggcugugcauacauuguagcuuuuugucuucccagcugccccuugugggcauuuaaccuccauuuuacagaugagggaaccgagccacagauuuagagcagcuuggcagaaggcugagcccggcuggaagcacagacagcccuggcugaacaccagccucucacuccuccuucuuuggauccugggagggucucucuagugcuacucuguaaccuugagagcuacagaguaacaacuccaggcaccuccagggacuuggagggaaaggaggagauaagaaacagaacaaauaaugguaauuuuaacaauagcuuaaucuaaggagugcugacuuuguaucauuguuuuaagggccugagauacauuaucuuguuuaagccuuacaaaaacauuuagaugguggauacuguuaccuucuuuuaugggacuggaaaugagcccagaggaucuaagugacuucuugcagccuagcuggcaagggggucccuggugguucagcuccagggccuggggagcgccuucacucuaaguccuauuuugggggcaggcaauguguuucuggggauuugggaggcagaaugagggaaugguacagagugagggcucagggagggacuaagggauuuugagcagaggagugacaugauuugauucauguucuaaaaggauccuucuggcucugcaucugagaauugacccuagcaggucagggaagaaguggggagagcaggauuagaauaguucaaguaugagauccuaggaggagccggugaaagggugagaugcguuggaaguggucgugagagaguccacgcaaggauuccuccaagguuuugggcccaagcaccucucugacacugaccacccacaagcauaaacagcaaucaaggacaccuccuaggugcuggccgucaccccaggugcuuugcuggggcauuucugaacacucccauuuuaaaaaggcuaaaacugaggcacagagaggucaagcagucuacccagagcuacacagucagcaggaaccuucucuaggguuugaacgugaagcugccaagaccugacauuuccugccuuucauccucauuucuaugcagaggaaccauuugccaaagucuccauggaugauucugaagguuuaguuuguuuuucguuuauuucauuuuuuuuuuuuuuuuguucuuaauuuugcucaggaauaaagagaugguuagaaaucucuagacaggauagagaaggauguuggagauuaggggugagaggugggagccaggcugggcugcuuuggcuauucaaauauucuuuaggauaagaguggguggggagagaggggacucacugccaggucagggugauuugguuauucaaagcccacguaacgguuggguccuugaggucaggggcucuucucacacuucaguuuccauuuaaaccuuuguguccugccuuagcucucugaguggccagcgaugccuugccacuagaaccuucuccuaaaacucauccugauugacaugagacaggauuuugguuccugaaguucaugcccuguuaacuaaaccccuuucaguacuaaaaucaguucacucuuuaauucugcccuuucagcuuccugauuucucccgauuccuuccuucucccuggagcggccgacaauguccaccacggucaauguagauucccuugcggaauaugagaagagccagaucaagagagcccuggagcuggggacggugaugacuguguucagcuuccgcaaguccacccccgagcggagaaccguccaggugaucauggagacgcggcagguggccuggagcaagaccgcugacaagaucgagggcuucugugaguacucgcuggguggggcaguguggcccguccucuggggcccuggccugagcaccuguccaccuuccugucuugucauuacugugauuguuguugguuugauguguucuuuuauucgucuuaaaaugaaagcauugccaguuuguguggaucucugaugagguuuacaccagguggaggaaguucagcugggaaaacucuggugaaagaacugaagcugaggucagccaacauggaaauggcauucaggcagcucuccuugccuggugguucugugcccugucugacagcaucagggaucgucugguucccacaacuggucgagucaucuuuccucuuaagggcgaauuagcccaagccugcagaaacucauagcuuggucgccaaaugcuaccuuguuuuacugcauaccauagcagugaggggccuuugcuuuagucuccaagcagggagagugaguuguugaacguuuuguagcuuucaaaugcaggucuggucuugguagaggugucccuccuccccuaccuccguuugauugggcagcugguucagauccuaaaguuucuaagacuguuuuuaacaaauagaguaaaggcacuuaagcaauuuucaguugcaaauauuugcucuaauuuguguuuuuaaauuaacuaguuuuuaauugaaauauauauuccuggggguuaaggagucaacucaaauauuucuccucccuaaaccauccuacugaggcaagcucauuaccaguuacuuuuaucuuccaaaauagucuaugcuugcauaauguguggguuuaaaaagaaaacaauugggaacucuuguacacuucugcaccuugacuucuuuuuguuaauuaauaaugauguuggcggugguuucuuaucagcacacauugaucucauucuuucuuggacacaugacauguaauggcacaggccucaauguaacaguuuaacuccagagaagggcauuucaugcuauuuccaggcuuuuguuauuauucgaagugacuaucauuguacucuuuuuuuuuuaaaacaaaauuaauuuuuuugagacaaggucucuuucuuuuacccaggcuggagugcaauggcaugaucauggcucacugcagccucagcccccugggcucaagugaucuuccugccucagucucccaaguagcugggaccaugggaaugcaccgccaugccuggauaauuuaauuuuuuuuuuuuuuuuuuguagagaugggaucucacuauguccaggcuugucuccaauuccugugcucaagugauccucccuccuuggccucccaaagcauugggauuacaggcaugagccaccucacccagccuugcacucuuuuuuuuuuuuuuuauaauagauugauugagacauaauucacauaguauacauagaauucacccauuguaugcagcauguauaguguggugguuuuaguauauuuauauaaaugugcaagcaccacuccaaucaaaaguagaaccuuuauaucaccucaagaugaaaccccauaccuuucaccaucaccccauccccucauccccccuaccagacguaagcaaccguuaaauuuaauucuguuucuauaaaccucucuauucuggacauuucauagaaauggauccuauguaugugggcuuuugugacuggcuucuuugacucagcauuuuucaagguucauccacuuuguugcguggaucagaaauuuuccuuuuuguggcagaaucacgauacguuguauggguauuccacaguuuauucagucaucuguugacggacccuuggguuguugccaccuuuuggcuaauauaaauagugcugcuaagaauguuucucuacaaguuuuuguguggaugucuguuuuuauuuguuuuggguauauaccuaggaguggaauugcugggucauacacuaacucaguuucaucauuuuaggaacugucagacuguuuucuaaaguggcugcaccauuuauauuccuuccagugguagaaaagggugaucguugcauuauucuucauuuguauauauggguauaucugaaggacagcuuccugaagguuuauuucugagcugaaggauauggcauauauauauuuuaauagacagagucucgcucuguugcccaggcuggagugcaguaguacaaugucagcucacugcaagcuccgccucccggauucaugccauucuccugccucagccucccgaguagcugggacuacaggcgcccgccaccacgcccggcuaauuuuuuguauuuuuaguagagacggggucucacuguguuaggcaggauggggguauggcauauuuuaacuuuaaagggaaguuuggcagcaccccacaaaagagguugcccccacugucuguuucagccacaggauguaaaaguaccuguugccugaacccucaucuaugcugcguggcugcugaacuuggccauccacagguagacuuugguagcuuggugucauccuuaauuugauguauccuaucaugagugugaucaaacugcuuucugaaaggcuuuuccugguuuuggagcccagugggucucuuguggcacagagccagagcccugcuuuggaacugcccauguggagguggccaucuucccucuugacuguuugcauuggccggcuccacccccagguggcccagaaaccuguugcagcugggguggccacccucccuucccccacaaggggugagaggguuggcacugaugguaaauacagaugggccacguugagacuggacugcagguuguuccuuucucuucucaaccugcccaucccaaaccuagcugcccaucagaaacacccaggggggaucuuguaaguauaggguauuaaccauggcauguguauacaccuguguaacaaaccugcaugcucuucacauguaucccggaacuuaaaguaaaauaaaauaaaauaaauauauacaaaaaagaaauuacaggguauuagaaccuucuucugaagcucauugugaugggcaugagacaggauuuuggcuugaaaucuaugcccugucauucuccccuucugcugaguaauaccauuucacucgcuuacgcggaugcgcucucucgcucucuguuuuagagacagggucuugcucuguugcccaggcuagagagcaauggccugaucaugguucacuauaguugugaacuccugggcucaagugauccuccugcccagucucccaaguagcugagacuacaggugagugccaccaugccuggcugauuuuuuaacuuuuguguagauagggucuugcuauguugccgaggcuggucuccaacuccuggccucaagugauccucccaccuuggucuccgaaagugcugggauuacagacaggaacuaccaugcccggccucaauucauucuuuuauuuaucuguucagccucuuuauuuccuucuucuuucucccuggagagaccaagaaugaugauauuucaccacuuuggcuggggcguauuauuauaauaagucccccggauggucugguaacuaggcagguuucacacauaugccacuggagagacacugcccuuccuccaccuucccccuccucucccuccucuucucccucccacuuucccuuucuuucuccuucccuucccaccuuugcccccccuccauugccuccccucugucauuuggaugcccacuguaggcgccgcccuaggcgcuagagauacagcaguuauuaaauuggauucaaaucuccguggagccuauauugcuuuauuagguaugagcagucuggggcuugacuuccagugcccuuggaugagcuuugcugugugaucuugggcaaguuaccuccacucucugaacuuuaauucccuuaucuguggacuggaaauaacauuggugucuaccccacaggcucaugguugggaagaagcaaaugagaagaugcauuggagaggcucggcugaauucauagugugugacaggcacucaguuguugggaaccaccacuuucaggauguuugcuguuguugcuaacuaguggaguccagccuauguagucuuccuuagggguuuggacuggaggggaguaggguccauucucagguuuucagaagagggaugacgugauuggauuugcaucuuugagcaugcaguggagguccuguuugcaaugaugguguugguaaagugacagggaaagccaauuaugugugaagagcuuagaaauggugcuucucccucacaccuugagagagcaggccuucaggcccuggguggggacugucagugucaccgcucagucuccugcugagaagggugacguuuuaucucaagaagaacucccagcucuggcaauuuccucacgggguucugguuagcaggaacuugcugguuacuguggggucugcaggggcaggugcacaugagaggagcaccggcaccugguuuuggaauaguuggcaaauggugugugacuuuuggacagguguuacaaucccugugcagaccuggguaaaauaccuagguccuacugucuaaagcagcgugugguucucaaccagggugauuuuugccucucccucccuacuccaggguagggggcauuuggcaaagucuggagacguguugauuuucucaccugggauacagggugcuacuggcaucuaguguguagaggccagagaggcuguuaaauguucuguagugcacaggacaguccgcaccacagagagugauccagcaaacgugucaguggugcagggguugagaaacugcucuagagucauguguuugcuuugcucacagcaauaaaaugucacuggguaaaauaggguuuugcucugaacccuguuuggauggaauuuucucauuuguucagcacauguuugccaucauauugagugcuaaacucugcagagagagggaggaggaggauggagucccagcuugcaagagggggagacagacucaaacuugcccuugcaagauugugugcuuaguaccauagcaggaguuuucacuggauguggugugaggagggaagguuuuuguccauuuggaugugggggagguggugaggaauggggagggcucauuguggaggagcugcuuggguggaguuuagagagauuugcuagaugguuagcagggauggcugcccugauccugugggauuaaugggugucauguaauauaaacaagcagauuugugggucauagaucugggcagagcucagcugggcaauucuucuacucuuuguagccuggacugaggucauuuggugucaccucgccuggaagguuccagaaucuucacucacacaucugauaccuuaguggugauggcuggaagacugagcuuagcugggauuauuuuuuguuuguuuguuuuucagacggaaucucugucacccaggcuggagugcaauggugcagccucggcucacugcaaccuuugccuccuggguucaagcuauucucccaccucagccccccgaguagcugggauuacagguggguaccaucacaugcagcuaauuuuuguauuuuuaguagagaugggcuuucaccauguuggccaggcuggucuugagcuccugaccucucgugaucugcccacccuggccucccaaagugcugggauuacaggcaugaaccacugcacccagccuuagcugggacuguugaccaaacaucuaccaugugguggucucaggcagaagagucccaggcagaagcuacaggcuucuuacgacagccucauaaauccgaggacaucacuugcaccaacucagaucagcaagcccagcucagcuucaaggaaaggaaauuucucucuuagagaaggaauggcaugcauaucgaugguaggcaggaacugaugguggccaccagcagccaagcucccacaugagcaugucgacucugaaucccaauuuaugaugcaaaucccugcucugccacuguauuaguccauucuuauggugcuaauaaagacauacuccagccugggcacaguggcucacaccuguaaucccaggacuuugggaggccaaggcaaauggaccaccuggggucaggaguucgagaccagccuagccaacauggcgaagccccaucucuacuaaaaauauuaaaauuggcuggguguaguggcacaugccuguagucccagcuacuugggaggcugaggcacagaauugcuugaaugugcaaggcggaggcugcagugagccgagaucacuccacugcacuccagccugggugacagagcaaggcucugucucaaaaaaaaaaaaaaaaaaaaaaaaaaaaaaagacaaaacaaaacaaaaacaagcaaacaaaacccaagacugaguaauuuauaaaggaaagagguuuaauugacucacacacaauauggcuggggaggccucaggaaacuuacaaucaugguggaaggagaagccuucuucacaugguggcagcaaggagaaggagagcugagugaagggggaagccucuuguaaaacuaucagcccucaugagaauuuacucacuaucacgagaacagcauggagguaaccggcccuaugauucaauuaccucccacugggucccuccuaugacacaugaggauuaugggaacgacaauuuaagaugagauuuggguggggagagagccagaccauaucagccacuuacuagaagugugacuggaagcuaauucuuuuguuauauuucugugccucaguuuccauaucugucaagugagauaauaguaguuucuaucuuauugggugagaauuaaauggauuuuauuuuauguucuuuuuaagaugugggaaauauugcauaaucgaaacuuaauacaauaagaccagaaagaaaaaaggcccccuggugaggacccccaaggccuggccucuggcagagaagacugagucugaagcacaacaccucacuuccuggccuccagguucccuauugcuuuccagggguguuggauaagauggugcugggauuccuuccauccccagccuucugcauagaguuaaggagcugguugucugugaaugucgggagggagcuugugguacuguugggcauguugguuuucuuuccuuucugagggaccuaguugagcagucuucaggugggaaggggucugcucuggggccuuucugaguugagccuuagguguccucuugcaucuugugcauuugaaaggcuuggauuuugucucaggagccgauguggugccaccuguuugugggucuggaauuuuagggucggcuguggugaugggcccuuuugagggccuggaugcguccaucucaacuguguaggcuuuuuauccugacauuuucacuuuugcuuaggcauaucuucucugucugcuuauuuguggcaagugguggcugcccaugagugacggauucucaaacauaugagcugucuguuuccuugguauuagguucuugggguucccacuuaauaaugauaauagugauaccguugaugagagccucuucuaaugaaugcucacuguguccuagucucugugaaggcacaucaaagauaacuccuuaauccccgcagugguccagugaagggggagcuaucccugcuuuauucauaaagagauugagucuuggggagaugagaugacaugcccaaguuaaggaaagggcagagcuacaauuugaacuuguucuucccaguuucagucucaagucuucuuccugcucuguguuguuuucuucuccuaaaugaucucaaagacguaucagaucugugugucauaaacacccugccugagaccaaagaauggcagcuucauuuagaguuucuuugugacagcaggacagaaacacaugaauuccuuacgugugcagaggacuugcucugccaggugcuggagguaccaagagaaaggagacucagugcucauccuagaggcgccggauuuguggggagaugcuaggaaaagaccacaaacacagccuggaaaagggcuguuggggacaagggugccgaagugagaguuuacuguauuuuggcucauccugaaauccacucuuggacuucuuuucauggaaaaaaugaauauuuuugaaaguuauuauuuuaucaaaauguuuuugaaauaaaugugaaauuacuauuaauaauaauaauaaaugaauuauuuucucgcuggcaucuccuaagaagaaauccauugucugagggugguccccaagccccugcaaugaagcgucucaucagaaauaagacgcaaccaaugccugaaguguccauaaauguauuugccuuucaguuacugguaugcggugaugguauaaagaagggcugucaaauccugguccugcacuugguaggggugugaccuugggucucucaugucaccucuuugggccuccauuuccuuaucuauaaaaugagaauaguugaagaacacaccccauaagacucuugugauaaguaaaugacgugauauauguaaaauccuucaauaguaucuggcacagaggaugugcuuaaguauuuuuugcucuugcugucguugaugucaucauuaucaucauccagcauaaaggcaagauggcauuguagaaaggaugggauaaauacuacauuuuccauuuauaugaggauuuuccuuccugcacccgauggauuguccugcucccccuggaguauguguccuccacuuuggagcaugccagugugaaaaguagaguugacauuuuuauucuugauggugcuauagcccuucucuuaugcugaauagcugaggaauugcuugucuuguuuucaagaguugucuucuauccuggaugacaaccuuagaauguucuuagaauuuguuccuuuguugauuuagcaaauacucaaagaggaccugauguguguugggcaaugugcuugucacuggggauaaaguagugaacaggacccugaagaucucuagaggaucuuacaaucuuguaggaaaagcagaaaaagucagacuaacacauucaaucauguuggaucgugauagacgcuaggaaggaaaggaacaggguacuguaauaaggagucauuagucaggagcacuagccuagcuggggaaggccucaggguggccucucuguagaggugauguuugagcugagacuugaagggugagaaggagggagccaugggaagcucuguggggagagcauucuggcauagggcauagcaacaaagcuuuccuauuagugaagguagccuaauugcaguaacaaguuauuucuuccuguaaguuuaucucucacucacucaaaucaugauccagugggauugggggugggacucugcugucugaucacaaugggacucugugcuaucaucuccaaagguguuggaggcuaccgcaggauccuuugugugaccacugcauggaggaagaggaagagcagaggauggcucaggagguuggagguuucuaugggccauaccugaaguggauguaccuguuuccucccaccugcuuuuuuuuuuucuccccaagagauggggucuugcuuauugcccaggcuggaguacaguggugugaucacagcucacugcagccuugaacuccucggaucaagugauccuccugcuuuggccucccaaagagcugggaucacaggcaugggccacugugcccggcccccucccaccuucuauugaacagaauuuggcaugugaccaagugcaagggaugcugggaaacaugcccuagccgcaugcuagaagaacagggccuaaguuggggggcauccuuccaggcuuuucuguaaccccuaauuuuggaggguacagaggcagcucuaggugccccagugaaggcugauaagcagguugaugguaaggguuugggagucuuguaggaauccaggagaaugaacagucucaucgcugggcugcauggaaagggaaguggugagccacuggcacugaggacuuuccugucuguaacuagagcugcugauggugaugucucuuagacagccucaucugcccucuuggguuucucucacagauguggcccuccccuccccagcacagacugucuccaaaccuuggcuuuuucuguugcugccacaucagugacagcuuugguuuugcaaccucccaaggauggaccccugagagagaggccuccuaugggccaugccuuuuaaagccagcacacaugagcaggcugcuuuggagaucaguauccuuuggcacggccagccuuuccugggcauagggguggauuggagguggucuccuguaagaggacaucgucuggcucccgggcugugggcaguggugggugccuguuacggauugaauuguccuuaccaauuucauaugucaagguccuaauccccauacucagaaugugaucuuauuuggaaagagggucuuugcagauguaauuaguugagaugaaaucauaauggaauagagugggcccuaauccaauaugacugguuuccuuaugagaagaggagagagagacacagggagagaaggccaugugaagacagauacagaaaucugagucaugcaucugcaagcuaaggaacaccaggggugcucccucaggaggaaccagccucgccaacacuuugauuuuggacuucuggucuccagaacugugagacaaacuucuguuguuucggccauccaauuuuugguauuucaugaguggcaggccuaacacacaaauacacucucauguaacaggggccugagggcaacggggugaguacagggauugaccuacccauucagccacugauacuauggauggguugugguuugucauaacggaauuuaagaggcguugcuuucuuccacgugucauguuauuuucuagcugcguugguucuggccugggcccugaggguguaagagggaauacaguguaguggguaaacgagggaggcagcauuugucccucaaaauagcaccaaguucugggaaugcagguauauuuggaguuccugacaagucagugcagguccaacgucuuagggauugugcugaguugggggagggaucuaguuaaagaugucccuuggugaaucauuuuugaaaaaaaaaaaauuaucuccacuaccuguccccuagucugucuuagauauaaaugcggguuuuuguauaucaggcucgcaaaauuaugugucuugauuugucuugggagagauuuaggugcugugcaguuugggguugaaaucagaaauccugggguugacuuuuccugcuuucaugcaaggcccgaucuuggggccaggccuucgguaguccugacccacagacuaagagugcugggaggccagggacccugucuguucuguucauaagggggacuucccagcaccuggcccauaucuggccuguggcuggugcuccucagauaccugguuaacagaugaaucaggaaaaggcccuggcugccccuuucagccucggacuuccgguuucuuccuaaccauggcagcaguaucugggguugagauagggcaccucugugacaacuuccucuuuaaccauacaccgugguuccacucgugguccuggcacuuagugacugugugaccuuaggcaaucuacuuggccucuuugagucucaguuuucuuuuuucuugucuuuuuuuuuuuugagauggagucucacucuguccccaggcugaagugcagcggcacaauuucaguucacugcaaccucugccucccggguucaagcaauuauucugccucagccuccugaguagcugggauuacagguacccuccaccucaccuggcuaauuuuuguauuuuuaguagagaugggguuccaccauguugaccaggcuggccuugaacuucugaccucaagugaucugccugcauuggccucccaaaguguugggauuacaggugugagucaccgcgccuggccugagucucaguuuucuuaucuauaagaugggguaauaguggagcuuaccccaucagaucacugggaggauucaguuuguaagugauugucacaaguccaguauguacuuaacacagggugccucccagccaugcugccauaugucuccucaggcagcaggugccugcauuuguguuugcgugggggacaugggacaggcugagacauagcucgcauguguaggggguguccuccuccugcucuucuguagcacacagcuagggguccucugggguuaagugcucuuggaccugagccuggauauaaaagcagcccagugcuucugggaggcuggggaggccugggcuuggagaaggagcgucgacagggugaaggugaaguucuggaaauagaaacagugaugauaccacaucacagccugggggccacuccacugucacagggcuguugggaagaagcuguaaggugcugcuuucaucuauacaaguugugcuggaggccagggguaggcgugaguuuugggaggugaaguaucugugugugugaaggauucuguuuugagaaagaaggaaaugggaacuuacuaauuuguagaauggaaacuagcaaaauuaggcaaggcauggugagagcaugugcagcaggaagaggagaccccgcagagcucagaagagguggaggaggggcuggccuccccggccucaggacuucagggaucccacugcgucuucucugcuccugcuucggcuggauuucaccggccaggugucucucuccccagcacuaccagccacuccaggaugucccuggccugccaccagccuccaccagugggaaaagccccuacaccagguaguagcaugacugaaggagggcccgugucccuggggaggcaagaagggcccaagcccagcguggcgcagagugaacguuacgccaguuuccuguuuagacagcucugagcugcuucccucuggccuugcauauuucuccuaauuaaaacaacugcuuuuucccccucauuauagaaguacuauguguucauugguagacacauuuuaaccuacuucugggugagaaaaacaaccccuuagcccccgccaccccccuacccagagagaugguguuaacaccugguguaccaccuuccaaaucuuuuuguccaacaaaacuuuauucacaagacauuuucacaacaugcgacccuuuuguaauguacuuuaguaaucugccuuuuucauuuuguacuacuuugugaccauguuaguauuauuaacuaauuuauuuuaguuaaugaauuaauuaauuuuuugaggcagggucuugcucugucacccagguuggugugcaguggugugaccauaggucacuguagccuugaacuccuggccucaagagauccucccaucuuggccucccaaagugcugggauuacaggugcaagccacugagccuggccuguuauuaauuuuuuuuuuuuuuuuuugagacagagucucgcucuauugcccaggugcaauggcaccaucuuggcucacugcaagcuccgccucccagguucacaccauucuccugccucaaccucccgaguagcugggacuacaggcgcccgccaccacacuuggcuaauuuuuuuguauuuuuaguggagaugggguuucaccguguuagccaggauggucucgaucuccugaccucgugauccucccaccuuggccuccuaaagugcugggauuacaggugugaaccacugagcccagccuguuauuaacuauuuuaaaugucgauguugguuuaaaaaauaauaugacagaccccacauacucaagagcaagggauccagggucugacugccuggguucagaucuuggcuaugccacuuaucccauuuguggccauggacaaguuacuuaacuuuucauugcacucaucuguaaaauaggauaauaaugguaccuauuacacuggacucucaugaggauuaggggaguuaauuauguaucauacuuuggguaucauaguaccuggcaaauaucccaagcacucuauaagagcuacuauugcuauuauuauuguuuaaauuuacuuuuauuguaaguucugggauacaugugcagaaugugugggauacauagguaagcguuugccaucguggcuugcugcaccuaucagcucaucaccuagauauuaagcccugcauguauuagcuauuuauucugaugcucuccuccauccuuacccugcuccccaacaggcccugguguguguuguucuccucccuguguccauguguucucauugaucagcucccacuuaugauugagaacaugcaguguuugguuuucuguucccguguuaguuugcugaggaugauggcuuccagcuucaucuaugucccugcgaaggacacgaucucguuccguuuuauggcugcauaguauuccaugguguauauguaccauauuuucuuuauccagucuauuguugaugggcauuuggguugauucccuaucuucgcuauugugauacuauugcuauuauuauuauuauuauuauuauuguuauuuccaacccucuaugauaggcagaauaaacgcucucugcucccaagaugcccuugucuuaaucccuggagccugugaauauauuacucuauacggcaaaaugcuccuugcagauugaacagaucuugagauggggagaugauccuggauuaucuggguggauaugaugaaaucacaaagguccuugcaggagggaggcaggagggucagagucagagugagacuggaagauggcaccagcuggcucugaagauggaggaaggggccaugaaucaaggaaugcagguggcuugugcaagcuggaaaaggcaaaggaacucauucuccccuagagggucuggagaaagcuugucccagugaugccuugauuuuagccccaugagacucaugacuuuugcucgucuccagagcugcaagauaaucaauuugaguaaagcuauuaugcaugugggaauucaguagcguagcgauugagaauaaauaacccccaaccccgcaaccaacuuagaugaguugugauguuugcuuuggaucuuuuuuguuuuuaagaaauaaaauauaguuaaguucucauaaguacccuucccucccuagagaaaucaguaucaugauuuaauaauuauaauucccauuucaaaaauuuucauccaugauuaacauauaauauguuuugcaggucuuuacauaaaagacacugcgugguguguaucccucaagcaacuugcauguuuuugcuugaccuugugaagauuuuccauguugauguagcuuuauuuuaacauccaugagcaauuucacucaacaguacagcacgauagauugaucuguccugucaaugcuggacauuuagguuguuuccaaucaugauacucccgauuccagcaaacacgucuucgcuauuguuugaaauuacuauaggauucuaccuuauuuuuuaaaaaccuaucucccauuuuuucgauauuagauaguuguuuuuuauuuucuuuaauuuuuuuuuucuugagguggugucuugcuuugucacccaggcuggagugcaguggcacaaucucagcucacugcaaccuccgccuccaggguucaagcgauucucuugcuucagcuuccccaguagcugggauuacaguuguacaccaccacgccugguuaauuuuuguacuuuuaguagagacgggguuucacuauguuggucaggcuggucucgaacuccugaccacaagugauccacccaccucagccucccaaaguguugggauuacaggcaucagccaucacaccuggccaacauuucauuuugaaauggcuuccaaaaaaucuguggcugugcagaggugcccaccaacauucugucuggaaugaaaaaacuagaaguuagcuccuucaggugaguacagucuuuuuuuuuuuuuuuuuuuuuuuuuuuuuuuuuuuuuugagacggaucucgcucuuucgcccaggccagagugcaguggcgcuaucuuggcucacugcaagcuccgccucccggguucacaccauucucuugccucagccuccacaguaguugggauuacaggcgcccgccaccgcgcccagcuaauuuuuuguauuuuuaguagagaugggguuucaccguguuagccaggauggucucgaucuccugaccucgugauccacccgccucggccucccaaagugcugggauuacaggcgugagccaccgcgcccggccucagguggguacagucuuauucaugucuguacuuccagcuuuugcuaccaaguguucccaguagaugcuuaguagauaugugauauugaauguguaacugcuaccuugaccuaccaccuucucuugaugaggaaccuauagauuuguuuucuuucuuuuuuuguuuuuguuuugagacugaguggaguuucacucuugucgccgggcuggagugcaguggcgcaaucucagcucacuacaaccucugccucccagguucaagcaauucucaugccucagccucccaaguagcugggauuacaggcaugcgccaccacgcccagcugauuuuguauuuuuaguagggacggcauuucaucauuuugaucaggcuggucucgaacuccugaccucaggugauccacccaccucagccucccaaagugcaaaagaaauuaauacuuuuauugagauaaaaacauuguauacccuauaauguaccccuuaauguauacuguuaagugguuuuuaguauauucagaguuguaccaacauuaucauaaucaguuuuagaauguuucauaauuucccccaaauccuauacauuagcagucaccucuacuuuacuuucccccaucccuggcaaugacaaaucuacuuuuugccuuuacagaguuuccuauucuggacauuucucacaauacauggcuuuuugcauuucacuuuuuuuuuuuuuuuuuuuuugugagacggaaucucacucugucgcccaggcuggagugcaguggcaugaucucggcucacugcaagcucugccucauggguucaugccauucuccugccucagccuccugaguagcugggacuacaggugcccaccaccacgccugucuaauuuuuuuuguauuuuuaguagagaugggguuuugcuguguuagccaggaugcaucucacuucuuuagccuaacauaagguucguucauauuguagcauauuaucaacacuucauuccuuuuuaagacuaauauuccauugcauggauagaccauauuuuguuuauccauucaucacuugauggacauuuagguaguucucucuuuuugguuacuguuuucauuuucuuuguucuuucuuuccuuucuuucuuuucuuucuuuccuuucuuuccuuccuuuccuuuccuuuccuuuccuuucuuuucuuuucuccuuuucuuuucuuuucuuuuccuuucuuuucuucuucccucccucccucccucccucccucccucccuuccuuccuuccuuccuuuucuuucuuucuuuacucucuacagucucacugugucggucaggccggagggcaguggugcgauuuugguucacugcauccucuaccuccuggauucaagugauucucgugccucagccuccugaguggcugggauuacaggcguguaccaccacaccuggcuaaguuuuguauuuuuaauacagacaggguuucacuauguuggccaagcuagucuugaacuccuggccucaagugauccaccugccuugccucccagagugcugggauuacagguaugagccaccgugccuggacucuuuuugguuauugugaauaauacugcgguggacauucauguacaaguuuuugugugaacacauguuuccauuucucuuggcucuuugccuaagaguggaauucuagguuaucuguaacuguuuaaucacuuaaggaauugccaagacuguuugccaaagcaguugcaccauuuacuuucccaccagcaauguaugagggcuccaacuuccccauguccucgccaacacauguuaguaucugucuuuuugguuaucaccauccuaguggaggugaaguguuaugucauugugguucugauuugcauuuuccugauugcucauugcucuaucuuaaauaguugauguaauaauuuccuucuaaacauuggcuuucuguagacaguguccuauuuucaacuuuucugggccccagcauugucuucuggcaugggguuggugcugacuagggcguaaaugaaugaggcaacucuggauauguuagcuugcagcacaugggcauggacacugauuggcaaggaugugcuucuuggcuugagucaagaaucauacauuuuaaccaucacuucugcuuuuuuuguggcacaaaaggaccauuuuuugaaguuaguaaccugucuuaguucccucaguagauguuuguccaaauguugcggugaagcauagcacagacuuuucaucauuucaagguuuaacgccucagcccagggaguguauauuuggugaccguuuucccagagcccuggaaaugcuucuuccuaacuguccacuuugagcuccucugccuccucuuuggcaaucaguuaccuccuaagaggaaccuggagaaaugucauugggaagugcugcuggcaccaggaugagagaguguucuugaaagcuugggagcaguauugagcaucugccaugugucaguauugugcugggcacuacaagcucacauguauccaugugaucauguguauggguauuuauuuguagugucuagucauuacaaucugucugugaguuuugccugguuuacuccuaaguacagugagcuucagugauuugcccaagguuaccaaaguuuucagaggaacaacaucagacacuuuuccccaaucaccaugugccagaaaaccuuuagguuaagagguuaacaagacaagccacagauaggggaaaauauuuaugaaacaagagcugauaaaggacccauauccaaaauaggcaacucuuaaaacucaacaauaaaaggccaggcucgguagcucaugccuguaaucccagcacuuugggaggccaagguggauggaucacaaggucaggagaucgagaccauccugacuaacacggugaaacucugucucuacuaaaaauauaaaaaauuagccggguguggugucgggugccuauagucccagcuacucaggaggcugaggcaggagaauggcguuaacccaggagguggagcuugcagugagcagagauugcaccacugcacuucagccuggguaacagagcgagacuccaucucagaaaaaaaaaaaaaaaaaacaaaacgcaagaaaacaacaaaaaaaaccaaaaacaaaagcucaacaauaagaaaacaacccaauuaaaaagugggcgaaagaucugaacagaugccucacacccccuucccccaccccacucacaaugcuuugccauccaugucuccauccugcaguagccaaagcuggcugcuucuggaccacugcugugcaauggaaauacagugugagucaccaauaccagccaugagaguaguguuuuguuuuguuuuuuuuuuuuuuuguuuuuuuuuuuuuuugcuguuauuguuguuuuguuuuuuaaauagagaugggauuuuguucugggugaagugaaucaaacuccugggcucaagugauccucccagcucagccuccugaguagcugggauuacaggugugagccacuguacgcagucauguguguaguuuaaaguuuucuaguugccacauucauaaagguaaaaagaggugaaacuaacuuuauuaauaaauuuuauuuaacucaguauauccaaagcauuauuauuucaacauguaugcaauauaauuauuaacgagauauuugauucugguuuuuggucugugucuucaaaauccaguguguguuuuauaccuauaacacaucuugauucagacagauucaauucugaguguucaaaagccacauguggcuaguggcuaccauauuggauagcacagaucuagauuauaccucuuuuguccuuuugcauuaccugcuuccgugguccccaagcagcaaaggcauucuccauguggcagguacuaugaucaucauaguggugcucccugugugugugaucagguagcuuuaauuucccacagagacugaaaauguggaagugugucuaccagcuuugccaucuguccuagauuuaggugugacaucugauugcugggcccgagcauccagugccagcuguacuucugcagauuacuggguaaucacaguagaaccuuucuuggggguugcuuuugacccaggcagcacugcucagcuuguggccagggagcuucaugaccauugagaguaggagucugcaccauuacaugaucauaggauagccugcagacaugugauucgugucuuguaaguuguaacugaguaaauuuuuauauauggaaagaaauagaaugcugaaagggggaucaugaggguccagguguggggcuggggacauggaaggccucacugagaagcuggcauuugagcaaaggcuuggaaaaguugaaggagugggcuguguagauaaguguuuugagggcuucaggaauggccaggacaaagccuucgagguggggcauguucuggggauagccagccaagcagggugaugggggcagaguuauggggaggaagcaggggucacaugacccagggcuguggaggccuccauagcacucaagcuuuuccuccagggagccgggagccaugggagaguuugcaguggaugacggaugacugauauggccccucgggcugcucugguuggcuuucuccugagucguccauucuaccuucucgccaaggcuuccuaggucauguuucaagucuguucaaugcauuuccuucuccagguggucaguggagaccucacagcagaggcuuaucuuguugaacguggugauucauguggugauuucacagggucagcuccccaugucuugucccagcgguguccuccuccuacaucaggagagggaggucagcucugggacccaagaaagggcagggugccuugguaacccuucugcaggcuugagggauuggggcagugugcaucucugcgaggagggcacugaggaggaugggcuucucagauccugggcucugccuucuggaucugagauccaaguugcaaaggaagagcugguuucaggcugaagcauuuuuucagcuucauacaaggcaggaagcccaucaagcccccacaucgucaucauugucaucacugucacuaacgccaccauaagagcugacauuuauguaguauauguuuauguaccuguuacagcucuaagagcuuucccuguauuauugcuuacuuaauuccacaacuguauguguucaauacgcauuauuuccauuuuacagaugagaacauugaggcauagcccagggucacuguauuagucuguucucacggcuauaaagagcuaccaaagacuggguaauauaaaaaggaaagagguuuaauugacucacaguucagcauggcuggaggggccccaggaagcuuacaaucaugguggaaggugaaggcggggcuggcaugugacauggagaaagcaggagcaagagagagagggagggaggugccacauacuuuucaacagccagaucucucaagaacucacugaauauugcaaggacagcaccaagagauggugcaaaaccguuaaugagcaauucauccccaugauccagucaccuuccaccagaccccaccuccaguacugaggguuacaauucaacaugagacugcugcggagacagauaugcaaacaauauuagguuguuucuaccuuuuggcuauuaugaauagugcugcugugaacauucauaugcaggauuuuguguagauguguuuuccuuucucuuggguguacaccuaggaguggaauugcugggccaugcaguaaccauucauuuaagcauuugugacuacauuuaaccuuuugaggcaccaccagccuguuuuccaacggggcuacacuguuuugcauuugccaaggccuguuggcuguuuuggaggcaaaccccuccccuuaaguuccaaagaagugaauccccaguguccugaggucagaauguccagggcacccuuuuagagagagagggaggaggguccugagagacuguacuggagaggcuguguggccccaagcccacagcacugaguuugagucucagcucugccaccuaccacugugcaaucuuuuuauuuuauuuuauuuuauuuuauuuuugagauggagucucccucugucgcccaggcuggagugcgguggcaugaucucggcucgcuacaaccuccgccucccagauucaagccauucuccugucucagccuccugaguagcugggacuacaggugcccgccaccacgccuggcuaauuuuuucuauuuuuaguagagaugggguuucacuguguuagccaggauggucucgaucuccugaccuugugauccaccugccucugccucccaaagugcugggauuacaggcgugagccaccucaccuggccaccacugugcaaucuugagcaagcuccauagccucugugggccuggccucuguuucccccuaugcaaaauggggcuuaucagagcaugcuggaggggcucccaugagaucaggggagacaugagcuugguguaguuuguggccuauuggaccugccugaugaagguugcugccugugagguugguggugucuaccaggcauuguccucuaaaauauaauacuccuauucuaggggugaggaaggaguguggguguguguucugaguagcucaugagagagugggaaccugugcuaagccaggccuggucucucugagcauggugacuuggacuuguugcuuuuguggcagggaacugaaacuguugcagacacucuuggccugaccuuauccccucagcacacaccucugcacaccacaagccacuugcuggaaacaccugugacuaugccugagggcuucugcuagccuguggugcaggauaggcugggagugcugggguguuagugccuccagggguggcauggcuggguggggaaucggcagaucaauaccccagcucccucacccucagucaggacacuccuggcuuguucugcacugacucccaggcuuccccaauggacuucggcucuauuuacucacaggaauaauaagcuugaugacacagccuuuauuugcugcgcuuccuucccuguccaccaccccauuccccuugcagugauuccugggauagcccccaaauaaacuccuuguauguacauccuugccucagagucuguuucugggggaacccagaugaagacagagacccacuuagacccugugucaggaaacacauggaccagacuugggccacccugggacuugcuguuuucucuguucccugcggugugugagccugugugugccuaugcaugugucuuucuccucuugccccugauuggcuagccuugucacuucuguccugauucuagagggagugucugaugucccaguuauugcugcccucagcagagucaggauuuuuuggccggggcgggggguggggucagaaaccagcucaagcaaaaaaagagaauuuacuggaacguguggcugagaugcauacuguguagcucacagcauccaagaugcaaugccuuucccaugcucucuucaucuuucugccagucuuugucugccaccaugguucucuccuuuuuuuuuucuuuuuuuugagauggagccuaccugugucaccaggcuggaguucaguggcgugaucucagcucacugcaaccuccuccuccuggguucaagugauucuccugccucagccuccugaguaggugggacuacaggcacucaccaccacgcccagcuaauuuuguauuuuuaguagagaugggguuucaccaucuuggccaggaugguuucuaucucuugauucucguggcaugccucagccuuccgaagugcugggauuacggugugagccaccgugcccagcccaugcuucucuccuaucccagacgacucuagucuauagaacacguaacguggccaugagcagccucauaagagaccguuuuucucucagcaucuaugcuuggccuucguuauuugcagcaucaguauuggugaauuugccuuucugcuccaacuuauuugcaaccugcaaaccaguaguucuggcccuucuguggucauucuuggugaugcagacuggugaaaaauuugggucacccauucacacaugcccugcugaggucaaacaagaugacacucugccuuccuguuuuagcuuucuuuuugcaaacagguguccuuucugccguccacuuagugccuuauuuucugcaauuucuuucuuuuuauuuuuugcuggugauguugcucuuuaaaauggcccugagcaaagugcauuuauuucucauuaauucauucuuccuguuauugauuuauucagugacuaucuauggaucauuugcucagggcaaagcacuguauugaguucugauagaaggagacagggucuuuaauuucaucgaccuuauuguuuagugggagaggcaagcacaacauugaucaaauaauuuuguacaugacuauauuuauaacgaaaaugaagguaacuuuugcuucccucucuaagaggcaccaagggagguuaugcaccugagaagcagcccagggaacagcagcgaaacugaucuaacaguggccuuccuggcccuaguggcugugcuuuguggucuaaggccacauuuaaccuguguaccagagggacaugagugugcacuuccuggaaugacccugagguguucagugugcuggggaaggucauauggcaccacguaugacagcaguguugggguugaacaagccugggcuugccuccugagucucccauucugucugugugacucccuccuugggucucagugucugcaucugucaaaugggcacaccggugguaccuuccucguguguggguguaaagacuagagaucggguauguaaaaccuuuagguuagugcucaguuaugagcacuuugguuggcaguaucaucgauaagggaugguuuugcacgucgggguucaggacucaaaagggaaggccauucccaguguuagucaccugagaagaugauggauucccuaggcugggaacugguuucaggaugauguuuccguuuucuuuuuucuuuuuuuagguauuucuccuagugcuaucccuccucuagucccccaaccccuaacaggccccagugugugguguuccccucccugugugcauggguucucauuguucaacucgcacuuaagaguaagaaaaugugguguuugguuuccuguucuuguguuaguuugcugagaaugaugguuuccagcuucauccaugucccugcaaaggacaugagcucauccuuuuuuaugguugcauaguauuccaugguguauaugugccacauuuucuuuauccagucuaucaucgaugggcauuuggauugguuccaugucuuugcucuugugaauagugccgcaauaaacauaugugugcaugugucuuuauaguagaaugauuuacaauccuuucgguuuauacccaguaauaggauugcuggaucaaaugguauuucuggugcuagauccucgaggaauugcaacgcugucuuccacaaugguugaacugauuuacacuccuaccaacaguguaaaagcauuccuauuucucuacauccucuccagcaucuguuguuuccugacuuuuuuuuuuuuuuuuuuuuuuuugagacggagucuugcucuuuugcccaggcuggacugcaguggcgcuaucucagcucacugcaagcuccgccuccuggguucacgccauucuccugucucagccuccugaguagcugggacuacaggcaccugccaccgcgccuggcuaauuuuuuguauuuuuaguagagacgaaguuucaccguguuagccaggauggucuugaucuccugaccucgugauccacacgccucagccucccacagugcugagauuacaggcgugagccaccgcacccggccuguuguuuacugacuuuuuaaugaucgucauucuaacuggcaugagaugguaucucauuguaguuuugauuugcauuucucuaaugaccagugaugaugagcuuuuuuccuacguuucuuggcugcauaaaugucuucuuuugagaagugucuguucauauccuuuguccacuuuuugaugggguuguuuuuucuuguaaauuuguuuaaguucuuuguagauucuggauauuagccauuugucagauggauagauugcaaaauuuuucuuccauucuguauguugccugcucacucugaugauaguuucuuuugcugugcagaagcucuuuagcugaauuagaucccauuuguuaauuuugccauugcuuuugguguuuuagucaugaagucuuugcccaugccuauguccugaaugguauugccuagguuuuuuucuaggguuuuuuaugguuuuaggucuuauguuuaagucuuuuauccaucuugaguuaauuuuuguauaagguguaaggaagggguccaguuucaguuuucugcauauggcuagcugguuuucccaacaccauuuauuaaguagggaauccuuuccccguugcuuguuuuugucaaguuugucaaagaucagauggugguagaugugugauguuauuucugaggucuguguucuguugcaauggucuguauaucuauuuugguaccaguaccaugcuguuuuguugaccauagccuuguaguauaguuugaagucagguagcaugaugccugcagcuuguucuuucugcuuaggguugucuugguuauguggucucuuuuuugguuccauaugaaauuuaaaguaguuucuaauucugugaagaaagucaaugauagcuugaugggaauagcauugaaucuauaaauuacuuugggcaguauggccauuuucaccauauugaugcuuccuguccaugagcauggaaucuuuuuucauuuauuuguguccucucuuauuuccuugagcaguuguuuguaguucucuuugaagagguccuucacaucccuuguaaguuguauuccuagguauuuuauucucuuaguagcaauugugaaugggaguucacucaugauuuagcucuguguuugucugucaugguguagaaaugguugugauuuuugcacauugauuuuguauccugagacucugcugaaauugcuuaucagcugaaggagauuuuucuauaacaguguaaaaacacaggagcuuaaaacaacaauucugugggucaggaauuugggcagagcucagucaguggauuugcuguucugucucacuugguguugccuggagucccuuaccugaauauauucauuggauggccaggcuggaaguucccaggcagcuuucugggccaccaguguuccuuugugcagcgucucucccuguucuguggcuaguuugggcuuccuuacagcaugguggucucauaguagcuagucuucucugugauggcuuccaagggacagaaagcagaagccugaagcuuuugcuguguuaaaaggaagucacaaggccagcccugacacagggaagggaaauagauucuaccuguugaugggaagaaguuuguggcuaucgugaauccaccagagauggagaccaugguauucaggggcaucucucugagccuugaccuuggguguguugagugaucuagaaggcaggucugguacuuggauauuagaaggcugcccuccauaaggagagaggauaaggggcugggaacccaggcuggggucuguguguuagugccaaacuuuggggcuaggauauaaaugucuuaagauacagcggaggggaaugguaccgggucugaaggauaggcugucuuuuugcuuguuuucugguuauuucacuguucuccucaauagguaauaaggucuucucaggggaccugccuguuuuagcagugcuucaggagcugagacaggggcagagauauagucuggggucagaauguuuaggaguggaggaucugcgaggugggguguagccgggauuggauugaaagguacccauggggacugagugcaguggcucaugccuguaaucccagcacuuguggagauugaggcgggcagaucacaugaggucaggaguucgagaccagccuggccaaaauggugaaaucccaucucuacuaaaacaauacgaaaauuagccaggcaugguggcaugugccuguaauccuagcuacucgggaggcugaggcaggagaaucacuugaacccgggagguggagguugcagugaaccaagaucaugccacugcacuccagccugggcaacaguacgagacucugucucaaaagaaaaaaaaaagacacccugggggacaugaagcacaggcagaauggagagcaaggacccaaggcuuuuguccugucucacuguucccuugcugugugaccacagggaguuaaccucucugaaccuuaguuucuuugucucugcaguggggauuaugaugauccucuccccauagaguugggauaaagauuaaaugagccaauacacauuagguuuguagcacaggguuugucuagaguaagugcugacuaaacgucagcugcuggagaugguggcgauaagaaguuacuuuuauuauuaucaggacugcuuguuccaguggcuguuccagccugacaaaucuuccaaggcaaaaccagaguugcugaaguuaacuuuuaaacauuuccuuuuuuuccugaguuauggaaggaaugauaauuggggaauuuaggcuuaaaaugaagcaccugugauaugacgcucuggaacgccucuucaugcagagggugguuaugcgaagggaggagguuuuauugcauauggggccuuacuggacagugaagggaggggguucccagcucucccuggugggcccaggcuagagcaugggucucccaguccucaccaaggggucucagccucagcagguuggcagccacacaacacagugagauccuucuguguagcugagccucugauucccagaggugaagauacagucuuagaguguaucccagggacccugucuuuccagcgggaaacugcaggggcugagagaccacccccuagaggcuuccucauuugcaucuuuaacacugccaugguugggggcuguuuucuucuucagccugcccugccugggcucuguugacuacucagccuguuguucugaaguucuccuggcccuuucagaggccaugggggcucaaaagccacucagaacacaagucccucuucagcugcugggagucugagcaugggaaaauccugccugauuuuuuccaguucccaugcaggugguggcuucuucgauucucgcggucuucuugguggaaaccuuuguaggucuuaagugcgcuauaauugagcagucuuaaaugaccagacacaguggcucacgccuguaaucccagcacuuugggaggccaaggugggcggaucacuugaggucaggaguucgagaccagcccggccaacauugugaaaccccguuuuuuacuaaaaauacaaaaauuagccaggcauggugacuugcgccuguaauccuggcuacucaggaggcugaggcaagagaauugcuugaacccgggagguggagguugcggugagccgagauugugccacugcacuucagccugggugacagagcaugacuucaucuuuaaaaaaaaaaaaaaaugugccuucacggacaggcacgauggcuuaugccgguaaucccagcacuuugggaggcugaggcaggaggaucacuugaggucaggaguucgagaccagccuggccaauauggugaaacucugccucuacuaaaaauauaaaaauuagcuggguguggcagcacaugccuguaaucccagcuacuugggaggcagaggugggagaauugcuugaaccugggagauggaaguuacagugaguccaaaucgugccacuacacuccagccugggcaacagaguaaggcccugucucaaaaaacaaauaaauuaggcuucagauacugaacuaucuggcauauccuauuuugggaccaugaaaagggugaccuggcaagucugagaaggagaccuuuucccucauuauaauuuuuuuuuuuugagacacggucucauucuguugcccagguuggagugccauggugcaaucacagcucaacuacugccuugaccuccugggcucaaaugauccuccucccucagccucacaaguagcugggacuacaggcaugcaccaccaugcccagcuaauuuuaauuuuuuuuuuuuuuuuuuuuuuuuuuuuuuaguagaggugggaucucacuauguugucuaggcuggucuuaaacuccugggcuaaagcaguccucgcauuucagccucccaaaaugcugggauuacaggcauuagccacggugcccagccagaaauuaugacuuacucccaagguccugauguccagaagcaagaacugaaagugcgguugcgcuguuaucauuagugggaaaacacucaggcaccuggggccacauccgguucugccucuuucuagcuggucuagagucuucucugagcugggcuuuuuuuccuaugcccauugcacaguuacccauuuauugcccagaaggugacgggcacuggaugcguuagaugcuggggaaauagaggcacaaccaucacaguguccuucuugugaguuuugaaggcugguggggagagacggaugguaaacagggaggugaagacaaagcccucucuuuacaagcgaagucagcacaagggacaggaagagcgcacaugauggguggucagaaaaggccucucugaggagcugauauuuaggccgagauccgaugggaagaauccucuagguggagaaggacuaugcauccaucccccauguauaaaaugggaauaauauuaguaccugugccgugaggcaguugugaagguaaaaugaauuagugcgugugaagcaccuaucuuccacuaaaaacagaaagcuguuuuagauguugauauuacuauuauuauuuuugagaaggaguuucgcuuuuguugcgcacgcuggagugcaucgucuugaggggugcugcgcaaggcacuagggugguuuuaaacgccuuuugucagcuguguuugguguugcuacagcuucaguaaacacaagugauaaaacaagagcccucaaacugcaccuggccuuccagaagaugacaaagauguauguagaacaucagaggguaccuugugauuauuuuauuuuaucuauuuauuuuuaaaauuucaaguagagauagggucucacuguguugcccaggcuggucuaaaacucccagacucaagcgacccccaugcccuuggccucucagagagcugggguuacaggcauaagccccugcacucgguugugauucuuucacuuaacacauuuauugauaaguuauuacaugucaggcccaggccaggguaggcaaaaaugagacaagcucccugugcuuaugaacauguucucacguuccuuacuguuucggggagaaggggguuaagugaacacuugggguugagagcaaagacccaaaggagaagacagauucugggagggaaggggcaagauuagagagaccugguugucaucuacucucuguuccuuccuuucauguggccugggcucggucacuuccucucugucggcucguguccccugaucugugaagugagaauuacaacaccuacuuuacagggcucucgugaguauucagccagcuaguguguuaagcucuuacucccguuaggauugcuucggcccucugugccucaguuuccucacuggugagguccuuucugccugaucaagucuguggcucagucagcuccucacuuccugccccucuggaggacaucccauuagucucucauuccaucgugcucuucucuuugggagcauugucauauggugguuauuuauauuuaugugggcauuuaaugucucucuuucucagacugucagcucuuugaaagggggcuguuuguuccauucauuguuccugugucaugcaugaugacuagcacauaccagguagaccauagaugcugucugcaugggugaaugccauucuuccucugcuugcaucuuggggauacucaucggcugcacggaaauggagcuccgaaggccugagcuucaggaauuaucugcuuggugggggcuguguuucuggaggcuucaguggccugaacaauagccaggacagagccaacuagccgggcauaccuuuucucugcagcagcaagccuuguuggcacugugggcagcaggaaauggcugaaauaacuuccaucaugaugccccuugucaugaguuuccauggaaacugagggcugcugagccugucacucuggcauaagggaggaguguggagggcagccucaugagaacugguauuuagguagaauaugaauagggggauuugauuccuuuuccauaagcuagugugggcucauggauuuuuuuuuuuuuuuuuuuuuuuuacugugguggggcucuuugaaucacaaaaauaaauacagcuuuuuagugagaacuuaggguauuuccaacacugucaucuuauuucauccuucuaggcccaccaugaggcagguguaacuccuucaauuugcagaggaagcugaggcucagagagguccagugacuugcucaagucuacacagcggggcauggcagaguucagauccacauucuggucggccugacugugggguucaguggagguuggcggugcuugagcauggaagacaaagaccuuguugggugccgggcugcuucuagagauggaugugguggguggaggaugguuuguguucuuuccagagucagauggcugggcagagucaggacauccuggggguguuggauucccagguguggagugacaacacugccucauauccauuuucagagcucauuucugaggcuucaucugguaccaacccugugaggcgagggagcuccugcgaauccccuugugcagccaggcuuggagaagucaaggauuuggcuuggggcacccaggaagccugaggcuuagcuggguggaccuccuggcuccucgcccacugcuuuucacccugcccugaggugugagaucuucccagccaccucuggaaggcuggacucuaucccagcucaguuauuuauguauuuauuauuauuauuauuuuuugagaccaagcuucgcucuuucgcccaggcuguagugcgguggcgcuaucucggcucacugcaaccuccgccuucugguuucaagcgaauauccugccucagccuccugagcagcugggauuacagguacccaccaccaugccuggcuaauuuuuguauuuuuagcagagauggggguuucaccauguuggccaggcuggucucgaacuccugaccuugugaucugcccgccucagccucccaaagugcugggauuacagcugugagccacugugccuagcccuagcucaguuuuaaaaauuacauuuaguaggucuuauuuuccauuaucagagaaaugcagauucauucuagaaccuuuggaaaagauagacaaacacaaaagaaaaauaucucccauugacuacccuccagggagcacuggacccaaacuaggaucugguugcuuuucugugaagauguccuauuucaucuuuaaggauuaugaucuuuuagguaauggaaguugugcuucauauuuuaagaacuuuuuaaaaugaacuuuauuucauauuuaauuuauauacaauaaaaggcacucauuuuaaguacacaguuugaugcauuuugacacauguguagacauguguaaccaccacccuaauugagacacagaacaccuuccaucgcaggagagaggguucccucacuucccucugcagucugcagccccccacccuccccagcaugcacacucccugccccaggccaccccaaccuacuuugagucauccaggauuuuuccuugguuuuagaauuucauaaacauggaaugaaacaguagacuguguuuugcauucgacuucuuuugugugauguucucaagguucacccauguuguugcuagugucaguaguuuuuccuuuucuguugcugagcagcauuccagugaccgaauauaccacugccuacucccccauucuccucaugggagaucuugggcauaucaguuuuccccucuguauaauggggaaacauuacccaauuuuuuuuuuuuugagacagagucucacucuauuacccaggcuggagugcaguggcgcaaucuuggcccacugcagcuuccgccucccagguucaagcaauccucccaccucagccuccugaguagcugggauuacaggugcacaccaucaugccuggcuaauuuuuguauuuuuaguagaggcagggucucaucauguuggcuaggcuagucuagaacuccugacgucaaaugauccgcccaccucagccuccugaguaggugggauuacaggugcacaccaucaugccuggcuaauuuuuguguuuuuaguagagaugggggccucaucauguuggcuaggcuggucuagaacuccugacgucaaaugauccgcccaccucagccuccugaguagcugggauuacaggugcacaccaucaugccuggcuaauuuuuguauuuuuaguagagacagggucucaucauguuggcuaggcuggucuagaacuccugaugucaaaugaucugcccgccucggccucccaaagugcugggauuacaggcgugcgugagccgccgugccuggccacauuacccgcuuuaucagauuguuguggggauucagugaguuaacaugugagugauuagaauaaugccuggcacauagcagaugcuaaauaucauaguaauaauaauggauuguugucucuugcuguguaacaaaccaccccaaggcauaguggugaauacuggagguauuuccaguuuggggcucuugaauaauaugagugaaugaaugaaauaauacaaauguacauguguaguugggcagccucgguggcuguugccuuccucgagggcucgaaugcugugugucuuggugaucggcugacaggcagccguugccucuucuaagaugggugguuuuccuuuugagguggguccugggggcuccuggcugcucagugcuggcccuacuuguugccuugugugcugcucugagccaggcuuggucuugcugggcugaccaacccauuuaagccucaggaaguggccucuguagaaaaaaauguauaagcagcggguggugaacagaucaguggagcgcagagccccaaaauagaucuuucuccgcuaacuugccaagcaacugggggcaguggcaaaugcuuugcauaacuuccuacccaaaagaaaagguuuuacugcaaacaacuuuuggggaccccuccccucucaaauaaucucagacagauccaagauguuuuuuuuuuuuuccagagcagcacaaagagagagccagacaggccugggguuccaucccagauccaccauuugcaggcugugugauuuugggcaaauuccuuaacuucgcugagccuucucuuuuccuguguuaacuagggaagaugagacuagacucuccaguguguaugcaaagcacccuuacgcugcagagaugcugcaaauagggagugucuuuuuuuucuuccuuuuucaauuuuauccucugugcuugcccuagagcuuguuaucaauuucucuuagcuuugucaauugugguggggugugggggauugagauuuggcuuuccugggaagauguuccaaaacugucuuugaaauaauacucuccuccucugcagaucaguggacaggguguugaagggucggcauaggugguaagcaugauugauggcccccagagauguccauguccugcuccccggaaccuguggguaugucauguuacuugguaaagaggaccuugcagaugaaauuaagugaagaagguugagaugggagaguauucuggguuacccagguggauccaguguguucacaggguccuuuuaagaaaaaggcggggcugggggcaguggcucaugccuguaaucccagcacuuugggaggccgaggcggguggaucaccugaggucagcaguucgagaccagccuggccaauauggcgaaaccccgucuccacuaaaagugcaaaaauuaacugggcaugguggcguguaccuguaaucccagcuacucagaaggcugaggcaggagaaucgcuugaacccgggaggugaagguuguagugagugaaccgaguucaugccgcugcacuccagccugggagacaagagcgagacuccaucucaaaaaaaaaaaaaaaaaaaagaaaaaggcaggagaucagagugaguagaagacaauggcaagaugauggcaacagagguuggaaugaugugcuucaaaggcagaggaagaggccacacggccacgauugcaggcggccacugcaaggugaaaauggccaggaagcagguuuucccucggagccuccagaaggagccagugcugccgacaccuugguuuuagcccagugagacugguuuugaccuaggagcugaaagcugauaaauguguguugcuuuaagccacugaguuugcaguaauuggugcagcagccguagggcacuuauaaagcaggcgaggccuauguuggcugugguuucacaggaaaguggccucuuggaugauggcgccuuauggucauuuuuauguuucuucccuucugaucuggauggauuguuuucaguucagccuaggggaggucuggcuuccccggggcuuuaccucgagacuggaucucugcagucaggccucuggugagccccuguggccggggcagcugcagcagagaggcuuccucucucgacagaaacgcagaagugagcugcuugcucgcagaggccaggcuuccugucuggccagucccugaaaugcugcuccccaccccucgccccaugagaguccaggugaagauugaguggggguaggggcugcacugucugaucucugaagugagccccuuccugucuagcuuggauuuguguugaaggcuuuaagaugacuguuuucuuguuuauuuacuuuuaagagacaggaucuggcucugucgcccaggcuggagggcaguagugugaucauagcucacuguagccucaaacuccugggcucaagcgaucuucccgccucagucucucaaguagcugagacuacagaugugcaccaccaugcccagcuaauuuuuuuuuuuuuucccuguagagacagggucucucuauguugcccaggcuggccuugaauuccuggccucaagcaauccccugaccucggugucccaaagugcugggauuccaggcaugaaccacugcacccagacaauucuuuucuuuucuuuuuuuuccuuccuucuuuucuuuucuuuuuucuuccuucuuuucuuuccucccuuccuuccuuuccuuccauccuuucuuccuuccuuccucccuuccuccuuucccuuucccuuuccuuccuuccuucuuuuccuucuuuuucuguuucuuuuucuuuuuccuuuccuuuccuuuccuuuccuuuccuuuccuuuccuuuccuguccuguccuguccuguccuguccuguccuguccuguccuguccuuuccuuucuuucccuccuucccucccucccucccucucuuucucucuuucuuucuuucauggaguuucacucuugucacccaggcuggagugcaauggcgugaucucagcucaccgcaaccuccaccucccggcuucaagcaauucuccucccucagccucccaaguaacuaggauuauaggcaugcgucaccacaccuggcuaauuuguguauuuuuaguagagacaagguuucaccacguuggccaggcuggucuugaacuccugaucuuaaguaauccacccaccucaaccucccaaagugcugggauuacaagcgugagccacugcacauggccccagccacuuauuuucuugugauuugucagcaaacagccucugggguugugacugcuggaaagcaccuccagcuuuuguggagccagguguggcuggcacuuuucguugggaucauguuuggaucucccucaggccuucucaccauguuccucgugugccacacuggugagauaacggggugugggagagacugggcauucagauucagcgguuauaauuaaagggcaacacugaggccaggauggcugggauccucucguagcugccaugugaccucuggccuuuuuguccuuccccaugaugucaccuuucauuggauggugacucccugcacauacccccaaagguguccauguccuaaucuuuggaaccuguggauauguuacauuauguggcaaaggagauuuuugcaugugugauuaagggaaagaucuugagauggggagauucuccugcaugacccagguaggcccaauguaauuacaaggaucuuuaaaagaggaagguaggaggucacagucagggagagagagcaggauucuggcuuugaagguggaggaaggggccacaagccaagaaaugcagguggccucuagagcugggaaaggcaauggguggauucccccuuggagccuccagaaggaacacagcccugcugacuccuuggucuuagcccagcgagacccguuuuggaaaucagaccugcauaauugcaagaugguaaauuuguguuguuguaagccacuagguuuguggggccauccuggccucagugaugcuuauuugggaguguguuuuuuuccuauuacugcucuaaucuuuuaaauuagaucugaagagaugcucuaauuuuuuuuuuuuuuuuuuuuuuugagacagagucucacucugucacccaggcuggagugcaauggcaugaucacagcucacugcaaccucugucuccuggauucaagccauucucuugcuucagcuucccaaguagcugggacuacaggcauggcaugcgccagcacaccuggcuaguuuuuuguauuuuuaguagagacaggguuucaccauguuggccaggcuggucuccaacuccugaccucagguguuccaccugccucggucucccaaagugcugggauuauaggcgugagccaccgcgcccagcccgagaugcucuaaucuuuuagagcaguaauaguagguuggugcaaauguaauugcaguuuaauuguaacuuuaauggcaaaaauugugacaacuuuugcacucaucuaauaggaaacacacucccacguaaccaucuccugagaucccuuuccuugacccauucgguaaauauuuacugagccccuccacaugcuggagacucugcuugucaccagauugaccaaagcaaggucuuguccuucagggguucaagucuuaggaagacagagacaagaugacaaggcuaagauugucacauaggguguuagguggaucguagagaaagaagacauagaaaucagauggcauuggaccagagaaauuuucucagaugucagugaaaggagcuuugaacuuggagcgagcucuggaaauguugucuggucgcacuggguaucuaguaaauauuucaaacucaacguguccaaaauggaauuugucaccaaaacaacggagaucucugccuuuaaaaccuauuccuccaguuuuccccauugugguaagagauaccaccauccagccagguccccaugccagaaagcuagaguccuccucggccccuuugccaccuucauuucuggcaucauguccaccuccugguucuugggguucaucacuguuuggagaugugcuucccucugccacggcaaggcuccaggauccuaggcucagagaugggggaaccgagaaaagcaucaaguaugaucuguguccucaccuaggugcaguaggaggucaguguagggguccaugggcagguucccugggcuccaguuucagcucugcacuuaccagugugaccuugaggucaaagugcucgaccucgugugccucagucuccucacugauaaaaucgcaauaauaguaggaccuaucucacagcaguguuuuagaauucaauguaacaagcacuuagaauaacacauguucagucagugauaguggugguuguuggaggaagcuucucuacaauacucagugcuucaaauggugauagcagcagccacucauuaaccacguccucucaguggucuuauuaaccucuguccuuggcgcuuuaaaaauccuccucaugcuuuuugacgagucuacccauuuuauagauggggaaacugaguuucauaaaguagcaagaaccuucccaaagccacuuagcuggaacagcuuuaccgugauuuucuaguaugacucucaaggcugccggagacaauuuugaguaauugcuggguuuuuaaaaaguucuucuucuguauccauuugaggucuugguuuaucccugcuggagauccgcagaaccagccuccugccuccuguggauccgaugagaugacugaagauaggacacuugauccuggacuuguuucuacuuccagccucccuguuccccuagggaauuuccucauguuuugcagauuccuaagccccaugauugugcuguggccuagggcugcauguccuuguugaccuugcgcugaaauaagacucaggggaugccccucaacgggaugugugguaaggugcaugguuaaucucauacauuauagaggauugcuggguuuuuuuuuuuuuggggacagggucucacucugccacugaggcuggagugcaguggugccacuaucgcucacugcagccucagcuucccaggaucaagugaucuuaucucagucucccaaguaccugggaccacagguguaugcucccaugcgcagcuauuuuuuguauuuuuuuuuugguagagcugggguuuugccauguuucccaggcugaucucgaacuccuaggcucaaggaguucaccugucuuggcuucccaaagggcugggauuacaggcaugagucacuguacccggccugcauuuauuucuuuaaaauccuacuuccucuguuucagaugagggaucagaaacauaaauaccugcaggcagcuggauaggugaccuaaauaagagaagcagguuguaucuaggggacaaaugacaauaaacacaggcugcacacugggaaaguucuaaggguggugggaaccgugguuaacggggagucagugcaugugugccugguguaaaguggacagauccuacgucaugcugcaggcucaggguccacagaucugcaguuggaaauguagguuguuacugugaaaucuccucauuuaaaaaaaagcguugacgccgccaggcacggugguucaugccuguaaucccagcacuuugggaggccaagguggguggaucaccugaggucgggaguucaaguccaaccugaucaacauggagaaaccccgucucuacuaaaaauacaaaaguagccaggcaugguggcggaugccuguaaucccagcucuuugagaggcugaggaaggagaauugcuugcaccugggaggcggagcuugcacugagccgagaucaugccauugcacuccagccugcgcaacaagagcaaaacuccgucucaaaaaaaaaaaaaaaaaaaaaaguugacucauugaaacacacaaauaagcaaaaugaucuucaccugacaaaacacuccuguacccugaugcaguucccaggccaacaacuugugaagucuguuccagacuguugagaaaugucauuuuuuuuuuuuuuuuuuuuuuuuuuuugagacagaaucuugcucugucacccaggcuggaaugcaguggugugaucucggcucacugcaagcuccgccucccaaguacacgccauucuccugccucagccuccugggacuacaggugccugccaccacgcccggcuaauuuuuuuguauuuuuaguagagacuggguuucaccauguuagccaggauggucucgaucuccugaccucgugauccacccaucucggccucccaaaguggugggauuacaggcgugagccaccgcacccggccgagaagcgucauuuuuauucugugcugugguguggugccucuuccuuugcuuuuaugagcugcaguuuugaucagcgaguccuugcgggucagcagagggucuugagaaaagguugcuuuuacaaccuuaagcaaguuauaaaagucgucugagacucaguuuccucauauagaagccagccgucacagccucagccuuccgaagcugcugugaugauugaacaauguggcauuuuccugagugccuggugaagucggguacauagaagguuucaacaaaugugaauuuauuuccccuuaacuugcauuccuuuuucuuuucugaaugccgagguggguggaucaugaguucaggagauaagaggcuguaucuuaccaacugcauucugauuuuacaggagaucacagaaugaauuuccugugugggccauucucucaaacauugcuagucucaggaauagucagaaaagcacaggaccuggcuuuuaaugaugacaaggacugcccccucugcccugucuuuuuuguaucugugauuuucauucauuaaugggguaguuaguaguuuuuauuuuauuuuauuuuuuuugagacggagucuggcucugucacccaggcuggagugcaguggcacgaucucggcucacugcaaccucugucuuccggguucaagcgauucuccugccucagccuccugaguagcugggauuacaugcacacaccaacgugcccggcuaauuuuuguauuuuuaguagagaugggauuucacccuguuggucaggcuggccuugaacuccugacuucaggugaucugcccgccucggccucccaaagugcugggauuacaggcgugagccaccgugccuagccaguuucaccauguugaccaggcuagucucgaacuccuaagcucaggugauccacccuccuuggccucccgaaguguugggauuacaggugugagccaccacacccggcccauuucucuguuuuauauugccaugauaccuuugccaaaagugagaaauuaacauuaccacaucgcuaucaaaguuccagaauuuauuuggacuuuaacaguuucuccucguauguucuccuucuguuccaggauucauccaggacaccacauugcaccuaguuuuuguuuauuuccaucgauauguagagguguuucuuucuuuugaauugcuguagagcauuccauuggugacaagagccauuuuguccacucucuccugcugggcauuugugcugagucccuuucuccuuugaaauugcagagggugcugugguagcuguggauggggaaggaaccucugagugggggggcguguguauuuccagccucaguagugagugccaaaucgcucucuagggggcuuauucuaccucucgguggcauccccacuaggugccaggcacuuuccugcuguggacccaugaacgggcagugcugucuugccuucaaggaguggagagauuaaauauauaauaguggccgggugcaguggcucaugccuauaaucucagcacuuugggaggcugaggcagggggaucacuugagcccagggauuugagaauagccuggguaacaugaugaaacccugucucuacaaaaaguacaaaaauuagccaggcauguuggcacgcaucuguggucccagcuacuuaggagucugaggugggaagaucaccuaagcccaggagguugaggcuguagugagcugugaucaugccacucacuccagcagugucuugucuuuuucuucuucuuuuuucuugagacagagucuugcucuguggcccaggcuggagggcaguggugcuacuuuuggcucacugcaaccuccacuucuuggguucaagcguuucuugugccucagccuuccaaguagcugggauuauaggcgcaugccaccaccacuggcuaauuuuuguauuuuuauuagagacaggauuucaccacguuggccaugcuggucuuggaacuccugaccucaagugauccauaggccucagccucccaaagugcugggauuacaggcauaagcccccaugccugguaagacugugucuuaaaaaacaacaacaaaaaaaugugugggguguguguguguguguguguauauauauauauacacacauauauuuuauauauguauauauaugaaugaaauggcaaaaucaucugccaagggcugcagcugacuccagaggacccuggaggagacugacagacacagugugugauaguggagggggaugggaagggugaggggggcaucgggcuucuggaugacugaggguauaugcaagugcagagacagcgugacuagaauguccaggcaggagaggggagauggacaggcacugcgggucaugaggguuucagagagcauacgcagugugucccagcuggugacaaccuugcucuuccuacaaccaaccauacacauuuccaucuuggggccuuugcauuuacuauuugcucugccugaaauauucuaucucagacaucagcccagaugucaccaccucuggggaggccucccugauaacaccuucuaugagagccccucccuccuggucacacaccaugcuuugcucuucuuugguuuaguuuuuguagcacuugugauugccaaguguaauaaauauugacuugucucugucuccuccuauuagaauguaauucuucgaggccaggaauuuggucuguuuuauucauagcuguauccccagcucccagaacagugccuggcacgcuggcuuuuaccuacucuuuguugaccuaauggcugaaugaacggacgugaccaucaucgugagaaucuguggauaauagcagcaaacauuuaaacacaggcugugugccaggcacugcacuaagcacuuggccaugaacuuggucuccuuaaauccucaugucaaugccacgaaacuggcccucucuauuugucucaguuuuacaccuggggacauggugggguuaguauuugaaccucauccaaccccauacuccaguugggaccccuggcugggucucugaccagugcugggaaagagggaggcagguagauuucagccccaagcuguggaguccagcaggcauuuguaccccgagugggacucagauccuuguguuagggggaacuuaggccagaagugccugggcuagaggguaauggggaccccaggaggcuccccgcucuugccccaauccugccuugucugaaagggaaggaaggcucuuaccuucuagcugucugcaacaggaacugccgggaggccacgcuagccaucccccaacuuugguuugcaaaacucugagccugguggggaaaugaagggcuggcuugcuaaccacaaaugaagacucauuugcacaggcaaagcgggggcaggggugacuccucuugcccuagcggaagggacugacuucugcaggcugcugucuugcuggagccagucaugccccaccauugagccugggcacucggacacaguuaccagcagugggcuuugucguccuccggccucagucuucuccuuugauaaauggagggggggaauagugauauuguggcgauucuguggcacucaaaugaggaaaugcacauaaagccuuugcucagugccugacucauggugaauacuuggggggauauucaccaucauuguuaacagugguaguggucagagguggcagucaccaucagagccucucuccugggcuccgcuccacauggcagccacauuuuaggaauaauccucagauuaagcaaaagagguuaagugaauauucccuaaugcaugcucuucuuuuccuuuuugaguagaaucuguccccacccugccuuuuuuugagacacgaucucacucuaucacccaggugggagcgcaguggcaugaucacggcucacugcaaccucugucuccuggguucaagcuaucuucccaccucagccucccagguagcugggacuacugaugugcacuaccaugcccagcuaauuuguguguguguguguauguauuuuuuguggagaugggauuuugccguguugcccaggcuggucuuaaacugcagagcugaagccauucuccugccucagccucccuuagugcugggauuacaggcaugagccauugcgcccaggcagaaucuaccauuuuaauuacacuucugugagugguaugauauccaguugacugcgugaggaucagaucccauucuugcaaagcuagagaaugaggcagaggccugccauccuugcagcuagugggagacccugugggugacccauuagccauaagagagcaggcuaagugcccagauaggaaggugucagcgugugaggcccaggcagccaguggucagccgauacuugaaggccuccugugugcccagcuugcugcuggggccaugacaguaacugagggaaacaagucacgcuugugagaugugaugaggaccuggaaagggaaguccagaagcggaaggcaaccucucagagagggggugucuuguggggacuuacagccaaggugagggugcuuuccugcuggcacccaccucgcagaacccauuccuucccugagucuggucugugagaagagcccacagcaugaggauaccacguuugggguucagcaaccccagaaugaaaaucacccuuuaaagaaggagugcuuuaccuuucugugggggccacagccugguuguguguuagagucacugggcucuggagaagcuucuggaggacuggggccuucuuucgcaaucuguccacacccccaggguccuuuuuccuggacuguggcuccggucgguacacggguccugagccaguauucuggcccgggguggccguucccugugggugaggaggaggcaccuggaagccccuggccucuccuguuaaucacugacaagguaaaaggauacuccugccuguuuuuuuuuuuuucaauuucaaaauuuaaaaaaaucuuuuuuuuuuuugagucaggauuucacucugucacccaggcuggagugcgguggugugaucacagcucacuguaccuuccaccuccuaggaucaagaaaugcuccuaccucauccuccugaguagcugggaccacaggcaugcaccacuacuccuggcuaauuauuauauauauuuuuuuguagaggugggaacuuacagccaaggugaggguguugccuaggcuggucucggaauuccugggcucgagcuguccuccugccuuggccucccaaaguggugggguuacaagcaugagccacggcgcccggccuccugugugucuugccuaacgauugccuuuggcgaugggagugcugaaugcuucuggcaucucucugucugcagaggcuuaccugacuucaaaggaagcauucaucuuuagccagaagcuagcagguucaccccaagguuuucugagaggucauucagggagcagcugcuggaacgugggaauggggacaggagguaacuggacuuaccuugucuccgggccuuccacugugggccacccgcacagacuacccuggugucuuuggcaucaaaacccagccagguggccuugaaugggugacuucaucuuccugggcugucucuggaaaauggggcuuucuucccaagauuggugggaggauuaaagagauguugaggucaacucugacaccuauuaaauguucaguaagggggaccugguuuguucucugucccaguagguguuucugcccugaacuugaccucggagggcucgguguucugcuggcugcuggcagaauugugagggcggucugugugagagucuuagcccaggagccggcgcgggugguguuggagaacucugggccugcagcuagacuggcaggacucagaccccagcuugcccaaccugccugagccucaguuuccccuucugcaaaauggaguugaugauaaugguaguuacuuagggcuuugggagagaccgcugagaugauggacagagagcacucgucacgugguugauagacccuggaucugcagagcugcugcugcugcugcugcuguugggaguuucagagcuggggcuccuugagggauguuccugagaggaagauucugguaggacccaccugggacagggugagaucugagcaggguggggaggagaacccacuggaccaaggcauggcugcccuuuacaagggcucccaggacgaggacaaucuccuuuaacaaaaccuccugccaguccccagagcuucuuggccaugagcugaggaguuuuuauuuguuccuuuggucuuuuauggcuaacucuggauuccucuuggguggauggggaggcagccuugguccauuguagaacuggguacuacugcaaaagugccaaguccuugcuguaaucugcucucuggagaacagacccugugggcaggggaaaggcccauugcccaccuccuggugucaugaacacuguuuuucucagugggaggagguggagguacccaaagaggaggaaguggccuuccaggugccacuuacuugguuuggugucagcucuguuauugauucacugugugaccuuggacaagcuccuugucugcuuugagccuuagaauuuuaugucugcaaaauggguauaauaaugacuccucugucguaggguggcuggcacgaaaugggauaauuuaggugaagcaguuaauauacuaccuuacguacagcuaacacuuaguaaguagcuguuauaauaauaaugaagauggccgggugugguggcucacaccuguaaucccagcacuuugggaggccaaagcgggcagaucaccugaggucaggaguuugaaagcagccuggccaacauggcgaaaccccaucucuaccaaaaauacaaaaauucgccggguguggugacacuacuugggaggcugagguaugagaaucgcuuaaaccugggagguggagguugcugugagcugagauugugccauugcucucuagccugggcgacagagcaagacucggucucaaauauaauaauaauaauaaucauaauaauaaugauaauaauugaagauaauaggaaaaccauguuauuaccuauauuaguguccugugguugccauaacacaagugccacaaaaugagggacuuaaaacagaaauguacuuauucccuugcaguguggagcuuagaagucugaaaucaagguguugguagggcagugcucccgcuggaggcucuaggggaggauccuuccucuccucuuccuggccucugguagcugcuggugacccugggugucccuuggcugguggauauuggcacucccaucucucccucugagugugucucuguccaaauuucccucuuacaaggacaguagucuuggguuaggacccacccuaauccagcaugagcucaucuugacuacaucugcaaagacccuauuuccaaagaaggccacauucacacauaccagggacuggacuucuauguauguuuuugggggaugcaguucaacccccaacauuacccguuuauacuuucuuuccagggccaccaaggacaagaccagagucauuuucauccugaauuggugucaacuaguguuuucauacccuagagacuauccaaaugacacagcugacccaaucccugcauuucucagagggggaaacugaggcccagggagguaaaaugacucucccaaggucacacaguaagguaguggcagugggacuggaucguggaucuccuggugcccuguauuggcccacgugucagccauggacucguauucccacugguggagccaagagguuuuugcugucugcaggggagagcacuuuggaucuuggcuucucguuucauccuucccuugguagugguuaagagugcaagcuuugggccgggcaaggugacucaugccuguaauuccagcacuuugggagggugagguggguggaucaccugaggugaggaguuugagaccagccugguuaacauggugaaacgccaucuccaacaaaaauacaaaaguuagccgggcaugauggcacacuccuuuggucccagcuccuuaggagacugaggcaggagaaucgcuugaacucaggaggcugaggugcagugagcugagauugugccacugcacuccaaccucagcaacagagcaacacuaugucucaaaaacgagugcaaacuuuggagccuggccauucagguucaaguucuggcucaaccauugugaccuugaaugagucagugacucucucugcuucagccuccccaccuguggaaggaagacagucaucucagccuuacaugagugcacaggugucaggaccccugcugugcacacgggcauguacucaguguuucugugcaugugguuucccuucccuuuccuccuguuugguuuucucugaagccgaaagguccuuaguaggaaguugaggaccagcguucuccaugggaagacucaacaucaguuacaacucuagaauuuauuccaggccauccaaguuaagguaguugucuguauuuugagaaccuuucucuugcuguaaaaagcaaacaaaaacaaaaaaagacaaacuagcaaacucaaagaacgagaauacauauacaugcagugcugcuucagauggaagucagaaaagugugugaucaaaugaaaggcuguuguugaaagggaagucugcauuuacucuucugccaguucucagacuaccucaacuccuugcugacauuccuaggaauuguggucccagcuggcuucuauagcugugugaccuuugccuuuuccaaacgagugggcacccugcaggccacuuccucuggguuucagugcccagcuuaucaggaggcugcaugaacaucuauuucuagcugggcgggaaauaggacggguccuggcagaaggcggagcccagagguggcugguagaauccccugggaggaguaagggaugcucuccgcagggacccccgugucgugggugccauggcaaagcguuaacaacaggcagugccuagggagccugaaccaagguugggagugugguuuccuucucaguucccuuuccgucuuccugauuaugacaagaacaucuguuugguaccaacauguguuuuuuuuuuuuuuuuuucuccuugaugcugugcauuuuuuuccauuggaauuuuuguugagauaauugaagaaucacauaaagauguaagaaaugauacagagagaucucaugugaacguuacccaauuauccccaaugguaauaucuugcaaaccuguagugcaguaucacagccaggauauuaacauucacaacauucauagaacccacuaccagucuuauucagauuuucccccauuuuccuuguacuuguguguauuuaguuauguacaauuuggucacaugcauagcauccuauaucugccaucauagucaagagacuaaagcaauguaaugauuucuuacaccaauuccauuuccaaaauuuuaacaugucugucuuugaaagauacuaauuuucuuuuuuuuuugaggcggagucuggcucuguugcccaggcuagagugcacuggcuugaucuuggcucacugcaaccucugccuccuggguucaagugauucucuugccucaaccucccagcuucccaagcaccugggacuguaggcaccugccaccaugccuggcuaauguuuauauuuuuaguagagaugggguuucaccauguuucccaggcagguuuugagcuccuggccucaugugaucugccugccuuggccucccaaagugcugggauuacaggcaugagccgccguugccagccugaaagauaugaaaugucuuuauuaaaauauaacuugcagacauaaaaaagaaugaguucauguccuuugcagggacauggaugaagcuggaagccaucauucucagcaaacuaacacaggaacagaaaaccaaacgccgcauguucucacucaucagugggaguugaacaaugagaacacauggacagagggaggggaacaucacacaccagggccugucagggggugggggcaaggggagggagagcguuaggacaaauaccuaaugccugcaggguuuaaaaccuagaugauggguugauaggugcagcaagccaccauggcacagguaugccuauguaacaaaccugcacguuccgcacauguaucccagaacuuaaaguaaaauuaaauauauauauauauauauauauauauauauguaaauaacauagaugugguaaaaugcacacauggugcauguaaggcucaaggcuuuaagcauggguccaccucuguggccauuccucgggucccggugacccaguccucucuuuaggugacaccacucugaccccaucagugagucuugcauggcuaauuggcuuugugccucucuuaaaggcuucucauuucccuuuaugacucacagaaccaagccgaggguuuugcuuccagcagacaacuauuucuagguagaauuuaaucauauugucacguuuccacugauuuuauuauuuugcaguuccuauuguauauggugaguguuacugguuuucuuuuugccaaaaacauaaaaucacucuuaacauacaucaguucaggugaaaacggugaguugauuuaaagaaaacuaucacauaaauaguaucagcaguaggcagauacaacaaaccuuauaagguugauaaacaaauguuugcaguuugagaaauaaugucauauggcuccaaaccaccccccaaaacuggucaauccaugugugaggaaaaaaaaaaaucucuauauagucuuuguauaaugagaguuuucuguguaauuuugauacacaguacugguuuaaagaaaagcagaauuagccuauuaaaauauuaauaggcuguauauaaaguaaugagcccuuccuuuauugccuuaauaauuuuuguuauauuugcauaccaugaguacuauuuuauaucuaauacuuauuuuaauauugauucacuauuuuuaaacuuaauuuuauauagaaaagaaacuugauuucauaguuuagaggugccagguauguauuuuuucaauauauuuuaaaauauacuacaguuaagacauaacaaagggugggcaccauuuaaauuuaauuaccagcaggagggugaaaaacaccaaguuuaaauggcaccaaaaugaugaacauuuaggcugggcaugguggcucaugccuguaaucccaacacuuggggaaaccaaaaugggaggaucacuugaggccagggauuugagaccagccuaggcaacauagugagaccuugucucuacuaaaaagagaaaacuuagguaggugugauggugcaugccuguagucccagucaccuggcuuugggaggcugaggcaggagggucccuugagccuacgaguucaaggaugcagugagcugugauugugccacugcacuccagccugggugacagggcaugaccuugucuccaaaaaaacuuaaagaauuauuugauggcccaugcuggggguguuaguggugagcacauaaagcuccucauuuucucauugucuccugaguuuggaaaugauugagaaaugaaacaucggcaaucaacgaagggcgaugagauggcugccuggagagcaugcuuagaauugagcccugacagcuggccccugagcugcccacccugucauggccuggguggaugcccauaggugucucagagcagcagucccagacuuuuuuggcaccaggggccgguuuuguggaagauaacuuuuccaugggccagauuggccuggggggauagugugaggaugauucaagggcauuacauugauuguguacuucauuuauauuaugauuacauuguaauauauaaugaaauaauuauacaacucaccguaauauagaaucagugggagaccugagcuuguuuuccugcaacuagacaguucuaucugggagugaugggagacagugacagaucaucaggcauuagauucucauaaagaguguacaaccugggucccucacaugugcaguucucaauaagguuugugcugccaugagaaucuaacgccgcugaugaucugacaggagguggagcucaggcaguaauguucgcuagaccccugcucaccuccugcugugcggcucgauuccuaacgggccacagacaggugccaguucauggccuggggauuggggaccccugucuuggaggcagcucccuuccgaguggcaaggaacagggcagggcacguggucccuuggggguggauccagcuagaacaagaugaagaggcugaguauccucaguuccuuuuuccagggaguggucccuuccucccuuggggauggggagucccagaggggagagaagcaccaguuuccccaguaucacuuaaaacucuuaucuauugaauaguucugcaugaauaugaagcauuagaaucacagaccuaauuauuugagcauaaugaucugggaagaaucucuucacauggaagcaggacacugauuuucgccucugcugucagcgcaguggcaacaacucuguuguuuauuaucuuuuuaacaaagaagauaagggcaggcccacccccuaucugcaggccaaaaaguaaacuuuauuuauuuauuuauuuauuuauuuauuuauuuauuuauuuauuuauugagauagagucucacugagucgccuaggcuggagugcaguggcaugaucuuggcucacuucaaccuccgucuccugggcucaagccguucuucucagccuccugaguagcugggauuacaggcacccaggcgcuuacuaccaugcccagcuaauuuuuguauuuuuaguagagacagcauuucacuauguuggccaggcugguuucaaacuccugaccucaagugaucugcccacuucggccucccaaggugcugggauuacaggcaugaaccacugcgcccggcuguaaacuuuacuuuuugcaaaguuuuuuuucagauauaucucuauaggguguauguucuuuuuccauuucauagaugagaaaauagacaguaagccagaauagaggcuucuucauacagccaggagagaaagagcuggauuuaacucaugccugcuagauccuucuagagcugggcucuuucugcucuaccgugugugccucggaagccccuuuugucauuacauguucuucugcuguguaucucaccuauucccccagcugccaugucagacgcugcuacaugugugaaguaaccuaacaccuuugguuuuucuuaaagcaggguccuuggcugagaucaguaagcaacgcuggggcuuuuuacuuaaagugaaaccaccagcagcugggaagcugguguugcaaggugguacagaaaaccauucagccuaguagcuaaacucaccuugguggagcccuccuggggccacgugauuuuuauuucauguuauuucauuugguuugcaugacaacucaaugauaagcaucacugcuuguacagcggaggaaacagcaaagagaagggaugcaacgugccugguuccugugcaccccuggggagcauaagccaggauuugaaccaaggucuuuguacuccagaacucccuacaaagggaggcuuucuccucuucuucccaggugagcuccagucugcagaacucagccaggaugcaugugcucagagaagccuuucuuccccuugcuggggaggagccccaguguggacucuguugcacuccugauguggauggagauguggauauucacauaucauaugccggccuggacagggccuguccucccucccagacucggagccgucugagggcaggacugugucugucucugcaguguggcaucccuagcgcucagcgugggguucugugacugccugguugacugaauaacugaaagucggaaaagagguugggguaugugugggaaggugcccaagccuucugucugucuguuugcucgcuugaauaugucuugagcuuccagagagaaauuuuuguuaagcucauugucagguguggugccccuugaggucauguaugggaauuggggaaaaagccauguuccuggugucaggggugggaggacguuccgugggugcagggagccugagagagacagagaaucaguagcgggaggaggaaggaaaugggagcuugaagaacagggucauggcccggccagcaaaggggucggugguguaaagcggggagugagaggaagcuaugagacguacggaggggccaaaaguccgcaaggcugugccagaaggugauggguaggcagggagggcugagggaggguggcuggaguggggugccggccuuugaggcugacucuaggagacucaguguguggggguuuguuugcagggggugggaguggagggauggguggugggggugggguggaccugggaagacccgaggugaugcugggaagggggugggguugugcaaagaugaagccucauuucuguggcuggguuaucucacuuucuucaagcaggaaacucggccacugagccccaccaugcaagagugcauggccugaggucugcugaccacagccuacuuugagaauaaaguguuguuucagucacuaugagcccuuggcaaaaauuugaacccaugcagacaaagcccuccuugaccaucauuugcccaucuccuucucacuaguagugccuguugucagcaaguugguggaaaucuuuugguacccuuucucacaccuuuacacucauacgugcacacuuacaaauaggcacauuccuucuuagcugaauccaguacauuccugaaaacacacuggagaggaacauuuuuggauugcaauauauuacaucauauuacacagagacaagcgcugaugcauuaccaacugauugaaacaccccagccaauuuccuuaguaucacuuaacaaccuuaaguaccuaaaaucagccuaccaauauuuuucgcgugaauacaaagcaucuacagcaacaaaugcccaauuuuugggugcuuugaugaacccauugcuaagcauguuugcaaaaaguacauaggauacuauacaguaauguuucugaauuaggauauucuucuauccuccaacuaccuuguacuguaauggaaaaaacaaugaaaugaucugcuuaaaauacuaaagauucauuuaaauuggacccugguugguaguuugcuugucagaagcaaaugcugggaugaaagaagaacucaauagaaugggcaggaugccggguuugaugugccguugguugugugucuaacugcuucucuuccauugcagacagacacgccuuuccuuuccuuuucuguuucuguuuccuuuuccuuuuuccuuuucguuuuucuuuuguuuucuuuuucuuucuuucuuuuuuuuuuugagaaggcgucuugcucuguggcccaggcuggagugcaguggugugacgucggcucacuacaagcucugccucccggguuuaugccauucuccugccucagccucccgaguagcugggacuacaggugcccgccaccacacccggcugauuuuuuuuuuuuuuuuuuuuuuugguauuuuuaguagagacgagguuucacguguuagccaggauggucucuaucuccugaccucgugauccacccgccucggccucccaaagugcugggauuacaggcgugagccaccgcgcccgggcaccuuuucauuuuucuuuuccuuucuuuucuuucuucuuucggauggaguuucacucuuguugcccaggccggagugcaguggugugaucuuggcucacugcaaccucugcacccccacaauggguucaagugauucuccugccucagacuuccuaguaacugcgauuacaggugcaugcccccaugcccggcuaauuuuuguauuuuugguagagacaggguuuugccaugguggccaggcuggucucaaacucccaacuucaagugaucugcuugccuaggccucccaaaucgcugggauuaccggcgugagccacugugccuggcccacaccuucacuguuuucauuggcaccuaggugcucgugaaccucguacagcaggucuaugaucuggauugugcauuuugcauaaaaaaagaguuaauaaguuauaguagacauucagauagugagaauuugcauagugauggacacuuguauauaauauguacauguacacauggccauguauguguguacacacauggaugcauacaucuagucuccuauuuacacaggucaucgaggaguuuuugucaugucgguacauaaggaucugccuccuuaauguucacagcaaauaaauugagacaccauguucuuucuuuuuuucugagacagggucuugcucucuugccaggcuggugugcagaguugugauuacagcucauugcagccucaaacuccugagcucaagcaauucuccucccucaacuucuugaguagcugagacuaccagugugcaccagcacacuuggcuaacugcguuuauuuuuuguauuuuuuuuuagagaugggguauugcuuuguugcccagguuggucuugaacucucugguuucaaaugauccuccuacuucaaccucccaaagugcuggaauuauaggcaugagccauuguucccugucccguguuauuucuuaugccuuauauguguccagcuugauucaguugcuaacaaguacagagaagcuucuacaucuuuguuuuuuuuccccuacauuuuuguuuugccagguacuauuuuaauugacaaacacacauguacagucgcacacucauuuaauccccacaagagcacugugugguaaguaucacuaucacuccuguuguucacaugaagaagcagaggcacagagaauugaaguuacuguccaaagcuaucugcuauaagcuggggagcugggacuccagguuccagagucuguccaccucaucaguagcgacacugcuccucaugacuuggauagcuccugggaacaugaauuugcagccccugcacuagaaucuuguucccagccucgggucagaaagguggcuugaaugcacugcguugagcgcagugggccugaccgcucucugugcagcucugcaccccuguggguagugggaucaucauucaccaagaugccccugccugauguaagaucaagggguggagaugucaacaaaaaugcccaccgacccccucagacuuugcugaauaccagauagaaaacccuggagagagcugcauauucuuauguggcuucuuagagucacuugcuugacuaugagucaaaguucaaaugcuggcucuugcacuuguggcuggugacccuggccaagguacuucacuucuccacaucucaguuuccucauuuguaaaauaggggcagucaugguaccugccucauaguguucuugugaggaacgaugaguuaauacagaggaugcuguugugccccacucagcucccauuaccaggcuugugcuccauuucccagcugcuaggaguguugggugucguggcucacaggugccccuucuucagggcacugcucucacuagaagaaaucugcaucaccuaggagguuguaguggcuguaagccaagccaaugacugacuggcagggaggacaagaggacuggccucccuuccuucaggaggaccuacuuuuccggugugauucaugcuccagacauccccccgccacucccuauacagucagggugaagcccaucccuaagugggaccacagccuuguuuagcuuuauucugcucgccaucccacuccugcacucucccaguaaacacuugagcaagaauuccugacucaggcucaacuuccagggaaccaaccuaugauaacaugcaaaacauuagcacucugccuaacacagaguaggugcucuguaagaguuuugcuauauagcauuuauuuuuauccucaaggaugaggcuacuguaucuguaagacccuugagggccaggaucaaguacauccagcagaacaucgggcuuauggcuaaugcuuaaaaagaucaugaguagauaguccauguucauggauaggaagacucaauauuuucaagauaucaguucuuccuggcuucaucuauagauucaacacaaucccaaccaaaaucuaauagagauacaagaaaagguuuuuuucaauucacauucaauacagcacgaaacacuucaccucagagaaaggaaaaaucaagguguguuuuuuuucucuuucucuuuccucuucccucuguacucaacacuuuugacaccagauguguaugguuuuccccccacgcaucaagcaaacaauucuccauuggacaccaguuugguguccucuaguucaguucaauucugauacuaucuacuuggagcuagaaucagauuccacagguugagagcucagucccucaagacucugucccauuucaggugccagucacaagcccaaguuguggccuaugcuuuugacugacuggcuauaaauugggguuccaauaacccacuccuuggauuugauuaauuugcuagaauggcugacacaacuaagggaaacauguauaccaguuuauuaaaaugauauuacaaaagauaaagaugaucagccugauagaagagaugcauagggcauaggguucccauguucucucugggcaugccacccgccagaaacuuccauguguuuagcaaccaagaagcucucuaagcccugucauccuggguuuuuaugagagccuaauuacaaaggcaugauugauuaaaucauuggccauuggugaccaacucagucuuuagccccucucuccuuccuggacguuggggguagggcugaaaguuccaacccucuaaucacaucguugguuccccuggcagccaaccuucauccugagguaucuaggagcccccagcccuacaaaaagauacuuaucacugcagauuccaaggguguuagggguugugugccagaaaaugggguuggagaccaaauauaugcagucaguccucuguauuuguggauucugcgucugcggauuuaagcuauggucgauugaaaauauuugagaaaauugcaucuuacugaacauggacaaacuuuuuuguugucauuauucccugagcaauacaguauaauuauuuacauaacauuuacauuguauuagguauuaaaaguaaucuagggauuuaagguauauggagggaugugcauaggcuguaugcaaauucucugccauuuuuuaucagaggcuugagcaucuauuuggauuuugguaucuguggaagauccuggaaccgauccccaacagucacugagggaugacuguauaucuuauuaaaagucacaauauuacagaaucccagcaaguuauucuguggguagugacaaagugauuccaaagguuauauggaaagguggaagacauagacuagcaaacacagcauuguagaacgaaaucagaggacugcaagacuuacucuaacguuccaguaaucaguacaggugauguuggcagaagaauagaaagauuaguagaacaggaucaagagcgcagaaauagacccacacaaauaucaucaacugaucuuugacaaaggggcagaggccacucaguggagaaaggauaaucauuucagaaguaugaugaauaagcuaauacuugucuugggaagaagcaagagagggguguucaggaugauaaaguccugguugaugaaggcagaugccugcagcucuuuccuggggcagggcuggcuuccaaagggugcuuguuugggcccuuuggaagggggugugcggaugugcagggcugcuuguaucauuagaauggcuguuagaauuucauucuuucuuucuuaccaugcucugucucucugccuuuguacaugugcguuugcauuucucucccuccuugucuggguaaccugugcuuuucuguaccuggucucucugucccucucugucucccuuggucucccuugucuccuccucuguccuucuuccucucuguccccugcucugcucagucaucaguaauuugaucccucuugagguccccauuucucucugucccuuuccucuuuccaagaacuacuuauugggccccgcugugugccagcuacucugauagggguggagcucaguggugaagaaggguguacaaucccugcguguauggagcuuacagucuaggaaaggagggcuguggauccacagauuccaucuaauacauauuugccucuguugagugcuguggaagagaggugcuugguauagaucauagcaggcauugggagguuuucugaguuugguuugauugagcugagacuggaagggagagcuuggcacuaaccagacuaagaacauuuucaguggugccaacaacaccacuaauguccuaugguaggaaugagugugaccuauaagagaugcuuggaggggccuguguggguggugcaagggcugggaggcagaugcuuaggccacgugggguuggaggggucaucacagggcugugguucuuaguccuuacagcaaugggacgucacgggaaggcuugaucccaaggaguggcaugagccuguuuguauuucguaaggugacuguggggauaacguacugcuuuaaggagacaagucaggaagcugccuccauagacaagagauaaugguggcuuggauugugguguuggccauggaaauggauagacguugacagauuccagagcaauuucagaaguagaauuguuaaaaucuggcuauugcuggaagacaauguuaccuugucuaaaaaaguuuuucuuuaguuauguauaauuuuucuguaaggacagaugcucaccauaggccaguucaaagauccccucuuggcugggcgugguagcuuaugcguguaaucucuguacuuuggaaggccgagacaggcggaucaccugaggucaggaguucgagacaagccugaccuauauggugaaacccugucucuacuagaaauacacauacacacacacaaauuuuccaggucugguggcggaugccuguaaucccagcuacucgggaggcugaggcaggagaaucacuugaacccaggaggcggagguugcacugagccaagauugugccacugcacuccagccugggcaacaagagcaaaacucugucucaaaaaaaaaaaaaaaaaaaaaaaaaaccaaaaaaauucccucuugaagacauuuuacugggaaagagaauuguuagacuagacagaaagagaaaagaauguuugcuuaaagucacuagacuuucacuggcagucaacugggugggugaauaacuaacuuuggaaaacaaaccuuaauaccuuucaaguuuuuagauaauugcuaaagcaguuauaucagccauguugauuuccucuaaaaaugaauuccagugccuagugucuuuaaaaagucaaaggcacaagagaaaacaaaaguaaacaaggagacuccguaggauugaagauguaaugacauaaugagauaagauguaugcauuuuauuugucuucaagucuacuguaaaaagauuuggagaaaacuggggaaauuuaaauacagaugagguguuagguuauguuauguaauuaucaucaguuuuguuagguguaagguuuuaugguucuauaagaaagugugcucauuuuuuugagauaaauuaaguauuuuggggugcaacaucaugaagucuguaaaaguacucaagcuucccccagauaaaugaaacaaacaaacaaaaaaguuucagugcacgaaaaggaucuuucuguuuguuuguuuuugaggagugaagauaaagagaagagauaaggaagacucagauuucugguuugggugaagaguggcgacauguccaucuuuuacugaccgugcguucuugggcucucagugugauagaaauugacaagagguccaaagaguuuucccagacaaggcuuuauuggagcuuaugcccaggcauaagagaagcagcacaagagaaagagaauucucuuccuggcuccccgaagacagucaggagaggaauuuuaaaggggcuaaaguaggcagggagugauauuuaagcauguagaagcggggaacuucuggcaccugcacaguguaacagcauagagagcuucuuccuguguugcauaucucauuagcguguuaaauccccaccccuaggcaugauguuuaguauuauaaugcagccaagguggaggacuggucauucuucagaucuccugcacaugcgggcaauaggguuaacucccuugaguaagauuuaagauggggcccgcuuauuuuuguuuccucgaggucugcaaucagugggaauggcccuuugaacaagauuuauagugcaaggucuggaugggguccccacuuguuauggguccccccagccagcuuguaguagaaguccucaguggggugugacgggggaugaguccuuucucuacuuucucucaccuucaucccuaauacucuaccccacaagguuuagagauaccaccccccuaauaauagggccacccauaauugagaagugucuuuaguuacuuuuuauuuugaaauaauuuuagacucuuguggaccuggcaaaaauaguacaguuucugugaaccauucauuuagcugcuccagugauaacaucuuucauaaccauaguuaucaaaaccuggacauggucgcuggugcagugcuauuaaugaaacugcagaucuuaauugguuuucaccauuuuuuacauacacuccguuuucuuguuauuuugcauuuguuuugguguguaguucuacgaaaucuugucacguguagguggguaugucuaccaccguacaugcacaggauguagaugacgugcuguuuuuuuacucuuuucacauggccuuuuuguuguuguuguuguuguuguugaggcgaagucucacucugucacccaggcuggagugcaguggcguggucucggcucccugcaaccuccgccucccgaguucaggcgauucuucugccucauccucccaaguagcugguacaacuggccugugccaccaagcccagcuacuuuuuguauucuuacuagagaugggguuucaccuuguuggccaggcuggucucgaauuccugaccucaagugaucugcccgccuuggccucccaaagugcugggauuacaggcgugggccaccagugcccggcuuguuuucacauggcuuuugcccacugagcuguuucuaauugagcuagacccacgguaagaacucagaaagcuuugagugcaucccauccccucuccucuaacuuaauugucugcucuccuccucuagcucccauuguugccugugaauggccacgaaccucuccuguguuucacuaugacucuaagaugccuuugcucaccucuggacuucguucuguccucuuccuuaauuccaggccacagccaccucuucuugcugcaaagcugagaucuccuuucucacucucaucuccaggagugcuggaguucaaagguacaccaggguuugauaacacuuucuuccaugguagacaagguggucccugccacucccaggcucauguuuuaccagcuugggagcagccguggaggggagguuuuaccaguaguccuggccaaauaagucccaggaggaugcugauggugcagcugggccaugugucuguccccgaaccagucacugagccagggcacuugggucauucccuggccccugcugucgccuucagcuugugguugaagguggugggggugaaucagcucuaucuaaagcacauggaaugggugcaucccaugaaaagaugauuguuguuguaguuuuucagaagaaagggaaagaagggacugguugagcuuguugagcuugugucucugugccaguccagaguucacuggucaucuuguagggggaaggaggagucaccuuugagucagucagguugcuauccuugccugguagguuuugaccaggaguagauggagucacauggcagcagaaguugcagaacggaaggauuucuuacuuguuucuguuaucuauugcuauacaacaaacuaucccaguguuuaguggcuuaagacaacaaucauuuuauuuauugcacauauuucuacaaucugggcauggguggggacugggagagcuugucuguguuccacauguugucagcuggggcagcucacuggggccagaggauccacuucuaagaugguccagugcucuguggcuguuggcugggggcucagcugggcuguuggcugagggcauugauucuucuuccauggccucuccauagggcuaacuugggcuucuuacagcaugguggucuccagguagucugacuucuuacacagaggcuggcuucccccagagcacaaaauggaagguaccaggccuucuuaaguauuaggccccaggcugggcccgcuggcucacgccuguaauccuagcacuuugggaggcugaggugggcagaucacuugaggucaggaauucaagaccagccuggccaacaugaugaaaccccaucucuacuaaaaauacaaaaacuagccgggcaugguggcacaugccuguaaucccagcuacuccugaggcucaggcaggauaauuguuugaaccugggaggcagacguugcagugagcugagaucaugccacugcacuccagacugggugacagagugagauucugucucaaaaaaaaaaaacaaaacaacaaaaaaaaaccauuagacccugaacugguacagcaucauuuaugccagcgugccagugcuccuaaccuuuuugguaccagugaccaguuucauagaagacaguuuuuccacagauggugggggcaguggggggauugcuuuaggauaaaacuguucuacuucagaucaucaggcauuagauuccaauaaggaccacacaaccuggaucccucgcaugcguaguucaccguaggguuugcgccccuaugagaaucugaugccgcugcugaucugacaguugguggagcucagauaauagugcuuacuugccgguaccaguccauggccuggggguuggggaaucccugauuuauacuacauuuuauugguuaaaacaggucacagagacaaccuggauugaagggcagcuggcuauauaaggcauaaauacuggaggcuguggcccauuaguaacaguccauuacucuggacuguuaccagagucauaguuuaccacucucuucucacaggcccugugauauccagaaccccuguuaccauccccaacgcugggguuggccucuuauuauuauuuuuaauuugaaucaguuagugccuucauuuccucuucccccuuuaauugagccacagagcauuuguagcuuuugggacucaagggaaaaggucaucaaggucaaggucaaccggacaguugaccuuuaggcugccuagagugaucucuagugagcaucaauuuggucucuuguuuuuuuuugguagaauagucugugcuuauuuccugaaaucucaguugcauuacaaaaauuaauuguccuaguuuaaaaugugucugucugagaaacagggugagcggaaaccccaaacucuucagacuccagggguuugugggguggcagcaaaugcccggguagggucuuagcccuuuguccauuuccagaaggaggggacacugaguccagacgcagagauagcuuugcgggauccuguuggggaaggaaggagccaggcugugccugggcugcaguuguguggcugcauccucagguggagggaacuccagcuucuaauuggcucauguuaauuucauuuuaguggauaucauggaaauaaaagaaauccgcccagggaagaacuccaaagauuucgagcgagcaaaagcaguucgccagaaagaagacugcugcuucaccauccuauauggcacucaguucguccucagcacgcucagcuuggcagguaggugcauguuucugugccuuucuccuucccugugccuuagugucuuccugaagaaguucgcuaauagcagaaugcucaccccugccugcucacugauguguauuuggggucaugguuuugaaucccagcccugccccuuucuagcugugugucuuuaggugagugacuuaaccucucugagcugcaguuugcucagcugugaaauggggagaauaauaaugccuauuucauggggguauugugaggaguauguuaagugucucucuggcucaugcugagagcugaauaagugaugauuagauaguuuuaacacugaaggccaggcucuguuggaugaaaaauguacgcugggcucaucccuguaaucccagcacuuugggagccugaggcgggcagaucacuugaggucaggaguuugagaccagcauggccaacauggugaaacccugucucuacuaaaaauacaaaaacuagcugggugugguggugcgcaccuguagucacagcuauuugaaaggcugaggcacaagaauugcuugaaccagugagccaagauugcaucacuccccuacagucugggugacagagcaagacucugucucaaaaaaaaaaaaaaaagagaagaaaaagaaaaauguaaccuguuuucuuccagcagauguggcucagcaaaucugauugaucugaaggaacuguccugagaucuucuguugcacacacacaugcacuuuccucacuuuacucaggggcagaagcuuguaucuacuuucaaguucaguccuagaauuuauugacuuagaaguauauguauauuaauuaagaaaauaaauacgauuaaaauagaccaaagugggugaggcagcugucaaaguugagcaauauagggacauuuacuuuucggucaaauaacuuauuaauuucucauucauucuuuuacuacaugucuuuugagccuauacucuguguuagguuguguacaugccagugagcuaggaagaugaaugggaccuggugccgccuuuaagaagcucucagucgacuuggggagacagauguguguacugggauaagaccuagugcaagcaugauacagugugcugugaauguuuaauuccagggaagcuuggcagagaaggugacuuuuacauuggguuuugaggcuucaguaggaguuuggaggaaagagagggagggugcuccagggaaaggcuguggugugugccagggcuuggaggagggaaauagcaugucggauguaggaaaugaggagcgaaugucugacugaugauauggagggggaguugguagagaugggguaggagggcaaggcccguggcggugaagcuucacaccucugucuccuuagccccaccugcaggcugagcccugacccccuguucuuaauuugguaaggagaccagaagaacccgggucuuggaagccaggaugugaacuuugauauauaucccacucuuggucccucuuccggaacccuaaauucaaggucagcacagugauggucaagauuuugauucacauuccaucuucucacuuacuggcucugagacaaacucagcccuucagagccucaguuuccuccgcaucugugugggaagaugagagcagcagucucugccauggguguacggacugauaaaguaccuggugcuuaaggagaggcuucauaguuccaugagguguuugcacuguuagcuucauuuuacaggugagaugaggcacagaguaggguuaaguaaccuccugaauguuacacagcccugaaguggugcagugggacuugagcuaugaucuuccuuuugccagaugccaagcucuuaaccacuccucaaugccgcuuauuaacaaggguaauagcaaccauggguauuagcaagccauacucuccuggguauuagcaagcucuacuugcugucccucugugccaucuugauuagaagcaggggagauacugacagcugcuuaggguuguggugcagauuauuccagauucugcauuuuauuaguuagcauaggguuaaaagcuaacacucuuuaauaaaacaaaaagcuaaaucccuaagccagugguacucauccaugggaagcugaauacugcccucccacgaugcccauguccuaaucccgggaacuugugaauauauuauccucuauggaaaaggagacuuggcgggugugguuaaauugaggaucuugagaugggaaauauccuggacuaucugggugucuaguggaaucacaaggguucuuagauacccgggaaggucauucccagagaaagagaugugaggauggaaacaaaggucagcagaugagaggccaugagcuaaggaauguaggcagccuccagaagcugggaaaggugaguaaacagauucuuccccagagcuuucagaaggaauucagagaucucaugcaaccagucuauuuuagacuucuggccucucuaacagucugaaaauaaaucuauauuacuuuaagucacuaaguuuguggucauuuguuauagcagcagaggagacugaugacugaaccuuugauauacuuuggcaccaggcagguguuuccaccuguugaugucuccgucaucccucucuucugguuuaauuacuuuagggugggaccuaaguauugggguuuugaaaagccuucaagugauucuccugagcagcugggguugagaaacucugcucuggaguuggacaccuggguuugaauuccucagcuuuuucaucccuggagucagugugcugccaggguaagauaauggauucuuguuuaaaauccuguaucuuccacugucucagugugcucuggcuacuguaaugaaaugcuguagacuggggguuuaaacaucaggcauuuauuuucucacaauucugggggcugggaaugccaagaucaagaugcuggaugguugaguucuggugagggcucucuuccugacuugcagacagcugccuucuugccaugugcucacauggcuuuuccucagggugugcuuggauagagagggagcucuagucucucuuucucuucucuaaaaaggcauuaauccccucauggaggccccacucucauuacuucaucuaaaccuaaauaccucacaaaggcccuaccucagggguuagagauucaacauaugaauucggaaggaaugcaaauauucagucuguaauggcugcuaugagcuguguggccuuggacacaugacugaaccugucuuagguucagugguuucuccauguguuaaaugggaauauaauaguacuucccuugugggaucaauauaggaaaaacacuuagaacaaugucuaguauauauauguaguuagugcucaaaugauguuaacaaugucauagugauaguucccaccacucccuccauucuuagcugauuccauuuggcacaggaaauaacccacuugucaucccugugguacaaagcucaucaugaauguguggccccaucucagacaaaaagcagguccuagggccaugacggugugaaaggggaugcuuucuuugccuucugcaaaacuagaaaccagcauaggcuucucccaucuucgugaucuguauggggcagggcuuuguaagcagacgucuucccaggaauuaacacagcauuucuguucccuuucuccacuccagcugacucuaaagaggaugcaguuaacuggcucucuggcuugaaaaucuuacaccaggaagcgaugaaugcguccacgcccaccauuaucgagagguaguuggcuuuugccuguugauuugcguaguugcugauuccuuuauucugcugccuuuagccaacaugggcuacaggggggaaaaaaaaaaaaagggacauugguuuuuugaggcucguugagugucuuguaugcaaugggugccuaguagcggugugggcucuacaguuuuucaaauaagagcauuucccugugcuaguuuucagcguuggccuauuggagugaguggugcauuggacucgagauagaaacauuccugggguaugugcugggggaaaacagggcuuccuucuuaaaggauuuaauaagagauucaguggacugaucaaaggacagauacagggucuggaauuuuccaccuaucacucccuccuggguugaugaagaccucaagacugucucuucagugucaugggagucuagaugggcauuggggugugaguuauuuuccuuccacuaaaucaaaguccucuacuuuuuacuauuuuucuuucuagcuuuuuggggauuaaaugacuaucaucagaaggaauugacaauguaaagaaaccuggccuuuuugaguugaaaucuuggcuuagauaggccuuuuccacacuaggaggaaacugcuucccaagcugcccuuguuagaaaguuggaagacuccuccuuuugguuccaguuccuuuugugcacauuccguaggacucacuuagacuugugcuauuuucuaauuuucucuuucucucuuucuuuugucucauauuucuuuccaguuggcugagaaagcagauauauucuguggaucaaaccagaagaaacagguaagagucauucaguuuuuuucugaucacuuuggauuucgauccucauucuaucuuuaaaccuuccaagggggugggagcaugacuugucgggagcaagguccucacugcguccauugugaucugcggaugccauguuggguccugggguugaggaugacaaaauccuccuccuggagggagccucuauuccgcagaaaauucaaguacagccucagagaugaucucugccauggggcauuuggaccucaucacaaauauuugagcaccuuuaaaguccugguaauacagcaguaaccacacuccugauggcaccagcccaugcuuugugacaggagagagauugauugaccgugaagaaguaaaccaggugguucuuuuuuuuuuuugagacggagucucgcucuuucgcccaggcuggagugcaguggcaugaucucagcucacugcgagcuccgccuccuggguucaugccauucuccugccucagccucccaaguaccuaggacuacaggcacccgccaccaugcccggcuaauuuuuuuuguauuuuuaguagagacaggguuucaccauguucggcaggauggucuugaacuccugaccuugugauccgcccaccuuggccucccaaaguccugggauuacaggcaugagccaccgcgcccggccaccaggugguucuaagggcugguagagauguguugggugaugugauaacguauauucaguuuacuugacuuuuucacuuaaaaguaccucuuggagaagcucccuaucaguccugcacaaagcucuaugacggacuauuauuauuauuuuuuagaggcagggucucugucuguugcccagacuggagggcaguggcacagucauagcucgcugcagccguaaaguccugggcucaaacgauccucccgccucagccuccugaguagcugggaacuacagguguguuucaccaugccuggcuuauuuacuauuauuauuauuauuauuauuauuauuauuuuuuuuuuuuuuuguaaaggugaagucuuacccagacauuuuuuuuuaaaaaaagcaaacgcaguuuugguuuuucuuuagauuaaugcauugucauuucggaaaucauuuccguguugaugcacagagcgcugcucccaauccuuuaucauuacugugauuaaugcugcuguggaaaccuuugggucuaucuuucuguaaacucauuugagggagcugugagugggguaaauucucagaaacgaauaccagcagcacagcguuugcuggucuaauaguuugauagcgagagguagcaauuuguauaauauuucuaccaguggggcaagagggcacccuuuccugaugauuuauugugccauuagacuuugaucuuuguucaucugcaaccgaggcaaccaaguguuuuugcuuaaacuugcuuucuuuaugggugagguugagcauuuuuaauucauuauguuuuugagguaugauucagcucuugauaauguaaugauaaaaacuaccauuuggccaggcgcagugguguacaccuauauucccagcacuuugggaggcagaggcaggcagauugccugagcucaggaguucgagaccagccugggcaacacgguaaaacccugucucuacuaaaauacaaaaaauuagccaggcaugguagcacgcuccuguagucccagcuacucagccucaggaggcugaggcaggagaauugcuugaacccgggagguggagguugcagugagccgagaucgcgccacucuacuguggccugggugacagagcaagacuccgucucaaaaaagcaaaacaaaaccaaccaaacaaaaaacaacaaaaaaacccaccacgacaagaaaaaaccaaaaaaaccaaaaccaaaaccaaaaccaaacccuaccauuuauugaacaaccguguauuuggcaugccagggauugcauugagcucuucaguccuugucucauguuagccucacgugaggcaccuuauuuuuuugguaaaauauuccuuucauucauucuugauuuauuuaugucauuauccuauguggauaugucauuaucccaucuagaugugucauuauccuaguuaauauccaauaacuaaacucugucagcucucuuauuuuguuccugaaaaucuuuccaucuugaaggugacuucgugucuggucaguguccucuguuacuuguuagcuucaggguuugggugagcuucccugguuucuucacaugcccgaugggaggauuuggaacuauuaacuaggaagugguuaaaagucuaguaauguuaggucagccauuagcucacuccauguuuuucuguccaccugccuuucucuccguccucuucuucucauccaaaaugcccugccugcuccgccacgcugggccacccucucguguuacugagguggaucaaaugaggugcuuguguuggaagauuugguacacacuggucucuuucagccucggaggugaugccucuucugacuuuucuuucucuguggcuuaugaugauucauagcugagauuggcacagggcugagagagggagccacccucagugccucucuccacgcggugcugguaugguauggccaaucuggcucugaagucggcucuucguuugugaggucaagaaauggauaccacccucuugcucaggaggcauucuggcaaguccugcauagagauccaucuucccaucggcugguccaggacccucugcagagagaaacuuuucuguuucuggacugaguucaucccugugugcucaccggcuuccucuccucuaccucccucccagugggcagagcccugcucucugucaacauguggaaaaucccaccuuuccugugguucugggaagccuggagggagcuuugcaaaagaaacuuugaccaagaugccaaugaaagagcaacugacuucuguccugccaauuucccucccuuuccugucacccacgagacgaaucguguuuccugaaggaaaacaaaggagccacagaggcagaggaaagacugaaggcgagagggggcaggcucagggcuggcccagcccgggcaauggacaagucuuagguguuuugcuuggcccaagcacgcuguuucauuuuuugacuuuucuagaggcaaaugguagcagcgggcauuuguuuacagccuucuuugcagccguggcuguaauaagcacuuuacauccuuaggauaugcucuuggcugacgguugagcuaggugcucucagacacguuuucuaugugaggacacugaggcccagagagguuaagugacuugacuaaagcagcccagguugucagggguggcaccaggguuugcagacuuacuuuccccacugguguugcuuuuccuuuuuucuuuuuucuuuuuuuaaaugugcuacuggccgagcaugguggcugacaccuguaauccuaacaguuugggaggccaaggcggguggaucgcuugagcucaggaguuggagaccagcuugggcaacauggggaaacccugucuauacagaaaguacaaaaaaguuagcuggguguaguggugcacauuuguaguccugcuacuugagaggcugaggugggaggaucaucugagcccagggaggucaaggcugcagugaaccaugauugugccacugagcuccagccugggcaacagagugagaucccaucucaaaaacaaaaacaaaacaaaacaaaaccaaaaacaacgaaaauaaaaacaauugugcuguugagagcugggggaaaugcagaaaucuucccuuccccacccugaccaaucaccuuaugauuaaaaaaaauuaaaaacaaauguuaaaauuuguuuuauugugguaacaacaaugaaacauagaacaacauugaucauuuuaaccguucuuagauauguacuucugugggaugaaguauaucauguugucaugcucccgucaccaccauccaucuccagaacuuuuuaucaucucaaacugaggcucugcagccauuaagcaguaacuccccauugauucucucuuuagccccuggaaaucaccacucuacugucugucucucuggauuggauugcuccagguaccucauauaaguggacuagcagaauauuuguccuuuuguaucuggcuuauuucacuuaguguaaugucuccaaguuucaucuguguuguagcauguguuagaaucuucuuccuuuuuaaggcugaauaauauuccauuguacagauagaccacauuuugcuuaucuacuucuccaucgauggacacuugaguugcuuccacguuuuggcaauugugaauagugcugcugcgaacauggguguacaaaucuguuugagucucugcuuuaaauuccucuguguauauauccagaagcugaauugcuggaucaguugcuggauugcuguguauauauccagaagcugaauugcuggauuuauuuugccggauugcuauacuguuuucuguagcagcuacaccuucccaaggcagugcacagguuucuguuuucuucauauccucaccaacacuuacuuccuuucccuccucugcccuugcccccuuggcguauaacauuggauuugcauaaguagaaugugcacuucccuuuguccuuuagcccuggcagggacagaggaacuacucuaccaggagguggcaaagggugaggggguugcagguggaaggcaggugggugaguccauuuaucucauucagcgugaaugcaaauaggcuuccuauuugagacuccagaauguuagagucaccuggggaagcuuuggcagagccacggcaguagugauucggguuuuacuguucugggcauggccucuggcguugcaaauuuuuuaaauaagauucuucugugaagcugggguugaaaauuagggcugucuagagggcaauuuucaaaucugagcaugcaccggaauccccuggaggauuugugaaaguggaggcugcugggcuccaucucacaguggcugauugaguagguggugggcagggcucaagaauuugcauuucaaccaauccccaggugauguagaugcugcuggucugggagcuacuuagagaagcagaacucuggggcugcgcuguccagcagggcaccccucaccacagguggccauuucaacaaaacaaaacaaaaugaaauaaaauacuuagcuccucaguggaacuagcugcauuucaggggcucagcagccccguguggcuagcagcuacuaccucagacagcacagaugucuccaucauuguugaaaguucugucagauggugcugagguuuaaaucucagaucucacacuaacucauugugugaauugggguaaaugauuuaauuucugugggccucaguuuccucauguguaaaagauaaaauaauaguucccgccucccagggcagaugugaggcuucaggaguuaauaugugaagggugcguggaccugccuggcucaugguaaacacuugacgaauguuucuuauugccauuguugcuacaaaagagccgggggcaguggaggugccggcccagccucagcauggcugguaagugucacggggcugccauccuuaaugguuuggugauggcugccugggugcgggaguugaagaacccugggggccucccgggcugagcagggaggacacugugauuguucagugcugucugccaugggagagggaggggcuguugguaacucauucagggaauaguugccguccuucuccaaagggauucccuuguuuccuaacccacagcccuagguugagcucccaggaaacaugaucugagacgcagguuugugugcaggaggcuuacuagggagugcagggucaucacccugggggaaggaaggcagcuggaacaggcagcuggggagucacaaccauggccugggcacaccugauggggagcucugagcauggccuguggagcuguccugaauugagacuagagggccaggccuuuguucccuugcguggacugggucagagcuggcugccuuggaaggggcuuugaccugggcgaggcacucucuguaggggauggcagguugcagagaggggugaagcugagccguuggcuuccuccccugcagcgaugggggcucagccugccugugcugguuuuggucgggcugugcagcacgacacacacacauccagaggugggagugagggaggggcucgccuagggagaaagcgggugaggcugucccagagcuaggagcccaaagaagcucucagccuccaguguuuacauuguaaggggaggccuuuggaccaggugggcucccaugucccaggugcuuggaugcucaagccccugguuccuggguuuucuccacuuguucuugagcagcugcucuggcaccccaggccccucagucucucuguuccuggacaugggaugguuccuuugcccugcugcugucugggcuccuggggggcccuggccucuuccuugcucccaggaugggcuccacuggggcaccagcaugagaggacgcuggccucucccuugcucccaggaugagcuccacuggggcagcagcgugagaggacgcuggccucucccuugcucccaggaugggcuccacugggcaccagcaugagaggacgcuggccucucccuugcucccagggugagcuccaacuggggcaccagcaugagaggacgcuggccucucccuugcucccaggaugagcuccacuggggcaccagcaugagaggacgcuggccucucccuuucucccaggaugggcuccacuggggcaccagcgugagaggacgcuggccucucccuuucucccaggaugggcuccacuggggcaccagcaugagaggacgcuggccucucccuugcucccaggaugggcuccacugggcaccagcaugagaggaugcuggucucucccuugcucccagggugagcuccaacuggggcaccagcaugagaggacgcuggccucucccuugcucccaggaugagcuccacuggggcaccagcaugagaggacgcuggccucucccuugcucccaggaugagcuccacuggggcaccagcaugagaggaugcuagccucucccuuucucccaggaugggcuccacuggggcaccagcaugagaggacgcuggccucucccuugcucccagguugagcuccacuggggcaccagcaugagaggacgcuggccucucccuugcucccaggaugagcuccacuggggcaccagcaugagaggacgcuagccucucccuuucucccaggauggucuccacuggggcaccagcaugagaggacgcuggccucucccuugcucccaggaugagcuccacuggggcaccagcaugagaggacguggccucucccuugcucccaagaugagcuccacuggggcacuagcaugagaggaugcuggccucucccuugcucccaggaugagcuccacuggggcaccagcgugagaggacgcuggccucucccuugcucccaggaugggcuccacugggcaccagcaugagaggacacuggccucucccuugcucccaggaugggcuccacuggggcaccagcaugaucuggcuccucuccccacgaccccucucgcugccgcucugguagcgccuguucccacugcuccuccaccuucauccugcccuggcccagcuguuccuuggaccacucccagggcugaggcagaaagguucuugcaagccccuggggcaacuucccuagccugcuggccgcugugcccagccagccccagcuggcccaacagggacuuuuucugcccucaaggucugucugugaaagccgugggugcugucccugugguaccaguaaguggguggggagcaucuugucauuugaagucugugcuguuacagaggcccuuagaaccagaggaaaggcuggagguggggacacaggauggccagagucacacuggaccgucuccagggcagcggcugggcagugacgcgcuacuuccuuccgcaugccacagcagaagcugggaggaugguacagggaaacuaggugguuuucuccugcaagguggggcgagcuuccucucuugaccacucugucucagcucugcuggacacuuggcuccagccagaagggucuggaucucauauucuugacccacccaccccacuaauuucacuucuccuucuugugugagcuacucgcuuggaggcagucagguguggucauuaugggcacacuggguuggaguuugaggcuagcacagauaagguaccaaacugaucggugccucaguuuccucaccuggaagauggagaugaucaugguaccugccuuguaaaauuguucaaacaucaaacaggugaaugugcauauaaggcaccaccuagaacaacaccugucaccugauaagcacuauugaaguuucagcuuuuguuacuauuguuacugcugcugcugcuccuuuugccugggacguguucucccuugcuucccucccuuuucuuuuuuauuuuuggagauggagucuugcucugucacccaggcuggagugcaguggcgugaucucggcucacugcaagcuccgccucccgaauucacgccauucuucugccucagccuccugaguagcugggacuacaggcgccugcuaccaugccuggcuaauuuuuuuuguauuuuuaguagagacgggguuucaccguguuagccaggauggucucgauccucugaccucgugauccgcccgccucagccucccaaagugcugggauuacaggcgugagccaccaccgugccuggcccucgcuucccgcuucagcugaaccucacuauguggcuucgaagaaacacucaugcagauuccugugaccgagcacuggaauuugauucaaauccaggcucugcugccugccauccagcucuaagcccugaguuguguacccaugugacaccccacccuuggcuguucugagcccugggggucaaccauguguacuuugcagaagguagaaucuggugaacaauuaggcaacuuuaaugccuggaugaccccagggcagccuggcacacaguaggugcucauguaggccuuguuccuucccacuuccccucccuggcccuuagugaccuugccuugcucugaaccccaguggcauuaaaagaaaccuuuauuuuuuuacuuauuuuugggggugcaggggguccccacuuacucugcaucccucuugucucuucacagugucagacuagagucaaauucagcugggucuuuccuggcugauucugccaagcccguccugugguuuugguuccucuggguggcagguagagucaguaggagucuuguucauccauucaugugugucgcuaauuaggugacaaagcauuuggcuacaugaagagugucauaguuacuccugauguuuacccaggcuucauugaauuucuucacuuugacauucagaguccugggcagaaaucacaucaugucaacaccuauauugggccuuuggcauuucuguggcauuuuguauugagauuaucuggucauuugacaucauuuucugcccacacugaaucuccugcaagaccuuccuccaugaccauuccugaaggguggagaccagcccuucucacugggacaucacccuauacuggggaucuccaguguaggugccuccucauuggggcaucacuguacgcuauaaaucucuuaugugaccuaugucccuggacauaccugaaggguggagaccagcccuccuuauuggggcaucacccuacccugugagucugcuaugugacccauguccauggacauugcuugagccuugcucauugaagugucacccuuaccuugacucaaugucuuguucccaguuagugguccauaaauaacuguugaccaggcucucucauagagggcugccugaggugggaacugaugggagcagcuaaauccugugcuguugaaaacccucaaggugacagaacugggucucccucuuuugcagcaucagucuccgagaguugaagaccaucuugccccugaucaacuuuaaagugagcagugccaaguuccuuaaagauaaguuugugguaaguuucauggcucagccugggaauuuuaugaaugcggagugacuuagccucucucaugaagccguggcuugccuuugaguuccguggaauagugcacaagaaaauccuuugccuccagaguacaucuuaguucagacagagggaucauggacauaucugaggaccaucgucucaauccuagcagagaauguaaucaauaaagaccauguuuacugagcucuuggacuuggaacaucuacccucagaccuguuuuccauuaguccagcuuucccuauuucccugaccauacugcagcccauuuuuucccuagugaaaugaaugcauguaugucuuuuggaaaauauuaugaaagauuccuuguguaggguaccaggaccguggcauuuuguaugcaaguccugguaguguagcugucagaguuggcucuuuuuucuucuguuucuccaaccauccauccuuccauacaucauuaaauuuauuuuguuguguaaucaaguuauuggugggucugggcaguaaagccacuccaugagugaugggauauaguagagcaggugaggcaaggauggagacaaugggcaccgauuuuugcuuacagggaaauacucauucuucuuaggaaaugagcaacccugcauccaaacagccccaguuggaggacuccaaugcccauuuucaauaucagcuccauuacaagguuccucagugcaaaaagcucauuucauuuuuguauuaaugagcuccuggaaaaauuaucccauuuuauugcuuaucaagcauccuuugaccugcccccaauauuccacauuaauccaauaauagaaaaagagaaaaggguaggucagaagaggagagagaugggagaagcauuuaccauugauugcuacacaguugccauuuaauucuuuaucaaguauuuacugaaccagguguuuugcagguauguuguucacuuucagggaagcccuaggagcauaguagugguucucccauuuuacagguaaagaaaacugaggguuugaaagggucaaggaaauugcccaaagccauaaagcaauuaauuggagcugaguucugucugacucccaaugcuuuacaaaaugaccuauauguacguacucuacaaauaugucugaaguuggaaguccaaagagaguguuuucugcccaaaaaaggaggaguuacgcaucaugucucuuggaaaccuggcugagacucuucccuuuuggggcucaaaggagggucuuacuugguaggugucucugugaguauguuuucccagacagggggauuagggaacguguggaggguuuugauucagaggaauaugaauuugauuuuagccaauguuguagaaaagccauguuaaauagcaugacuuuuuccuuucaaaagccaugacacugaaacaauguggucauagcugucucuucagcaugccaauaaaauagcaugccauuucugaaacaaaaauuauucuauaaauagcauggagccauucuuacgguggacaucaaaaaucauguggucacuuuuuucauauuuacaggaaauaggagcacacaaagaugagcucagcuuugaacaguuccaucucuucuauaaaaaacuuauguuugaacagcaaaaaucgguaagaugauucuugagcaagugaucaagugauguuucuguuuuccauguauuuccaagucuggcauguuccuaagaaacccacaagaaguguugaaucuccauuuuagucaaggaaacauaaaugagaaugaugaaagcauaccauuuucauccauuagauuggcaaaauucuuuaaccaugacagagcugugggcaaaauguagagaaaugguguucauaugccuuccugguggaaaugcgaauggccauaaguuugauuggaauuugaucugagucuguuaaaaaagugcaacucacucuacugcauuauuucauucugaaaggaaauuuagcaaauggcuguuauuauuaauagccaucuccagauugaggaauuauauauauguuucuucuuuuuacacguuuguuuguuuguuuugagauagagucucacucuguugcccaggcuggagugcaguggugugaucuugguucacugcaaccuuugccucccggguucaagcgauucuugugccuuagccuccccaguagcugggauugcagacgugcgccaccacgcccagcuaauuuuguauuuuuaguagagaugggguuuugccgcauugggugggcaggucucgaacuucuaaccucaacugaucggcccgccuccacuuccuaaagugcugggauuacaggugugagccacugugcccagcccuuuauauacuuuuauucauauuuuuuaugagggcauauuuuuugauuaaaauaauagacuauuuaaaaauuaagaggguguauguuuugaucugacaguggcauccuggggacucuguuuuaugaaagggaaaacaucggggccugagaauauauuaucggauuguuuauugcagcauuacuuaugcuggcaaaguaccugggcaccaucugaaugucucaauggaggaauugcuggguaaauuauggucuauccauauuaugugacauuaugcagcugauuaagaagcaugugucaguucucuuuccauuaaucugagaugauauuugugacauuuugugaugaaagccagcagcagauuuacaucaggagucaggucugcuauuuuguuaaaaaucauagaauacaggccaggugcagugguugacgccuguaaccccagcacuuugggagcccaggcggguggaucauuugaggucaggaguuugagaugagccuggucaacauggcaaaaccccaucucuacuaaaaauacaaaaauuagccaggcaugguggugugcacccguaaucccagcuacuugggaggguaaggcaggagaaucacuugaaccugggaggcggagguugcagugagccgagauugcacuacugcacuccagccugggcaacagagugagacuccaucucaaaacaaacacaaaaacagagaaugcaauaauccuccuuuugcuccuuuuuaugagcaaggggagaguauggaagaaagcaccucacauuuaauguugauuuugugugugugugcuggaagggguugggaagauaggcaggaaggauaguuaccuuuucuuugcacagcucauuuucugugauauguuccaaguaacauguuaccuuugcaauaaaaaguuccauagagcauaaaguuuuaaaauugagacuauucugugcgaugcaccuagcacaguaccugguagguggcacacauucaauaaguaggggcugcuguuguugcugucaggaaagggcuuugcagacugcaaaagaguucccagagaaaggugugagggcuuggggaguaccuggaacuuggagucagguggcugugguuucugcaguuagcugcaugaucuuggaugaaccacugacugcuccuagccucagucuucuccucugugcaaugggagguugggaguugugaagacaggcauuuuuaagugaugagcaugaauguuccuagaagacagucauuaauugcuuucugcaugcagagcugugggcuggccacacagugaggccaccugaugggugaccacuggccgugggacuuuggauguaucugaguuagagaaaugggagggccauuuccuaucugcccagauuuggggaaaacauauuucuuagaguggaucauugaauugcaauguguucauuuuuucucauauauaauaauuaguuauuuguuugccaaaugaaauagaaagauugcaggcuugggaguugggagaacuggauucuagacccacuugaccucuaacugaccaaguaauguugggggaagccaucucuguccucucacuuagccuuuucuauaaaaugaagguauuaaaugagaucaaugguuauaaaacuuuuaauacucuuuaauccccucuccuuuagacaggaaacuguaacaaccacaacaaaaaccaugauucauaaaagcuuaucagaauacuuuuuaagguuaaaaccuguaacuuuaaaaauaguccuugagaacaaugacgugugucauugaacauagaacaugucauagaauaaugaugacagugugcguaugaaauuuggaauggugacgauugucaucuuaugcaauugaccaggauugagaaaagcucgauuuacucaagauaaguaguugcaaauaacaguuuuuuuuuuuuuaauaauaguuuaccuugaaauuucaagaugcuguguugucagacagaugucaggcaaaguuugaaaauaagauuugcacauggcugggagcaguagcucacgccuguaaucccaccacuuugggaggccaaggcaggaggauccuuugagcucaggaguuugagacuagccugggcaacauagugagaccuagucuguauuauuaaauaauauuaaaaauuaaaaaaagaagauuugcacaaaagcuguuucaccugcuaccagauuaacccauucauugaugguuuccacugugguaacauuccacaugagagguauuucaaccuguacuuuaauuauggcucuuauuaaggcuagucuguguguuugugucuaugagggagaaacauaaauuggaaucagaguuuuacaaaaugucagaacccucuggggugcccuagauugccccguguggaacuuuguauggcaaagauucugccgauaccaaagguugaccccugguggccagaaugccacauugagccugccccugguuguacuugaucuaaugguuuaaauauguuaaaaauuaauugccuacauuuaaaacuugagagauuauauuauauauuaaaaucuagauauuuggcuucccuuaggaaaaaaaucgagaucuggcuauaaauagggucacaucucgccauggaacgguccacuuucucuguauugacccagccccauacagcucugucugcucauuuauguugcuuaccugaccccaaagaaguuuugcuuuggcaacccucaucuccacuguuugaggguauaacucuccaguuuggucacugcauuuuaaaaauuuaauuuagugacagauuugaauaacaaagucccaagcuauguagauggcuucuggccagcucuaagaaccucacugcuguuguguagguaaaugcccauccccuaaccuguuagcaaauuguuuacuuccuguuccuggcuggaagcacagggcagagaaaaguaccuguuuugugauuuggggggaaugagggccuagcuggauuucucaggcuccugcaggagacagagcuauuuauggugacuuauaauccccagaacuaaauccagggaguggguucaugcuuaucagcagccaaaugguuuccaucgugagcuugcuaguuccucuuugugucuaaccaccugccuacguuccaccucucgagcuucagaguuuccaaaaguuuggcagcagcaggaggauaagaaauguaaucucacguuugugucucccuggugaggggauauaccucuaacuaggcuguaauaacaguaucauuaacaaagaugauagccaacauuuucucagguggacuauuugcuaggcacuauccuauguguuuuuuuuuuuuuuuuuuuuuuuuuuuuuauuugagacagagucuuucucuguugcccaggcuggagugcaauggcacgaucuugauucacugcaaccucuuccuuccggguucaagcgauucuccugccucagccuucugaguagcugggauuacaggcaugcaccaucacgccuggcuaauuuuuguauuuuuaauugaaacgggguuucaccguguuggccaggcuagucucgaacuccugaccucaggugauccucccgccuuggccucccaaggugcugggauuacaggugugagccaucaugcccaaccugcucuauguguuuuguauacauuuaauuccccccuagaggccugugcaagagcuacuguuguuauugccauuuuagggauuaagaaacugagguccagagagguuacuuugcugaaggccuguuuacugcaggguaguaagcugcagagcuaggauuugauuuucugcccaacuuugacgcauagccauggaauacuucuuaauuuuugaauccuuuguauuaaagaaaauguaaagcauauagaaguagagagaauagcguaacagacccccauguaucaucagcugacuucagccauuaucaccuugucacugcccucacccaagucccuuuucucacacuuugcagcagacaucaagcagcguaucaggucaucugccaauacuguaauuuaauaccuggcuacgugacugcuacccugcuaccuccugaucaaaccugugaaguccccugugguuacagcauucuuacauaaaaauagaaagcacuugcaaaaaaucaaaaagaaaauugagaaggcugcuaacguaucucugguuguuccuaugauccaguaaggcauugaaggauuauucugccggauuuuacaugggugugagcaugggggaagugagugaugagcguucugugacgauguuuguggaggagcucagagaucuugcaguuuauucuuauugucaguggcuggcaagaggagaguccacaguggagaaguuagauagaaucucugguuagcuuuucuuuuucuuucuuuuuuuuuuuuuuuuuuuuuguuuuugagacagggucucacuuugucaccgaggcuggggugcagugguacaaucauggcucacugcagccucgaacucccuggcucagaugauucucccaccucagccuccggaguaccugggaccacaggcgugugccaccaugcaggcuaauuuuuguauuuuuuguagagacaguuucaccauguuacccaggcuaggcuugaacuccugggcucaagugauccacccgccuuggccucccauagugcugggauuauagacaugagccacugugccuggccuagcuuuucuauugaugagauuuuacccuuggccuuccagaaccaaaugguuucuacagccuaaguaccacugagugcguaagaccagcuucgguugugaaagggcgugugccuucagccacgugggaaaacuccauuccuuucccucccuuucuuagugcccuggccccugcuucugugacccccgccucuggcauggccccuucucuuguccagcugguaacuucuccuggggcccgacucagagaugacauuucccuguagccuuuuagcuaccagaagaaauuaguuuaucuauuauuuuagucacucauccaguaaaugugugcgugacccaagaggcacagugguuaacaauacagcuguuucuccugaccucacuggcccuuugcuggggugggaagguccugggauguugcccagagugacauaaggcccagugccaccccugucccuugguuagguagaaucugaccacauaacccuccaugguaaugccgaacauaaauuaacugcugccuccacggugcacccguagcaucuagaauauucugugauugcuggaaucucauuuauuguguguacauauguacguguagugugggaugcuagagauuuaccaaggugggccuggguugaaauucuggcccuuggacuuguuaggagaaaaguccuugccucccugggccuguuucuuguuucugaaauggggcuuauuuuacuaccugaugggaucagcaggaggagugacugagacugucaccgucuugccccagcucauggagcccauguucauuuccuggggccgcuguggcaaguacugcaacucguggcuuaaaaauaacagaagugucgggcacgguggcucacgccuguaaucccagcacuuugggaggccaaggcgggcggaucgcgaggucaggagaucgagaccauccuggcugacacggugaaacccugucucuacuaaaaauacaaaaaaaauuagcugggcauaguggcgggugccuguagucccagcuacuugggaggcugaggcaggagaauggcgugaaccuggaggcggaacuuacagugagccgagauugcgccacugcacuccagccugggcgacacagcgagacuccgucucaaacaaacaaaacaacaaaacacagaaguuuauucccucacuguacuggagguuaaaaguccaaaauccagguguuggcagggccacaccccucggaaggcuccagggaaggauguguuccagacaucuuucauggcuucuaguggcugccagcaaugcuucaagcauuccucggaguguggacaccgccuggcugcugguggcugccagcaguccuacaaguguuccucgguguguagauggcauugcucuuuggugugcagacaccaucacuccucggcauguaggcgucaucgcuucuuggcguguagaugucauugcaucgcuccuuggcuuguagaugucauugcaucgcuccuuggcuuguagaugucauugcaucgcuccuuggcuuguagaugucauugcaucgcuccuuggcuuguagaugucauugugccagucucugccuccaucaucacauggaccccuuuucucugugugcuucucugucuccaaaucucccucuuuuuuuuuuaauuuuuuuuuuuuuuuuuuuuuuuuuugagagggagucucgcucugucacccaggcuggaguguaguggcgccaucucggcucacugcaagcucugccucccggguucacgccauucuucugccucagccucccgaguagcuggggacuacaggcgcccaccaccacgccuggcuaauuuuuuguauuuuuuuaguagagaugggguuucacuguguuagccaggauggucuccaucuccugaccuagugauccgccugccucggccucacaaagugcugggauuacaggugugagccaccgugcccggcccaaaucucccucuuuuaagaagccaggcacuggauucggguccacccuaacccagcaaggccucaucuuaacuugauugcaccuugcaaagacccuaauuccaaagaaggucaugcccauggguacuggguauuaggacuuggacauauauucccggggacaccauccuauacauaauacuagcuauaacuuuuucuaucuuuagaacgucuuccuugaucaccugugccccauacugucaacuacagccccauuuaucugcccccuuuaaaguaaccuacuccaagagcugucuacgcuucccuucuuccuacugucucuugagucuauucccgucuuguuuccaucccugccuccuagagcacuucaucuuggcacgucagccaucaccuccauguguugcgaauccagaagucugccccguggucuuuaucuuguccacucagcagcacgugucaaagcuggucacucucuccuugauguuguaacuugccuuugggaugcccgacugucuuccuuaucuugccucucacuguugguucucuugcagcguuuguggcucuuggcuuucauuuguucuuuuucauucucuguccugcucugcgucccaggggccaauuccugcaaacacguucccaggugccugugccaaugagcuuccgguugcuucaacaagcagaguguccgggcagggaguugcaagaccuggcagaggaggggaagccaggucuuuccugguucugggagcaucuguaccauggugguaccucugccauuguccgagcucccugagugggggaaugcggugcgggcuuuuucugugcuuuguugaaaggaauguaaaggaaggagagggcugaagaauugcaugugguggucagugaggggggccacacacugggcucccuccagauguaaauaagcuggguguggggcuuugggcuuggaaguguucuagccccugaugccuucagcagcaggcugacuuggugaccuaagcaguaaaugaguccaaauagcaacaugcccugucuaaaaucugcaacaccaccccuuuuuaaaaagaaauaccuaugcuguaaauuacacaucaacgaaaggaaguacuucucaguuugccuaaaaaggcuaaguuugcggcucuuaaccuuuuggugggaccuacuccuuugagaugcugauuaugucuccagaagaaacacacacccacacaaacugauguggacucucugaugcuucucagaggccugcgauucccuuucuagaacccugauaguccccaugacguccugggcugcaaggaguucagcaagaggacccugggucaucugggguaggagauguuuuaugucguuagcauugaucaugugauaguggauacauuucccuaagugcuuauccaaucgcagugucauugaagacuguugaagcaaggcuaccugggcagaaauggacaagaugugggugugcagggugccuguguacaaugcacagaaaaugggcuggugcaaguagaagcuggagggaggggugcuccauggcgccccccuugguggaagagccucuucaucaugcaacaguuggcacggcagugggcugugaagagaggagcugaagcaguccgauauuucuuucgucuucuugccuucgaagauuagaaaugcaucuuugaaauacuaaagauuugaaauguugccuguaaucccagcuacugagggggcucaggagggagcaucucuugaggccaggaguucaagaccauccugggcaacauaguaagaccugcaucucuacaaaaagaaaaaauauuagccgggcaugguggcgcaugccuguaguccuaguuacgcaggaagcuaauacaggaagaucaugugagcucaggagagugaggcuguggugaacuauggucgugccacugcacuccagccuggguaacagugagaccccaucucuaaagaaaccuggcagugaggauauagaaaaagguauguguaccccaguggaggugccuaucucaacuguuuugagagcaccuuggcagaauuuaucaaagccaaugugccuacaaugugcugugucuacgcgcuuuuccuucuaggacucuacucuguagaaaaacuggcacaagugggcaaagauagagaaauaggcacacagggacacuuaaaaauaauacuagauguuacaaaaaucaagugacaugcuuauuguggaauacaaugguuuuucaaagaaaggaaacaggguuauuugagguugcagaauaauauguaaagcuugaaacacagcaaaaaauugugagauguacguaaauguuauaauaugauaugauaccauuaaaugaauaucccuaaaacaaauucuagaaggaaaccuaugaaaugcuuaagggugacugcuucuugggaauacgacuguggagggaaugaggagggcuucuaccuuuugcuucuuaaguuucuguuauauuugaauauuuacaacuaacaucaacuaaaaugauauuuuuaaugaucuuguugcaucugacaaaaugaugcuuuuuuaacaacaaaaaucuuuccguuuuugcauuaagugacuugucuaagguucuuuuuuuugugugugcuuuccauuucagauucucgaugaauucaaaaaggauucguccguguucauccuggggugaggcagcucuugugugucguucggggcggcugugccggaccucggugccuggugcccagccggccuccaggaggggaugccugugugugcaggcgcugaccuccaaaggggcagggggccccugcuggggaauuggccaucccaugccuguggcguggauagagaugagcaguagcaacaggaagguguggagcacugggaggaugguccagaaaguucuguagaaaagccugugugccucagggccuccuuuccccgaaugugccucaugagaugugacagguuaauaguuuuuuuuuuuaauuacaaaaacuaauguuaaugaucaaauaagugaaaaauuccuuguuaaacagguuuaacugaauuaaaaugaguucagguguauaaacugcuucacaugaugcuuggcacccaugaggggcugauagauaguaauauuauuacuaaaaagucagaguugcaggacuuaucaggacauucacugugccucaugauuucccaaguggggaauuucugagauguuauguguuuccccagccuaucugacugggagaaauguuggcccuggaguuaauggucugggguacguugauccagucuuuaucggugagcaacuuuucccucugucacuuuugaaaucagaaacuccaagacuccaaaguauaaauaaaaugaaucuaauuuuuauauaguauguauauucgagacggagccucccuuugucgccuaggcuggagugcacuggcgcaaucuuggcucacugcaaccuccaccuuccagguucaagcgauucuccugccucauccuccgaauagcugggacuacaggcauccaucauguccagcuauuguuuuuuuuuuuuuuguauuuuugguagagaugggguuucaccauguuggccagucugguguugaacucaugaccucaggugauccaccugccuuggccucccgaagugcugggauuacaggcaugugccacugugcccagccauaauuucuauguaguauuuuaaugaaaacuuaguguuagacugugaggcugguggggaaagguuagaauuguacucauaaucaaagacaacagacuccuggacccugaguguuuaguaaagggagaaagcucagggcauguuucaucucuuacacuauuugaaauagaccucuuuuccccaggcuccugcaagugcucagggaaacauacccauuacccugggaagccccguguagcagaauguacuccccauccaacccggggguggcucgugcuggcccagugaggcccuguuuuucugguggccugcuggccaaggcgggaguccugccuuuauucggaguguaguguucccuaguguucccuaccugauaccuaaccucugcuugguccagggaagugucuuucacacugcaguuaauuuugcccugauggccuggagucugguggggccucauguggcucccacuccagagcacucaaugacccagggaacucuggaucguggcuucugaggaggcccuugggucuggcuccuguccuuucuccaacaccagcucucccucuacgggcggguggugugucgagcccugucuggguauuggauaggcacacucacaucccuguguuccccacaccuuuugcucugcaaucccucccucuggccugcguucccucgcuccuacuccucuuucuuuccuccccucccuucucuuuuuuccucgaggccgcugcuucucugguuuccuugccagguacucucugcaccuccuucuugcucaccccaccucauucuugcucaccccaccucauucuggcucaccccaccucguucuggcucaucccaccucacucucuggagcucaaguaggugccuuuuccucaggaaagccccucugguccuccaggucuggguuuggggccuucucagccauucccacucuuccccucccuucccacccucaucucuugcuacacuguaucccauaugccugguucaccugucuuccccauggccacacuccuggaggggcuccucagacucuggggugcaccagagcuauuuuggagcagcuaaauguagacaccagggccugccccuugagauuccgaugucagggucccucugaauccuuguaggugagggacauugugucacucaccugugucuuccuguuggccaaccugguaccuaacacagugccagacuaaguggggcguucuggguggcaggcugccccauuggcuggcaucuccucucgacuccucuguugaaugugucugucucuaacugcacccccuuuccccgaggauaggaacacugacaggccggaugccucugcuguuuaccugcaugacuuccagagguuucucauacaugaacagcaggugagagcacaaggugugugggugccugagggagcuggcgggaugcugcuggggacuagucucacccuucugccgccugugcucaccuggucaccugugcucaccuggccaccugugcucaccuggccaccugucuucauggaacgauugcagucugccagaugccagagacuucagauugcugucugaugccacugaaacucuggaugagaagagccucaugucgggccucuuuugaaggcacacauugaggaugagaagacugagaagauggcagggcaggaggggugagggccugaggauggggcugcccucaccuggcugggugcaccuuuucuggccaucaucucaggugucacugccugggaagccuuccuugacugaugggaggaugggaucagauucaucaagccugccagguccccugggagauaaacuagcacagcuuuccuuaaacaggugaugccugggacagucucccuggacaggguuugccugugggcucugagcccagcuauagacucaaggggggguuguguugcgccuugguuuuccacugcugugacgaugcccccagaggacacugggcaguguccagagacgacaugggugcgugucacagcgggaggcugcugccggcaucuagcaggucaacaccagggauguuccuaaauauccuacauugcacagggcagcccccccuaccccccagcgaagaaguauucagggccggguaggguggcucacgccuauaaucccagcacuuugggaggccgaggcgggcggaucacuugaagccaggaguucgagaccuaccuggccaacauggugaaaccccaucucuacuaaaaauacaaaaauuaggcaggcauuguggugggugccuguaaucccagcuaccugggaggcugaggcaggagaauggcuugaaccugggagguagagguugcagugagccgagauugcgccacuggacugcagccugggcaacagagcaagacuccgucucagaaaacaaaaaacaaaaacacccccaccccaccaaaaaaaaaaaagucaaagaaguauucagcaccaaguaccuacagugcugaggacaagaaacucugugagagugagaucaacuugaaaucaucuuaccagcugcacagccaccgacaggugguuuacccuuuuugugccccaguuucccccucuuuaagugggauugagagcaucuaccucugagaauuguggggaucagagucaauuguauggaucuguguguguguguguguguacauguaugcaugucuuuucacauauaaaucucaaauuuuuguuuauaucauuggaguuccauuuacuuuuuucuuuuacuucauuuguuuuuuuuuaaauagaguuuauauuuuagaguaguuuuaggguugcagcaaaaauaaguucauuuacuuaaaaaaccucuugucuugcagaacauuucaaacauacacaaaagcagacagacgguuuaaugaaccaccacguaucaucacucagauuaaaaauuacgagcauuuugcaauuuuuuuuuuguuugagauaaggucucacucacccccuugcccaggcuggagagcaguggcaugguaacagcucacugcagccucgaccuccugggcucaaccgauccuccugccucagccucccgaauagcugggacuacagguaugugccaccaugccugacaauuuuuuuuuuuuuuuugagauagagucuugcucugucaccaggcuggaguacaauggcucugucccauguucaagugauucuccugccucagccucccaaguagcugggauugcaggcgucugccacaacaccuguauuuuuguauuuuuaauagagucgggguuucacaauguuggucagccuggucuugaacuccuggccucaggugauccacccgccuuggccucccaaagugcugggauuacaggugugagccaccacgcccagccccgacuaauuuuguaucuuuaguagaaacaggauuuccccauguugcucaggcugaucuccaacuccugggcucaagugacucaccugucucagcuccccaaauugcugggauuacagaugugaggcacugugcccggcccacuuugccaguuuuauuucauccacuucuaacuuuacacuccuguaucucccuacccuuccccuuucuucauuucuuugcugaagaauucuaaagcaaaccccagacuuugcgucauuuuguuuguaaauacuucuguauguuucucucacagauagaacuuuuuuuuuuaaaauauagccauaacacuccucuuacagcuugugcaauuaacaguaauuuuuaaaugccauccgauacccagccugcauuuggauuucauugauggaagagaaacuuaugaguagagaagacauguuuugcacaaggccauccacacugagggcucaggaaagggucguagcuacccuaguaggcugauaaauggugaaugaggauguugaugcguguuguaaucaucaugccuuccuagugccgggguugaaugaugaugaucaaaagaaggcuuauuugcccaaccugagacuaaguuugagggaggaaguaaaaugaagguaauaaguuaauuuuauugggcacagucacguuaggucugagcuggugcuagagugagguagagagaaauucaugcacuuuuuucccuucauuauuuuccuuccacuaaauuauucaguuuaguagggaacgauuaaaguuaaauugguuaaauucuuggggacaaguagccucgcauccuagaauucaccaccugguagggagacuggggcguguagauuuaccccaccuaguggugguugacuuuauuacgugcuuuccccaaacggggcccuuugcugggcugcccuuagagaucagggaucuggggccaggagaaaguguaggaaaucucucucucugcaucuggggaguuaggacccgagcagccaugagcauccaugcgauguuuguuggucacacagaugcucauauggaauaaucacugcagcacuuugugugcaaauuaguaugccuuuucuagaaaacacuuuggcuguaugcaaugaaaagaaagcuuuacaacucgauucuauaucuggaguaaauaguugcccucccagacacuuauccuaaggaaauaauggcagcauuuuuaauaggaaugaaaacuuggaaguaaucuaaauuucuuuagaggauugguuaaguacgccauaguacagcucugggauggaugggugaugggauaggaaggggguuaaaaguauguuucuagaaucaguguuucuggguuuagucugaggcucaugacugggaccacuuacuuaaugacuagaagccucuccucuguuuccccauuuauauaacauggagaauaaccuguaccuccugggguggugguaaguucaagaugagacaccguguggggccgaguauagagucagugcucaguguugauggccaucgccauuuauuuuuauuuucauccuuauucuuugccauuuucacuauuacagguaucuagugcaauacccuacaccaaguggaugcauuuuauaaccccuagaauauugacauuucagucuucuuuagguagaagauuucuuucuuugcagccaguccagggccagguuauauuagcuaaguacccaugccuuuugauaaaugcaaaaacuuuguagggggaaggaaggagaaugccuccagccucuuugggacaucuuggccaggcaaaguuguuuuuuuuuuuuuucuuuugagauggagucucgcucugucacacaggcuggaguacaguggcgcgaucucugcucaccgcaaacucugucuccuggguucacgccauucuccugccucagccucccgaguaccugggacuacaggcacccgccaccacgcccagcuaauuuuuuguguuuuuaguagagacgggguuucaccguguuagccaggauggucucgaucuccugaccucaugauccgcccaccucggccucccaaagugcuaggauuacaggcaugagccaccacgcccggccuaguauuuuaauaaaauaucccacaauuuggguuucauguucuaguauucaaagauucugacaccucuguauucaaaugagcuuguaguuucccaccuuccuagcuguuuugggccccugauccaggcauauuugcaagagucaacagcaguucauuuuugucuugcacccaugcaugucaccagccugcuggucaccaccugauuugugucuguucuucuauuuuucauuguuucggacauugcauccagcccuucccaucuaagcacacacacaucuggucgcauauuugcuucuauuagucauaaagauaaaguuguuagaauauuugaagugaagaaagcauugaucaaaguugaauuuacaugucauauuucauccccuuuuccuaugaauauuugggauuucagggcauggagaggaaagcaacaguuacuuaauauuaugcauucuuuuuuuaaaggguuucuagaaugucuaggacugugcagcagcugcuuuggaacuggucauguauauuucagacguuaucaguguuucagcagcccuguuugccuauucuuuugaaaagagggcauaugauuacauuccauaucaguuucguuauuuggagcugagacucugcaguuuacaagcugugugagcuuaggaucaugagguauuguuccugggccucuguuuccuuuucuguaaaaugacaauggcaauaaaugacuugcggaguuguguggacuaagugagaugaccauaggaggaagaaagaugcuuguuugcacaagcugccacggucagaguacuuucuuuuuuuuugagacagaguuucacucuguuguccaggcuggagugcaaugguacaaccucgguucauugcaaccuccgccucuuggguucaagcaauucucuugccucagccuccugaguagcugggauuacaggcaccugccaccacgccaagcugauuuaaagaaaaaaaaaauguuuguauuuuaguagagaugggguuucaccauguuggccaggcuggucucaaacuccugagcucaggcaguccacccgccucggccuaccaaagugggucugagcacuuucugugcaccaggugcugcauuaggcacauaaccuaauaagauuuuauacaaugcuucauacaguguacauuucauacaaugcuucacagaaacugugugguagauacucuuauucccacuucauggauggggaggcacagagacgguauguaacuugcccaaggucaacuagguggaaugagaugccaacccagguaagugaccuggaaggcugauguaacuacuaugcccccaggcugcuucauacuaacaaacguaaagagcuaucauagggcaggagcuggcaaaccaugaccuauggaccaaauauagcugaccacuuguuuuuauaaacaaaauauuguuggaauacaaccaugcccauuugccuacggaucaucuguggcugcuuuugcaacacaacagcggaguugagugguugcgacagacaccguauggcucagagagcccaaaauauuuaccucuggcucucugcagagaacauuugcugaccccuggcagagggccaugugcagaaugaggccucaacaugugguggucgauugcaagugaauucggaauugguugauguuucagucuucgauugcgacuggauggacccugggaaaugaagaauuuuaucaguucucacuuugcugaucucucguucucuuugucauuuuaaggagcauugggcucaggaucugaacaaaguccgugagcggaugacaaaguucauugaugacaccaugcgugaaacugcugagccuuucuuguuuguggaugaggugaguaggcugggcuuguugucgcuugggggugacuuuuugauugaugucugugcuuucugagguuuauuuucuguuugucuuuccuuggagaacuuugcuguaugauguugccucgacugacugguuagcugggauuguuucuuuucuuuucuuuucuuuuuucucccagguucuagauuacuguaacuguaacugcccaguggguucauuuugccugcugccuagacagaaccgauugaucaaggcaggggaauugcaauagggaaagagcuuaacucacuuagagccagcugaaugggagacuggaguuuuauuauuacucaaaucauccucccuuucagaggcuggaguuucguuuuuuuauguuuuuguuuguuugcuuguguguuuguuuuugagauggagucucagucugucacccagccuggagugcaguggugggaucucaccucacugcaaccuccgccucccagguucaagugauucucgugccucagccucccgaguagcugggauuauaggcgcuguccaccaugucuggcuaauuuuuuuuguauuuuuaguagacaggguuucacuauguuggccaggcuggugucgacuuccugacccuugugaucagcccgccucagcuucccaaaguacugggauuauaggugugagccaccgcaccuggcggaggcuaggguuuuuuuuuaaagauuguuuggcgggccagggaaagggugcugcugauugguuggagaugcaaucauaugguuguggaaaauagugugcuucuggguggggccacaggaccagugggcgguccagguagagccaugcgaacgcccgaaaagacgucucaaaaggccaaucuuagguuaaaccacagugauguuaucuguaggaguaacugaggaaguugcuaaucuuguaaccuccagaaaaauggcugguaaccaguuagucuccaccuuagcagaauccaggcuccucucauccuccuaaccuggucuuaccuuagcuuuacaaaggcaguuuauuuugggggaagggcugguauuuaaacuauaaacuaaauguuuuccaaaguuagcuuggcccaagcccaggaauaauuaagggcaguuuggagguuaaaggcaagauagagguugguuagaucagaucuguuucacugucauaauuuucuuguuguucugauuuuggaaaggcaguuucauagcccuuucuuacucuucucuacugaccguguugccugggugggauuauugauuuugccacuagagggcaucugccaccagggagaguugaaccauugcaagcacagaaacagaaugcgaaggugucugggugcuugcuggucagaaugguugccuuugaccuugcauagggaaggaggggagguggaacuggggagcgacugacccauaugaggucguucucacgcagcagaaauuaggcccagaucgcuaaagcauuuuuuuuuaaggggccaggaauuguaacuugaaauuuccugcccuuucaacauucugauauggauaacacucuguuucuuaaguugggucguggguucacaaauauucaugcuacuauuaugcuuuaaauuguauauaugaggccgggugcaguggcucacgccuguaaucccagcacuuugggaggcugaggcggguggaucgcuugagguuaggaguuugagaccagccuggccgacaugguaaaauucugucucuacuaaaaauacaaaaauuagccuggugugguggugcacgccuguuauccuagcugcuugggagguugaggcaggagaaucgcuucaacccaggagguggagguugcagugagcugaaauugugccacugcacuccagccugggcaacagagcaugacucagugugaaaaaacaaagaaagaaaaaccaacaacaauguauauaugguaagcauaaacccuugcaguagcaaauauuuuaggauaaacauuacaaaggaaaauauugucuagguccauggaacaaauaugucgcugcagcccauugcagccugagccuucgguauugaaaacguggguaacugaggucuggagaccgccuguugauuucccgcaucagagcuguucuuccccccuggugggcgcagaccagaaacaagcagacaccauccugcccgucaacgugaugauucggucuucguguuugacucuuuuaguuccucacguaccuguuuucacgagaaaacagcaucugggaugagaaguaugacgcgguggacaugcaggacaugaacaacccccugucucauuacuggaucuccucgucacauaacacgugaguuucagaugagccugugauggguugggcagcacagagcacgugaggguugaggcagggguccgauacgccgcuccggugagcccuguugugaagcagguggaggguguagcaccgcauuccuuggacuaaaauacacagaagcuucuggaaggggcugggaacacacuucccuuugucagcuggcauuguaauaauaaucucuuuucuguggcccuaaaaagcuaguaaaaacaaaaguaacuuaguuuauguaacuuaguaacuaaaguaacauaguaaacuuaguuuuucacgauuugggcaucucacaguagccacagcaaagcaauucagugacucauugaauugacuuauagggaguguguacccugugccugcugggagcuggggauguggcugugaaccggcagcagccauguccucaugugcugggaggaagaccuccauugaaaguuaaccacagaauaggacuugcugauguggggagcaggugguaaggcaaggagaaguguuucagacagaggagcagcaugugccaaggcccuggggcaggaacaacugagaggagucugcuaaggcuggagugcagaauccaggagagcggugucaggaggggaggaaggcagguccugcuggagcaggaucuuguaggucaccgugagagcugucggggagacccugacgacuuuuaaccagaagaugagaugcucacagggggcucuugggaugguuacucugauugcaacagaaggaggauacaggauguugcgcugauguuccaguauuuagucugucuuauugggugaggggugaaguccuugggugauggcccccacagcuguggguggggacuuuccuaagugacauuccagggggucaucugggaaaaggcuuuuuaugguguuaugcuccaggcauuugggaagguaaaaugucuuucagggggaaauugauuucacaguucucucuuccccaccaugcccaucauuuuaagaguuuguguuucagcauggugaauucuagaaaaccuagaagacaguuaagaaauacaaacuuaaaaaaaaaacuuuuauuuucaguucagagguacaugugcagguuuguuaaacgggucaacuugugucauggagguuugcugugcagauuauuuugucacccaggcauuaagccuacuuacuacccauuaguuauuuuuccugauccugucccuccuaccacccucugacagaaccuagugugaggaacauaaacuuuuuuuuuuuuuuuuuugagacagagucucacucuguugcccaggcuggagugcauuggugcgaucucagcucacaaccuccgcuuucccgguucaacagauucuccugccucagccucccgaguagcugggacuccgggcacgagccaccaugcccuguuuuguuuuguuuuguuuuguuuuuguauuuuuaguagagacagaauuucacuauguuggccaggcuggucuugaacaccugaccucgugaucugcccgccucagccugccaaagugcugggauuacaggcaugagccaucgugcuuggccucggaacacaaauuuuaaaaaaguuggggugaaucaugacaaggaggaaagugcauuaaagagucauucuuacggcaguuuugguggauauggcuccuagcauagccgauugcaccaacaguuguugaauaucuguucugugccuggccucaagccuugauaucaaaagaagugcccaucuuuguuuagaccgaggacccagagagcggccauggggccuuguuaauucaucuucugcagcuuuuuuugcuucugacgugcuuugaccaacuucuccucaaaagaacacguccucuccacgcuugcauugcccagguggucagcagucacuuccugcgauuguggccugacuucagagcucaugcccagugugaccgugggauuguguauuucuguccuaggccuuagcuuugagucuuucuacauggaagaacucagagcuuuggcggcucgggcggagaaguucccccacaacacccugaggugcaggcuugccccccaaccccuguggcugccacucucacacggccaccugccuucucuccugcagguaccuuacaggugaccagcugcggagcgagucguccccagaagcuuacauccgcugccugcgcaugggcugucgcugcauugaacgugaguagcuccuucuugguggaggucaggcucgcagcaaauugaggauaaccaugugguugcuccauguuuucuuucgaauuguaaaaagguuuuaauggacacauaauaacugugcauauuuauggaguuagagugugauguuucuuuguuuucuuuuuucuuucuuuuuuuuuuuuuuuuugagacggagucccugucaucuguaucuccucagcuuccuccugggcugguauuagaggaaggcaaacagacacccgcuguguuuuggcagcuggguccuaggugugcacagguaccgcguaucaccuggauuggggggucucugagcaaaugugaaaagaauggucagggcuggauaugguggcucaugccuguaaucccagcacuucaggaggcugaagugggaggauuguaugaggccaagaguuugagaccagccugggcgacauggugagaucguaucauuacgaaaaguaaaaaaauuagcuguguguaguggcaugcgccuguggucccaacaacuugggaggcugaggugggaggaucgcuugagcccaggagguugaggcuguggugagcugugauugugccacugcacucuagccugggcaacagagcgagacucugugucuaaacugaaaagaaaagaagggucagguggcaucucugccugggcagauggcagacgccuuauuucccuccuuccuucucauagccucucuggcuauuuuccuuccggccucucucucaccaaaggcucaugggugcauuuggcugagaaaaggcaacaaccagcuugucguggugucucaugccuguaaucccagcacugugagaggucgaggugggcggaucacuugagaucaggagcuugagaucagucuggccaacauggcgaaacccuuucucuacuaaaaauacagaaauuagccaggcgugguggugcacaucuguaaucccagcugcuugggaggccgaggcacaggaaucacuugagccugggaggcagagguugcaguaagcugagaucgcgccgcugcacgccagccugggcaacagagggagacuuugucucaaaaaaauaaaaauaaaaaauaaauaaauaaaauaaaaaaggcaucaacuacugacuuaggcuccaguguuaccaaaacgacucaucauggaagcaacguuuuguagcaguuacucuauagacuuucuucccguuuaugauuuuucuccucccucaggaaaaaacaaauguuuaaaaguaaagcuugaagcagucagcuccugugcccuccagggguccaaaagauuggggauguucaucuuccacaugacccauuucuguuugaaaauauuacugugaaccuuuacaaauaaauuucucauugcucuguaucauuuccacgggcagaaaaggcagucaagguuuucaacagguaaagucagaaaauaaaacacgugguaaaaucuucuuuaaaaagaagcauugagguugggcgugguggcucacgccuguaaucucagcacuuugggaagcugagguggauggaucaugaggucaggagauugagaccacccuggccaacauggugcaacccugucucuacuaaaauacaaaaaaauuagccgagcgugaugguacgcgccuguagucccaguuacucaggaggcugaggcaggggaauugcuucaacccgggaggcggagauugcaaugggccgagauugugccacugcacuccagccugggcaacagagcgagacucugucuuaaaaaaaaaaaaaaugaaaaaaaaagcagcauugaaacuagcuugucuuggacagcugcacuugcauuauguaagcgcacagggaacccugcggauacagggaaagccauguccucguguuggcagccgaauggagggaguguggguguccuugucuaguaacugaacuggugugugggccgggggcugaccucggggcugucagugaacacacgugguauugaggcugccgcguuucucccuguaguggacugcugggacgggcccgaugggaagccggucaucuaccauggcuggacgcggacuaccaagaucaaguuugacgacgucgugcaggccaucaaagaccacgccuuuguuaccucgaggucaguuggcugauuucuggguggugugacuuaaaggggaaggcagcuaggguuggauagacagauggacagacaggcaaacacacacagacaccucccuccaaaugcgggaaggccugggccccaucuuggccaaagccacugccaucaaguucucacccgaguguuggcacccccugcaggccgagagugcaaguugcucccgggcucuagagccccgaggaggcucuggcuggggaacccuguggcugcucagugcccaccccaccuccucauucugucuggcccccacuuucagaacccccgaaagagagggaaaggcugggcgcaguggcucacgccuguaaucccggcacuuugggaggcugaggugugaucacugaggucaggaguucgagaagagccugggcaacauggugaaaccccuucucuaccaaaacacacacacacacacacacacacacacacacacacacacacacacacacacacacacacaaaucaucuggguguaguggcaugugccuguagucccaguuacuugggaagcugaggugggaggauugcuugaaccuggcaggcagagguuacagugaggucacauugcgccacugcacugcagccugggcaacagagcgagacccugucucaaaggaaaaaaacccaaaaaaacaaaaaccaaaaaaaaagugaggcaaggaaaguaaaauuccccuucuguccuaauucccucuuuugugcccaguucucacccccaccaaaccuguuucuacaggcggaauccaagcagccaguaaugguggugguguguuuuuugaauacccaccuggggccaggcucugugcuagguucuuuguacaggugaucauauugauucuuugccacaaagugaguauggucauccccauuuaacagaugaguaaauugagacaaggagggguuaaaugggugagaacauuuagguucauuucaaggguuucugaccucagguguaauccuuuucugucccaccagaagaucuuggucugggcuggaggucaacgaaauuguucuauaaagagccagauacaaauguuucaggcuuuaugggcccuguggucucuguugcaacuauucagcccuguugcugaagugcaaagcagccaugggcaagagguaaacacaugagucuggcuguguuccaguuaaaacuugaauuacacauuacaaaaauagauggcaggccagauuuggggcagaggccaucauaugccgacuccugguuuggguuccuuguuauuucugagagcuggcaagaggccuucuauaggcucauuggaaugauaguugucuuuuuauacuuucugggguagaauagcaguuacgaguauggguucugaguccuucucgcugaguuugaauccagcuguugaguacuaguuugggcaaagcacuuaccauccuaugcuucaauuuccauguuaaaaaauagaggugauaacugugugcaccucacagggcgguugugaugauuaaaugagaugccauuacagcaagugcuuaacccugcaccuggcauagaguaacuguugagucaauaagaucgauuauuuuuucucuuuuuuucuuuucuuuucuuuucuuuuuuuuuuuuuuugagauggagucucccucugucgcccaggcuagagugcaauggcaggaucucggcucacugcaaccuccaccuccugaguucgagcaauuccccugucucagccucccgaguagcugggauuauaggcauccaccaucaugcccggcuaauuuguguauuuugguagagauaggguuucacuauguuggccagguuggucuugaacucaugaccucaggugauccucccgccucaaccucccaaaguguggggauuaugggcaugagccaccgugcccaacccgauugguuauuuuuauugcauuuacugcagaugucccuugagcuggguggagguguugcugugagacaaugaaauuauggacgucuuuucgcacuuggugaaaaccuuucaaugaaggcauaugauuucuccaucgcagcauucuccccugugggguccuagcccuucuaagugccaaccuccaucaggcagauggaaggagcugguauuaacagacacugugcaguggcagcuuacacucugcuuugagaguuugcuuucauuugcaggacauaggugcuuaugguugugagcugacagucauucaucgaacauuaucucauucaugacuagaggaaguuuuuucugguuaaaauagggcuggaaucaucuaacaccuauagggcuagaacucuguaaucaaacauuaaugcauuaauguuuuggcagcaaaagccauccuuauugguauuaagagggauuuaagaaaaugauugcaagcagcguucauucgaaugguucagauuuugcugucaguuacauuuugauaccaacuuacuagguagccuuuguuguaaaagcuuuuuagcuguuauguucuaguaaggguguguggaucaggaucggggagugagcuggguccacgcuucccaggagugaugaggcuaugauuuacuugagcuggaacaugguuaaggauuuuauuuuuaucaucgucacuuuauuuucacauuugccuucauuucuauugagugacgugauuuccuauuuauggaagugacauagcugccuuuagaauaauuuuguuucauaguaaaugccaugcacaagccucagauggauucuuggugggaaaaacuccaucuauacaguauauuucuuggauaacuggggaaauuugaguaugucuaaugaucaguaugucuaaugaucauuauuuaaagauaguuuccugaggugauaugguguggugaugucaggggauguucuuaagagauaccugugggggaugucugcgccuuauuucagaugguucaggaggaaacguaaauauguguauaaaugaaauacaaauauaggcugggcacaguggcucacgccuguaaucccagcacuuucggaggcugaggcggguggaucaacugaauucaggaguuugagaccagcagccuggccaacauggugaaacccuaucuuuaguaaaaauacaaaaaauuaacugggcaugcuggcagauaccuguaaucucagcuacucaggaggcugaggcaggagaauugcuugaacuugggaggcggagguugcaaugagcugaggucacgccauugcacuccaucccgggcaaugagugaaacuccauuuccaaaagaaaaauaaauaaauaaaauaaaauaaauaaauacauaaauaaaugacuuuucuccugccucaggaggaguauguguguauauauauauauauauauacacacacacacacauaaauauauauguguguauauauacguauauauguauauacauguacuaaugauaugugaauuuauacauacacguucacaugauauagaaggauacaggugauccuuauugguggauucuacuugcuaaaauugacuuguaaccccaaaucaaaucucaaagcacucugaggucauucugagacacgcacaaagugugggaaaugagacucaugcgaugcacacguguucagcugagggugagcaaagcagcgcuccccuuccuggucuacagcgugaaagcuucaacaaguguccucaccaucuguugacugccauguuuuuccuguuuuugagcuuuuucuuggugaucuugcuguucaaauggcccgaagcacaguggugagggcugccugguguuccugagcaggagaaggcugugaugugcccgauggagaaaacaccugugucagauacgcuugguucaggcacgaauuacagugaugcuggcugugagcccagugucagucaauaauauauaccaaaucaggugucuuuaaacagaaacacacauaaaacaacgucagauauugauucauugaggaaaauguugugaccacacgcucaaaaggcccugauccuguauuuccccuuaggagcaauggcucagguauuugccaaucaguguugguggugacuuuaugaaccauaaccccaauagauaagaaaaaucaacuacagauacacacaaaugaucuauaaauacacagacaccuuauagaaauauacauauauacacauacaaauaauaaauguaugcaugcacacaugcaaauuacauaugugugcauaugaaugagaauauauaaaaccaauauacuuuauaaauagaggaaguaauaaacauacuaaaguagguggaugcacacguggaacagcgucccuguuggugacccugggugaagcacacaugggugcuuauugugcugucuguucaucuuuucuguagguuugaacuugaaaaaaagauuagagacuuuuuucuguaaguuuaaagauaugaauagauggaaaaaaauacagagaaaaggugcauucugggguauggggaagcuccugaaucagaucgcagcuguucugagucccaagacuugugccuucacacccaggaugagguccucuccuucugggagggcagauguggggguugugccccccgagcagcgcccgguuucugucgucccagggagcugcccuggccccucuguggggcagaugcagaggugugugcucccccugccgagcugcccacccucuucugccugcagcuucccagugauccuguccaucgaggagcacugcagcguggagcaacagcgucacauggccaaggccuucaaggaaguauuuggcgaccugcuguugacgaagcccacggaggccagugcugaccagcugcccucgcccagccagcugcgggagaagaucaucaucaagguaggcaccccgggugcugcuguuggcuguccagggagcccaguggcucgguuccccggcucugggucccguucaccaaguucuauguccuacugggccugcuccaggucccacugcacaggcucaaaucugcucuccuuacuaacacugugaccuuaggcaaagucauuaaccuuugggagccucuguugucaccagucucugggggagauaauacuggaacucaucuggcuagcuugcugggagcaugaugugagggaaggcgugcagaaugcgugcaacugcgccugucaugugguuggugcuacguuaagugcuaaccuguuauaguucauuuguucauuggugaaccuuccccauccucucucggagacagccccaugcgaggugcuggagguguccagcgaccugggugcuguuccugugauugcagcuuccaguugugugggaggcgggcaguugcuagaaaaggcugagugcagcaauagagcugauguucccagcacugcaggggagaugggugauuauaucugugccuagggaugccaugguaacauuuggauuuuugaauuauuaggauaaagagaccauauaugccguggcuuaaagcacagaagaguuuauuucuuccccaugcgagggagaauguucugugaguuuugagcucuagcccacaaggugacucagggacccggggcccccgcauucugcucuagcaucucucagggcagcaguuuucaacugggguuucacagacccccgaagaauccacgguuagaaucagaggggcacgugaacuucaacagaaaaaaaauuacaucuuuauuuguuuaaccuguacauaaaacuuaauacuuccuuccauugugaacauuggcagcaagccacuugcgggcucugucaccagcagaagucaugaguguuuucauaucccguuuacaguuauugcaaauauuucaaaauaauguugugcucgucaucacuuuggaauuauggagguuauuaggucugccucuagaucuuauuuaagauguuaaugaagaaacccaucuuuuaguguauugcaaauauuuauuuaauaucuuaaucauguuucaauauaauugaguuuccuuuguaauuuuaugcauuauuauucugagaaaagggucuguagcuuuccccagauuuugaaggagcucauuacacaaaaacggugaagggacuuugcuuuguccuuguuuaugugguggacgcuuggucucaggcacauccgaguuccagcucagagcacgggaaguccaaggguguccagggcaaaugguuucugguaagcaagucagcugucccguccuuuucucuacuguucugugcaugagagcuuagucacguuaccugcaaggacuguggaaucugaagucccuagcggggcagccuuucauggaaggagcgagugugaauuuuguugacauuccacgagcucauggggaaggacaaacagcuguuuccuagguauuucagucuguuccugcagcuaucacaaaauacccuaagcuggguggguuauaaacaacaggaacugauuucucacgguucuggaggcuggaaguucaaggucagggugcugguaugagaguccucuuccaaguuguaggcugccgacuucuaguuguguccucacaugguggaaagggugaggcagcucucugggaccucuuuuauuuuuaaauauuuauuuauuuauaaauaaccaucugggacauggagauaucuuuggccucuuuuauaagggcaccauucccauuguugagagcucuacccucauucccauucacuggagcucuacucucauucccacuuaugagagcucuacccucauucccauucauaaaagcucuacccucauucccguucaugaggacucuacccucaugaccuaaucaccuucuguguuacccauucucacacugcucauaaagacauacccaagacuggguaauuuauaaaggaaagagguuuaauggacucacaguuccauauggcuggggaggccucacaaucaugucagaaggcaaaggaggagcaaagucacaucuuacaugguggcaggcaagagagcuuguucagggaaacucccauuuauaaaaccagaucucaugagauguguucacuaucacaagaacagcacgugaaaggcccgcccccaugauucaauuaccucccacuggguuccuccuaugacacgugggaauuauaggagcugcaauucaaggugagauuuggguggggacacagccaaaccauauuaccuuccaaagcuaccaucuccaaauaccauuacauuggggauuagguuucaacauauaaauuuugggaggacacagacauucagaccauagcaguaggcagagaagggggauguccuuccagguugggacaauaggacacacaagggugugguggugucaacacguggcauguacccuauauuaucacugggccaccaagauacauuggacacaauccuuauguuccaggaagucgugguuugguagggagacaaacccgucaacagagaaacaccaaacagugcaaggagcuuuggccaagcacaaccagaggaggggauguuggugcccccauggguaagagcaucagugcacggggaguguuuggccaagacugugacccuuaagguacagauguuugccuaagcgggagaucagcugucauugucuuagucuugcagaugagaagugugaggccuggagaagugcagccaccuggcuggggucacaaguuaacaaaauagcugcagcacuguuugcacccaggcaguuguuucggagaugccaagggaugcuuccagcacggugaaggcaggauaagggguggagggagcucggccauggaggguccauggcuucucaggcaccuaguuggugagucuucggggcagccugguugcaugugcucuucccuguucccagcucauuccuucuguuuccauuaggauggcuugcugccuguucccagggaguuuucagcucuuguucuaagaugcaaaguacugaaggccccuuuuagagcacccucugccccacaccugauacgcuguggcccacuucuuucuauuucaagaaaugagguggaaauagcguuggccacacggucacuuuguaccaugcacuuggcuaggcguggucauauguaucuucuuauucagucuugucaagacacugcaggacgaauaaccucagcccuugcccacuuuacagauguggacauugagauucagagguuaaauagcucagccagggucacacauuuaguauuugcugaggaaauuauucaaggccaagguggucugcccucagagccuguuuucccaugccuguaucaugcugccauucacaagggacacugagguccugcuucacuguugacacuuaucuuucacguucuuugacuuacgggaucccacaggggcugccacgucccgauuuuacgagacagauuacugagacucugaugaugacucagccaaggucacauggccaguaagguaauaggcccugaauucaaaucuggaucugacccccuauccugagcuccuucaccagguuacaugacccucaacuuacagacgcuugccugcgugggaguccaggugucaucacugucuuaaucuugcagaugagaagccugaggcucagagaagugcagccacuugcccggggucacacagcugguagaauagcugcagugcuguuugcaccccggucgccuuagucuaauccccauugggucccccgccacccugcccagccuguucccucuggacugcggccugccuuucccucugugugcuagagaaggcugggcacaggugguguuguuguuuauucaccgaguaucaacagagcacuuacugucugcuaagugcucuucuagcacaggagacucaacaggaagcaaaacaacaucccugcccucaugggguuuauauucuagcagugaggacagaagacaaacacaugguguguguagggcuagacaagugagaggaauaaagcaggcuuggggcuagagaguggcaggauaggaaggggagugugggcuauuuuuacuuauuuauuuuuuacugggacagagucucacucuguugcccaggcuggagugcaguggugcagucucagcucacugcaaccuccacuucccagguucaagcaaucuuacugucucagccuccugaguagcugggauuacaggcgcgugccaccaugcccggcuaauuuuuuuauuuuuguagauacaggguuuugccauguuggccaggcuggucuagaacuccugagcucaagugaucugucugcuucagccucccaaagugcugggcuuauaggugugagccacugcgccugaccaguaugggcaauuuuuagaugaagcuguaaggaaagcuccuccuccucguucaggguaaccuggagggcagagcugaacagacuaagagggaagccaggcagcaagaacaggcagugcaaaggcccugccugggaagaggcagaugaaggcugcuggcucaaaggccuaaacuugggucuccauggagacagccuauguauauguuuuccccucagcauaagaagcugggcccccgaggcgauguggaugucaacauggaggacaagaaggacgaacacaagcaacagggggagcuguacaugugggauuccauugaccaggugggccuuggucccuucccguagccacugcggccacgccccuugcagcugcuucuuggagcccugcugggagcucugagaauacgccugucuuguucccauuuuuagucaagugaguuuuugccaugugaauuuaccuuccuucuuaaacuuuauuuauuuauguugugggacagggucucacucugucgcccaggcuggaguguaguggugugauugcggcucacugcagccuugaccucccaggcucaagugauccucccaccucaaccucccugagucucugggaccacacgugcgcaccaccaugccuggcuaauuuuuuguauuuuugcagagaugggauuuagucguguugcccagggugauuucaaacuccugggcucaaacaguccucccaccuuggccucucaaagugcugagauuauaggcguaagcuucuaagccuggccaacuuuauuuuccuuuugcauuuuuaauguuuuauuuugaaauaauuuuagauuaaauauauuuacacacacaaauaguaugggauauucccaucuacccuuaccaagcuucuccaaauauuauuaauaacauccuacauaaccauaguauaauuagcgcaaucaggaaauuaacauugguacaauacuaauaacuaguuuauagaugguauuucauuguugccacuguguucacucaggcuauuuuccuguuucaggauccaguacccggugcugccgugcauuuagguuguccugacuccuucguguccuccaacugggggucguuccaccagaaaccuuauuuuucagacuuuaaugcugccucuaucccuuuaccuaauguguauauccauuuugaguauauuuuuacauguccguucuuauauccuagauauaacauacauaucaaaggcaauauuuauuuauuacuuauuuauuuauuuuagauagucuugcuccauugcccuggcuggaguguggugguacgaucuuagcucaccacagacuccaccucccgguugaagugauucuugugccucaucuucccaaguaacugggaccacagaugugcaccaccaugcccugcuaauuuuuguagccuuaguagagauaguguuucgccauguuggccaggcuggucuugaacuccugaucucaaguggucugcccgccuuggccucccgaagugcuaggauuacuggcgugggccacuguacccagccaaaaauggcaauauuuaaguaaagaauuaaguugggccaggcgcgauggcucaugccuauaauccuagcaccuugggaggccgaggaaggcagauuacgaggucaggagaucgagaccauccuggcuaacauggcgaauccccgucucuauuaaaacuacaaaaauaaguugggcaugguggcacgugccuguagucccagcuacucaggaggcugaggcaggagaauuacuugaacccgggaggcggagguuucagugagcugagauugagccacugcacuccagccuggugagagagacagacucugucucaaaaaaaaaaaaaaaaaaacagugcagcacaccaacauggcacauguauacauauguaagaaaccugcacaguguacacauguacccuagaacuuaaaguauaauaaaaaaauacaaauaaaaacguuauuaaaaaaaagaguuucugcauacccugcacccagccuccucucacauuaacgucaugcaugacaauaaaacagugaccaaagcuaagaacuuaacccugguacuuuacaauaaaaccagagacuaaauuucaucgggggaaaaaaaaaagaagucauuaagccacaaauaaauauugaacguaaggucuccagacaaacuggcugggaaauccugaaaguuuuaaaagguagauggaauagaaaagaaaaugaugaggaguuguaccuaccuuagacucauggaucuaaaaaguccaaaaagaagcucaaauaccaaaagaagcucaaaaugcaucgauauuuuaaaaaagaaaugccuuguaaggaauugaauucagagaauucgccauaaaugucuaugaaacugggaaaagcacauccauaguagaugcuggggugacgcccugcagggcuccugggcuccacaguugaugagguagaggacuuggggggcacuaauaccaguuucacuuucuagaaauggacucggcacuacugcgccauugccgaugccaagcuguccuucagugaugacauugaacagacuauggaggaggaagugccccagguagggggacacccuagccacauagggaggagguccccaggaaccccgaggaccagccaguccccgggaccuccuucccauguggcuucucuggccggcuggcaaggggaugcuccgcugaagaagcuguugauacucuggguaccauguccuggcuggcuugucucugauuggcuggcugccccaggugcuuuaaccagugagguucaagaugcuuuccugcucucuaaagugccugauuggccuuagauggaggccggugcucuggcuuggucccaugcuuuccuguugcccucuccuccagcuguggucaucuuucccgcuguuuauuucugcagcccccagggccucauggcucucagacuucccauagaacagaauggagggcuuugcugggaaccguucacugcaugucucaggaugccaggaggccaccauaaaugagggcucucaggagugggaggcaggcagaggaggguagcaggugcuguuuucccauaccccuucggguggggaccagcugaggcuggccucucuauguuaucugguacccugggucagggugagacagaaggaccugucuagugaugcugggguuugguccaaggcuuucagaaaccccuccucucuuugcggcccaggauauacccccuacagaacuacauuuuggggagaaaugguuccacaagaagguggagaagaggacgagugccgagaaguugcugcaggaauacugcauggagacggggggcaaggauggcaccuuccugguucgggagagcgagaccuuccccaaugacuacacccuguccuucugguaaugcccccgacccagggaacgccuaccuucuucuccaugccaaccgaugaggcaggguggcgagugguucuagcucaggcaggaauugggcaggcugggaccugaaucccaggcuucauuugucuagcucuucuaggccgggacaagggugagguggguaugacucacuucggcacuguaacccagauuaaugagauuucagggcaaucuuuuaaaaaaucaaaaguaaugcaaaaaagucugugaugaacaaaauaugaacauuuuaaacaaagacaagaucugacccuacucuuagaugauguggucucacucacuuuccccgaucccagcccuggagugggucauguggcucuggaugauucagccaaccuucuagcaucucugucuccuccauaaaacgaggacucuagggcuguccuuuugaagccgucauaggcugugaugagcuugugcauucauucauccacccacuuauccaugucucagugcauuaaaagauacuucuugagggcgugcccugugcuagacacaguacuuaugccagacagacaaugucuuuguccuccuggacacuagcgucuuuugaaggagaugggcaaugaaaaagcagucacucaaaugauuugcaaguauaguugugaugagugcaaugaaacaaggcaacauaaagggacaucccucccuuuauuggggggguuuaaugugaguuggggggauuugugaaagucugugaggaaggcucugaugcccugacguggggaaugguuaggaaaaccuuccugaaagaagaugagaccugaaagagggaaauuauaauucugucacuuaaaaaaaaauugugauagggucuugcucuguugccuaggcuguaguacaauggagcagucucagucacugcagccucaaacuccugggcucaagcaacccuccuaucucagccauuuaaguagcugggacuacaggcacaugccacgacaccugaauaacuuuuaaauuuuuuguagagcuggagucucacuacguugcccaggcugguuuugaacucagcucaagcaauccucuggcuucggccuccugaagugcuaggauuacagcuguaagccauugcaccuggcugaaaauuagaauacuaauaacacgcaaauaauccuggacaccuaaaugaugcuuaccaugugcugggcaguauucgagacaccuuguguguguggucucguuuacucuucaggaugccucuuugagguggauacuguuaucauuccugucagaccgcugggguaguaauacaguguggcucagacagcacgggugaccugcuccaggacacuugguucauauguggcagagcugggauuugaauccaggcauccuggcucuagagaagcaguuauauauauaaaagggggauggggugggguggggugggggaaguagguagaauguucuggaauccaggcugagggucuagccuauacuaaggcccugcaucugguuuuguuguuguuguuguugagauggagucucgcucugucgcccaggcuggagugcaguggcgugaucucggcucacugcaaccuucgucucccagguacaagugauucucuugccucagccucccaaguagcugggauuacaggcaugcaccaccaugcccagcuaauuuuuguauuuuuaguagagacgagauuucacuguauuggccaggcuggucuggaacuccuaaucucaggugauccacccgucucggccucccaaagugcugggauuacaggcaugagccacugcgcccagccuccugugucuguucuaggagcagagggaagguuguguggccacauguaauguccccgccucugaggcccuggcugccgcaauggccuggccugcguucucccagcacugauggcguccucuccccgcaggcggucaggccggguccagcacugccggauccgcuccaccauggagggcgggacccugaaauacuacuugacugacaaccucaccuucagcagcaucuaugcccucauccagcacuaccgcgagacgcaccugcgcugcgccgaguucgagcugcggcucacggacccugugcccaaccccaacccccacgaguccaagccguacgugucugaggguggagcaggaggcaggcgguggucggguuagcuccaccaggcagagaagcuggccuggugguucagccgggccagucccccaggacacccucuccccagcccaccggcaucucaaaauugccgagguggccaguuuccaaauuccuggcaccaugaccuguguccuuuucucuuuucuuucuuuccuccccuuuucucuuuucccuuucuucuacuuugucuucauagccccgagacuuugggcuuugauuuucagagggucauuuuggccuggggauauucucuuaccuuucagagcuccuuccuguuuguucugaaaaugaacaaggaaacaaugauuauaagagucucccgcugauuuuuuuuaucuagugaaaugaguaucaagguaggucuugcgaagggucaacaaauucugggaauaaagaaaaaacaauuuuuaggcagaaagcugcaaaaauguccauuuccgaggaggccguauuacuuauagcaacuuuuuuuuucacuuuuucugucacauuuuccuauggauugccucuuaaaacuugcuauuucuuaucuuaagaaauaacccgaaaacaacccaaaaccuugugaaacuccugcugugaucuccgucuucgauuuucugagacacguggcaauaacugugccucccugggagccuggcuuuucagguuugggcugcuuggguggaugaagaugaaucaauuuuuugagacaagguguugcucuguugcccaggcuggagugcaguggaacaaucacgucucgcagcagccucgagcuccugggcucaagugauccucccaccucagccuccuaucugggacugcaggugugugccacugugcccagcuaauuaauuaauuaauuaauuaauuaauuuugagaccgggucucgcucugucucccaggcuggagugcaauggcacgaucucagcucacugcaaccucugccucccagguucaagagauucuugugccucagccuccugaguagcugguauuauaggcgcacgccacugggccuggcuaauuuuuguauuuccuuuuuuuuuuuuuuuuuuuuuuuuugggacagagucacauucuguugccuaggcuagagugcaguggcaugaucucggcucacugcaaccuuugccuccuggguucaagugauucuccugccucagccuccugaguagcugggacuacaggcgccugccaccaugccuggcuaauuuuuuguauuuuuaguagagacaggguuucaccguguuagccaggaugaucucgaucuccugaccucaugauccacccgccucaaccucccaaagugcugggauuacaggcgugagccaccacgccuggcccaauuuuuguauuuuuaguagagacagaguuucgccauguuggucaggcuggucuugaacuccuggcuucucgcgauccaccugccuuggccucccaaagugcugggauuacaggcgugagccacugugcccaggcuauuuuauuuuuuauagagaugggggucucauuguguuggccaggcuggucucaaacuccugaccccaagugauccuccugccucagccucccaaagugcugggauuucaggugugaaccacugugcucggcccaauguauuauuuugggcuugaaacagaccccuggggucuuccacuauucuuuucacaaauucucuuugcugaggugccuuugucuggggaagcccacugugugauuuccauggucguuuccagggccagguuccaggugucacuggugccauuaucuuguccucugcggguggcccacugacagccuggagaccgcucaccuggucguuuucccuggcccugugccgcaggugguacuaugacagccugagccgcggagaggcagaggacaugcugaugaggauuccccgggacggggccuuccugauccggaagcgagaggggagcgacuccuaugccaucaccuucaggugggugcgagggugggaggcacaugcucuacagaggggcuuggcaaggacagaugcggagagacaagggggaacuucagguggaggcucaccugcagugcccugcccccccagcaucagcgacaacaacaaccaccacagcaaaagccgcugcgagaaugugcgcuccugcgugccaggcacagucugcguucuccagggcaggauguucuguaguaacucacuuuggcuuccaguaacucugugggguugacaugaccaugauccguguuucucagaggaggaaacugaggcacagcaagauuaaguaacuugcugaagcaugcagccacuaagugguggggcugggauucgagcccagacagcccaggcagcccaggccugugaugauauagaucugguuuccucccaacugcagcugcugcccaaccaccucuaggccugugguucucuaauguuaccccaaaacgccagauucucccacuuccacuaaugacaaggagccgaggagugacucagacuccguguagccuacugucccuccaucuccccagccccaggguuucccugcauguucuuacggugguaacagucugcuauauguugaguuccuaaccguguucuagacacuggacugccuucaaggccucaucugauugaauccuuugcuacagccugugagagguaggucuaguuauugcaagggaggaaacaggaccagagagguuaagugaccugccuggagucacacagccucauagucaacugaguuugagguucagaugcaggccuguccgucuccaaagccuaagcucuucacuccagagucucuagccagaggccugggggccaaaucuccagccagaggccugugggcgucuuuuguacacugaugugaaaaacugagaaauuucacugaaaaacucagauugcuucuugugaaaaaugggaggcaguggaugcucugggccuguguuuccacaugggcgcgguggugcuggcugcauggcagcuacuguggggugugugguuugccccuguccacuccucuccccauucccucugcccugaucccauccccuggugacccugccaggcugcccccugggcguuuggauuucccuuccuccuugccugcaccacuaugccugagccaccucccuggggaccguggugacggucauuaucacuauaguuuacugaggaccuacuguguacuggcuccagccagagagcagccucccaccagcauggcuuuucuguacucucuguucccaagagggugaccugggcuucucagcauuggugccucugcccuuugcucuuuccccuaagccucuuagugguaccuccucagccuggauggggaggagguguguucaguccgcugcacacggauugaaaaccugcugugugccaggccccaggugggguguuggcacucccacugugcugucauccugugcaaaugauggcaacuaaacccaacuggcugaaacugaggugcccaagcggugagacagcucugacacaaccggaucggggccucaccugaugauggucaggaugccaccuguaugugcaugcuggcguuacucuccaucagcuucugucucagguggcuguaccuugggcugccaggacaguguccggcagaaaggauggcccccucccugagccagguggcaugauucugacaggccaucuggggaugggguuggggucacuucaaugggaccgcgugaaugaagagguuggguggguccucagguugauugccugacuuacauacacgccccauucaguuugugagcuugucuuccccaugagauuggaggugucuugagaauggaaguuuuuauuuuuuagaaguuaauagauguuuggugagcaccuacugugugccgggcccugugcugggcuccagagaugcaggagugauaaaaacagcccaguccuugcucucucaggcuaauggucuggcagggaugagagacaucgccuuacuccaaguguuucuugcuuuugaccuguuccugcuuauguaacauuggcugggauguaguuggugguuggugaaugcuggcucagugaaucaaucagcaaggauggccgcuccccaccucaccccauggcccacugucagggaagcucaguccacacaguguuucucaaagaguuggggugugaggacugauccuguuguauuuggauguugaacuucccuggucucuacccacugcaugucugucugggacccuaagucauuguaacaaucaaaaauaacaucccugccccaggacacacacuuuuucaaacccucucuggucaggguauggggugaagcgucacuguccuucacugagaagcacugaggagguuugagcacauaaggaaaucaguguaguauuuugugaugagugcuacaaagggauuggucaggcagggugguggagggugaguagcucuccagggaaacggauggggaauuuggaccaggcaguaggggaacacaggucugcagcaacuucuccuugcccucuacauauuuguaaagugccucuccugugccaggcacuguucugggcucuggggauguguaaugaacuucuggauagauuuccccaguagaggagaaacaccugcuuucaaauccacaaaggaaguguugaguuguugcccggcugugauugguggaaggcaucucuugggcagugaagcugagaccucaggcuguggccguggcauccacgcuccaggaggauggaagaugcaacucguauuccagaccuguucccaucuccccuucugauucucuuuucucccagggaaguuaguuguggguugauuucauuuauguuuuccaaaccauucacuuacugaguccugccugagugccagacacugugccgacagcuuacccugaauaagcuaauagacgaugauccuaaugcuccccaugcgacggguuguggauccccgaugcuguggaucgggaagcugaggcuuagggguccccuguggaaggagccggaaccugaccuuggcucuguaccucggcaccccagagccccccugccugcccugaggagcucuuauaaaaaguuuuaaaauuaauuuuuaauuacaugaauauugcaggaggauauucucucuauaaaaaauuaagacauuacagugaaggcuaaagcccccugugguccuucuaaucucaguagagagguccugguagaaagcacaguuuucuagcugguguguccauccagacauuuaaaaaauauguacauauuuauacaugucuguaucuauggaaaauauauggugccauuuugugucuggguauuuucauucuauuuuuagaaaauacaaaugggaacauucugcagcuuuucuacucagcaguguuucuuuucuuuccucuguuuuuuuagaaggaauaaauauuuaauaaaauaucacuggaaauaaaccacugaagcagaagucuucuagcauuuuguuuuuacaggacuuuuugacgaaaucgcuuaaagcaauauauuuuuuuuuucaaaagacuggaaauccuuuuuuaaaaaaagaaaaaaaacaacguuuuuuaaaaaaagaaaaaaauaaauauuuuaaaacaaaaagucucucuauagugcaaaaaaugccuuuucuugauuuuuuucccugccaugcaaaauuguuaaaugagcaguaugcccauagaaacgaugccucuagaugcuuuuccuaauuuauuuaauugacaaauaaaaguuguuuauauguaucauguacaacaugguguuuugaaauauguauacauggugaaauggcuaaauugagauaauaacauauacacacacuuaaccauuuuuuuuuuguguguggugagacuuaaagucuacccucagcaauuuucaagaauacaggacauauuuuuuuuuugaaauggagucuugcucuguugcccagucuggagugcaggggcgugaucuuggcucacugcaaccugcaccuccuggguucaagggagucuccugccucaggcuccugaguagcugggauuacaggcaugcaccaccaugccuggcuaaguuuuguauuuuugguaaaggugggguuucaccauguuggccaggcugguaucgaacugcugaccucuggugauccacccuccuuggccucccaaagugcugggauuacaggugugagccaccacgcccggccaggacuuuguuauugacuauagucccuaugcuguaccauagaucucuugcacuuacuccucuugucuaacugaaauuuuguauccuuugaccaacauauccccaacacucccuaccucccccugccccggacccugguaaccaccauucuacucuccacuuccgugaguuuaaaccuuuuuagguuucacguaugagauccugugguauuuguuuuucugugccugguuuauuucacacagcacaauguccuccagguucauccaugcuguugcaaaugacaggcuuuccuuuuuuuuuuuuuuuuuuaaagcaaaugguauuccauuauguaaauguaccacauuuucuuuauccauuuaucuguugaugggcaggcugauucuacaccuuggcuauggugaauggugcuaugaacaugggagugcagcuuucucuuugacauauugauuuccuuuccuucagauauauaccgagaagugggauugcuagaucccaugguguucuauuuuuaauuuuuugaggaaccucuguacuguuuuccauaguggcuaugcuaauuuacagucccacccaccaggugcagggguccccuuuucuccacauccccaccagcacuucuccuuuagcuaauagccauucuaacaggugugaggugacaucucauagugguuuuaauuugcauuuaucugaugauuagugaugcugaacauuuuuuacguaacuguuggccauuuauguaucuuccuuugagaaaugucuauucagauccuuuguccauuuuuuaaaauuuuuuauuuuuugagauggagucuugcucuguugcccaggcuggagugcaguggugugaucucagcucacugcaagcuccgccuccuggguucacgccauucucuugccucagccucccgaguagcugggacuacaggugcccgccacugcgcccagcuaauuuuuuguauuuuuaguagagacgggguuucaccauguuggccaggcugguaucgaacuccugaccucaagugaucugccugccuuggccucccaaagugcuggaauuacaggugugagccaccacgcccggccuuuguccauuuuuaaauugggucauuuauuuucuuacuauugagcuguuugacuuccuuauauauuuuggauauugaccccuuaccagauguucaguuugcagauguuuuucccauucuguagguuguuuauuuacucuguugauucuuuccuuggcuauguagaagccucuuaguuugauaaaaucccauuuauccacuuucacuuuuguugccugugcuuuuggggucauaucugaaaaauaauugcccagaccaaugcuacggagguuuuccucucuguuuucuucuaguaguuuuacaguuucaggucuuauguuuaagucuuuaauccauuuugagcugcuuuuuuuguuuauggugugagauaauggucuaguuuucuucuuucgaaauugcuauuauuucuauauaggaauuuauuucaaaauucuuuuaauuuuuuuaaaucuagguuucccaacccuacuuauuuaacagacuguccuuucccccugguguguucuagacaucuuuauugaagaucaguugacuguaaaugcauggauuuauuucuuggcuaucuauucuguuccacuggucugugugucuguuuuuaugccacuguugugcuauuuuuauuacuauagcuuuguaguauauuuugaaguaagauagugugcuaucugcagcuuuguuauuuuugcucaaaauugcuuuggcuauuugggguagacauuuuuaaaaagacccucuuggcuguaaacuuagggucaaaaauauuuuuccagauguuucugucuugcugauaaaagcuaauaaaaccaaggaggcucuucuguuuuggauuuuuucugcuucauguuucaaacagaugaaggaaugaaagacuuguuucuuuuuuuuuuuaaaaaaagucacuguuuugcuaguugagucaccgaagacaagauuuaauaauuuugaggugggggggauuggcaaacauuuucugugaaggaccacagagugaauauuuuagguuuugcaggccauauggucucuguugcagcuacacaacucugcuguuacagugugaaaacagucccagacaauguauaaacaaaugaacuguagcuguguuucaauaaagcuuuauuuauaaaagcagguggugggacacauuuggccuacucuugaccuaguucccuaggaagcuccuaaagucaaguccuguaguuggggaggagaggaaggguaagaggagcuguugagucacucggccauauuucuucugagacacagauucuucuagaucuguuuugaaaauacccacaucauuguuuucuuauugucuuguauuccauaggaggacuauacccuguuuauuuacccacuucucuaaggcuggauaacuagguuguaucuaaucaguaggguuuguguaaaaauuguuuggccaccaggaucuuggcaugucaacccuguguucuuccugcuccagggcuaggggcaagguaaagcauugucgcaucaaccgggacggccggcacuuugugcuggggaccuccgccuauuuugagagucugguggagcucgucaguuacuacgagaagcauucacucuaccgaaagaugagacugcgcuaccccgugacccccgagcuccuggagcgcuacaauaugguaggugguggacucccuugugauuuggugggauuucuugucugagguuguaacucaucuguucaugaauucagcaaaccucugaguauucaccauguaucugauacugcuguagguccuggggauacaaauugagcacaacaaagacccugccguugugcugcuuauaguguaguguuggggagaugcaacaaaugacauuuaaaauauccauagcaugugccagauggugaugagugcuauggagaaaaacacugggcagguggauaagaggauacagagugauggggaagggguugaaguuuucagaggguggucuaggaagaucucacugaaaaggaaugagccauguggguauguucuggaggaagagaggauagcaugcgcaaagguccugagguagaagccugccuggaggcaccaagaggaagucagcauggccggaaucaagccagcccagguggggguagagcuaaauaaggaugaggguucacaggugacuuaucaugcaggggcucauaggccauuguaaggcccuggcuuuuucucugagucauuggagaguucugggugcaggagagaccugaugugguuacuuugucuccauuccuaccacauagaucauuaauuuauugaagagagauuuauggcaucccgaucaugugccaaggacuguucuagauacuaggaguacuguggaacaaaaucugcuuugggaaauuuagguucuggagaggagagacagauaauauacacaauuaagauguuuucagguagcaugaaauauaauaaagcaaagaaaacaggauagugugaaaagggguggacacuaccuuaggcugugggaguggagaucagagaaggccaccuuaaaaggggagaaaugugagccgaaacauggaagauagcagugaaugggaucuggggagaagugaaugaaggggugacucuagguacaggaguggccacaucacaagcccuaaggugacaugaggaacagaaagaagaguuagagaggaacagagaggugguggggguggaucuugucaguggugugcuaguaaauguucaaacagcucucagcgggguagggggaaggcacugguuuguagcauuugccaguuuccaugguguaaauacuuccauggaggucaguuucaaguuguugaugugcugucguugaaccuggaacguggagucaggaagugauguacacagugggcuuuugugagccgggaggucacuccagcacaccaucgcaucuuaggauuugugcuuuuacaaaggaacgcagugccuggcacgcagcaggccaggacagggccucucugauuuuggguuaguuuccaagucuggggaccuucuuuauagcuucuuccugugucuacucaugggccaaaagaaaauucuaugagguuucaacuccucuaucaaaggauagguaaccauaaggaagccuagaacccuuguuauauguaagggcuauuccaggagcauggauuauuccauuucuuucuuucuuuuuuuuuccaggaaagagauauaaacucccucuacgacgucagcagaauguauguggaucccagugaaaucaauccguccaugguacggugccgaaccuccaauucacaugauuuuggagucacgaggcugauguggauuccaucuuguucccauggcaguuauaacagggcaagggaagacuuuggaaaaccuggccaaaauaauuuuuuuuuuuuuuugagaagaaaggaugauugauaauaucaagccuaguuucagggaaaauguuaauagaauuccauccaaaugcaacaguguuuugcuaaaauucugagguuugacgaaccaccuuugggccaaauggcuucuaaugaaaagucuuucaaauguuuuuggcucgcugacagagccugugguguuuauaaauuccauuugguucacugaccuccuugcagugcaaaugcuaucucauauucccacccugacucuguuguguaauuucaugcagguagggauggauuuuacuuucagcccucggcuccuccuugccaugcuuucaucucaaauuuaguuugagccggcagaggaagaaccacagcgaauuuucuguuugggggccauguggcacacaauuaguguacaacgcucacuuaggaaggggcccugcuugugggcucuguugaaauccagagaugacuuucuuuuucaaaaauuuauaauccauggccaaugcagaucuguuucagaaagaaaugaaaucuugaaaaguugugggcaaauugagcugugugugaaaugcauuaagagaccuuaguagcaaaaacuuuuguuaguagugaaggauguuuuggcgaugagaacagucaccucucuaacugaugacuuuuccuuccuguggccuuggagacuggcugguccuuauauccacccuugaagcaggauacgcaaguagaggcugcucuguuugcaggugggggagagaaaggcaaggguacugcuuagccucuggccuccagcugcagaucccuguggcagagcuccuagaacccacauugcuucuuaugaaacaucaugcacuauggcacuaacucacauugauggauccaguucugggcugagccacuuaaaacagcuggucgauguggggcaaauuacuuucucucucugcaucucaguuuucucaucugcaaaaugggcauacucauauaacuacuuaccuguuaugguugcuuaaggauuaaaggagauaccuuaaggcuuggaauaaugcuuuagcgauacuauaguuagcacuuaagaagugcaagcuguugucaguuuuaucauuauacacaugaucucauuuaguagucuuaacaacccugugaaauauauaaaaauuuaauucccauuucacagacgggggaacugaggaucagagagacucaaacuuauaucauuauucaagggcagagcaaugauuugaaccuacauaucugacucuguagccuguguucugaggaaaaauuuuacuagguucccugugaaauuccuguucccauuuccuuugggugggaggagaaggaagcugcucauuuaaacagguuugacaacgucagagcuuuucccacuaacauuugcuugccguguggguguucauuuaugcccgccaggcagaaagcaugaaagcaaauucauugaagaaaauuucuaaccaaggaaguucuaucuuauuuaguucugugaacagagaccaccuuuugaugaauuucauggaggagaagcucaguuacucuugcaaaaugucaggguccugcaggaguguagauaggggacugcugaccuacaaaaacagagcaaugaggcccucaggacaggcaggaagaaugggguugcccuugagcuucugggaggcuugcugagcaccggcacugugaugacagucuuggcuuaaucuaaaaggcauguccuuucuuuguugaggaaauugagcaauauugugucacuacaauauagggucacucccacccuaacccuaagccuaacccuaaccccagcgcuaaacccuagccccaaacccuaacuccuaaccccuaacccuuaaccccaacccagguacccuuggcucugacuaggccaguucuccuucacucccugguggcuuuuuggggccuucgauccuuugcaaugccagucccucuccagcagaugacuuuguaaccuuggccugaagccuccugcuccccaaugagaagaaccaaaugguaccugggaacgcagccgccucccuccccuccugucccuggccugaccuuuuccuucuuguuuucccugaaagccucagagaaccgugaaagcucuguaugacuacaaagccaagcgaagcgaugagcugagcuucugccguggugcccucauccacaaugucuccaaggagcccgggggcugguaaggcugaguggaggcugggcugcucggcaggugggcuugacuugucccuucuuggugauaagacucaggugcuggccaagucugacccccuuugucauccugggcuggcuuugaccucuuguguuaagucccuucuuaggaagguggcuuggugcaugcucuauuugagaaaauggauaaacaacaauauuaacagguaucgacauaucauaucauauauuguauauuauuauaauuacaacagcagcuaccauuuauugaagucuuucuaaguggcaagcagucugcuaauugcuuuccaugcauugucuaaccaaaucuucaaccaaaucuucauuacucccugugacaaaagaugcggcaaaugagacuuuccaagucacacaaauaaauacuaaauacuaaauagugcaggcgcuuuccaauacacaagacuguguguuauuuccaauucaaauucguaugcuguuccauagucccgugcugugugcaauggccacauccugaauugaagacaauacguuuuucgugcaaagguaccuggguaugcuaggguuuaguuaccacuucgcuuuuuaaccuuagaagaaaaauucacugcccacugauagguuucuggggaagugguuuuguggggugacuucugucugagagcaauaagaacuugcucauaauagugagcacugguuuaagcaccucauagacuggcauuucugccucccacaagauaacuggaccuggcuuaggaaucugaauagcagcaugcauggagugcuucuaugugucaagcacuguuuuaagcacguuugaaauaacucacuucauuugaaauaacugagucuacaugaugacuguaaaagguugguucuguuguuaccugcauuuuaccgaugaggaaacugaagccuucagaagugcagucacuuguccagggccacauagcaggcugagauuugaaccgccaggccuuuugacuccagagcuuacacucuuaacuccauucaucugcuaaguccuucccuguccucuugcaagaugccuuaauccagggauuaucaaacuuuuucuuaaaaucaggagaaccucauugcaaaccaauucauaccuagauuccacagaaucaaagaugcagccgaguuacccauugagcuggagugggggcguagaauugcccuguuuggccuccuugcugacauugcuguuccuacugcagccucugaugcuuccccuuggaggcucccagacccaguugggcaaccacaguguuguccgucugcuucucccaguucagaggcucggcuuugccgaagucccuccacucgaaguggcacagaguugaggucucuuccaggcacacuggcguucccucacugggcuccugucccugccuuggucaacauccuggugcgcacugggugggugacuaacaacauuuuuggaguuguggcuggagcccaggugacuacuccaaaucacgguuuuccauucugugugagauggccucaugccuuucuaugccucugacaggcaguucucugaauuucgaaggcucuugucuuaagagacugucagaagucccuuuggcaagggacugugggcaaaccgcccagcggcuguggucaauuccucucucugauggcaguagugcuaccuagggggccgccugggugaaaccggcuuuuuugcauacuuccaaacugguucccuguagcuaggggaccaaacaauuauugucugaaccaagaugcuccugagagugaagagaauguaaagugcucaguccuggacagaugguauauaugaucgccguaaauacagccagcccuugccagaagugggucuggagaaauggugcgggggggcgugaaaagggcuuacaacccgcaguccugugucucugcuaggugaauugguagcaucaguccucacucugcuuauucagaccaaaaaauuguuaaguucuucccaccaccacggagcacagacuugauuaagauccagaaaggucagccgggugcagugacuugcgccuguaaucccagcacuuugggaggccgaggcggguggcucacuugaggucaggaguuugagaccagccuggccaaccugguaaaacccugucucuacuaaaaauacaaaaauuagccaggcaugguggcccaugccauaaucccagcuacuggcggggcugaggcaggagaauugcuugaaccugggaggcgaagguugcagugagcugagaucgugccaugcacuccagccugggggacagagugagacucugucucaaaaaaaaaaaaaaaaaaauccagaaggauaucauauagaggggaagacagauguauaauuauacguuaaguauaagauguggcugcuuggaugacuguggggacaggaugccaggggaccacagaggaagagugcucagccuagggggcagucagggaagacuccgugggagaggaaaugcccaagcugagucuuaaauuaguggggggaaguuggguaccaagggcaugggccaaggcauggaagcuaggcagcauggcaggggcaugauagggacgacgggccagcuggagucaacaucauggagaguuaggaggugaugucugggaguccuggggucagacugugcugggccguggcugccauguugaagagucugggcuggauucuggaggcccuggggagccaucaugugguguggucagaggugcauuuuggagagucccuggcugcggaaaauagcucaagagaugggcagguugaaggagggcguuugcaugucugggcacggccuugccgggaggaaucuuagaggugcucaccgucuggugggguccaggaacauucauagauggauuaugucccguguuguuaguguuguuauaaagauagggaacaauguuuuagcugaauaauaauaagagcuaacacuauugaguauuuacuguguacuagguaggcgcugucccaagcacucagcuuauguuaauuuagaguccuaauaaaacccucugagggaagcacucacguuuaugcauuuuucagauggagaguuggaggcacagaaagccuccaccgucagugguagagcuggaguuuaauuccagccugucugccuccagaaccaccuucucucuaaauucacaaccuccccgaaauaggggugaacuuuugucuuguauggucucugacuuccacguaaagcauggaaacuuuugacuugugaucuuugauuaaacauuaagaucaugugauggggguaaaaucagcccccaguaacucauuaguaauuaaaaaauaaaaagacagcaguugccuuugagaugcuccauugucacagauagugacacuggucacuuggccacuugcugucuguccccaucagaauugagccagcagccgggugcagaugagcaguaguggguaauucaugccaccuggugacagcgcccccauguccucucuucuuauccagguggaaaggagacuauggaaccaggauccagcaguacuucccauccaacuacgucgaggacaucucaacugcagacuucgaggagcuagaaaagcaggugagucccccucuucgauccucuuacaggaagaagggaucugcagguccaguuuuucagggagcugugccaucucagugggugaauuuuuccaugugcugcuuguggucucuguggagcucuggaucagggaagacacagugaugauagggaaauugagauugaguuguugugggugaguugcugugacaagccggccguguuuuaaucagguuguguugggcuuggaaggauuucauuaugcaggagaauucccgcuggagugaaagugaccaaauggggaauuuguccuuugcuuaagcaacuugcagaugaaacacauuuauauuggacagccagacauugagaacgugcuuggggcgaguaagcaagugggccuaaccagaggugagaugaggccuuccuggugacuuugcaaaccuggugguuguucccucgccgccucuuguuuagagagcagccacuuucagcgugcuagcacuccaccaaggaugauaucuuuguaaugaggauuuuaagaucccguuagacccccagguguuuauuuucuaagggauguagggcaaucugggaaggcuuccuggaggaaggaguauuugacccuuaaaagucaaguuagaguucaacagcaagagacuggcagaagagaggugcaagugggagguacagucuaagcaaagguguggcagugggaaugugguuguguuccgugugcuugggcugaggcagagacuggaagcccuugcuuccucuguacugaguugcccuuaccuguacaucagcauuuaccuggugcagggggugggguuugggguggugcaggcaaggaguggaugccugguucugccaccucuccuaagcccaggauauucuucaucucagccagacccugggaugguucaagggugcaaugggaggcagagcuggaaagggugaugggggcucugaaagucuuaaaagccaggucauagagcauggguguugcuuccacaggacauggggagccacagaagguucuugagccgggcuuuaguaggcaaaauagucucauuuucuaauaaggucagauaaauagucuaggauguguuuggaaaccagaucugaggaagcauuaugaaaccuguucuagaauucacaaggcacguuuuuacggauuggaaaaugaaacuccgaaccuccuggcacccucuccccgccaggucccuaucagcuccaugcuucauuauuuagcucucuccccauggacguaucugguaaugaaaaugcauuuuaaacaguuccacaggcaguaucucugcuaaacggugugcuuuggaaacggguuuucuuuuuauuauucccguuacaacuaacgugaguuaugucuuguuucuucacagauuauugaagacaaucccuuagggucucuuugcagaggaauauuggaccucaauaccuauaacgucgguacgugcacacaucaucuuagccuggauuuccaccccuaucccccaugggcugaccucagccccgcccuacacagggagguggcugacacaggguccugucuugaaugccagcuccuucccuggcugaagcugaguauuuaggucaggcuggucagugaguaugaugcuaugucugcuauuaaucucuacuaaaacuguaagugcuaaaacaaggucucguacauaagugcuagauggugguuagcggauauuauuaccagcgucacucuuauuauuucaggauccaucuguguuucccaugcguugcgaaggaaagcugagcugucagccuggcugaaaugcagcguggaguugggagucuuggguucuaaacccagcucugccucucugucgcugugagacuacaggccugucacuucuccucuuugaaccucugcuuccugguugcucggcuggggcccaggaaacccagcccgcccacguugaccaugcugcaacgggaugugaaggcguggccccaaggcuaggcuuguccagugguggccagggucugaugugugcuggguuuccugggucuugagccugccugcuuugaaguggguguggugcagcucccaugugaagggacucuguagcgggccuccuuguucugggcagcccaugacccucccugggcaggcacgggcaugcuccccuaggacucaggugacagcagccccaggaacuuccugcuucuauugccaaugcucugcuuuacacauucauucauuuauuauuauuucuuuucgcgauagagucucgcugugucacccaggcuggagugcaguggcgugaucuuggcucacugcaaccucugccuccuggauucaagugauucuccugccucagccuccugaguagccgggacuacaggcaugggccaccgugccuggcuaauuuuuguauuuuuaguagagcuaggguuucgccaugugggccaggcuggucucaaacugcugaccucaagugaucugccugccuuagccucccaaagugcugggauuacaggcaugugccaccaugcccagccugcuuuccacauuuauaaccugcuucuuuaccuuuacaaugauccagcaggauagguaggagagggauucuuugcuccgauuaccagaugggaaaaucaagguccuaagugaccgaccaccacaugugcugagguccuuugggcaggggggugcaggaucccugcauccacuucuggugcucuuuguaucaucuucccccaucccuguaucugcagagcagaggcacauggcucauugguucugaguagaaaucuuggagucagguuugaacugagccucaguuuuacuacuacuagcuguaugacuuuccacaugugacuuucucuuaaugagccucaguuuugccuccugcaaaaugggccuagcaaaagcagggugccuuuagucucagcuacucaggaggcugagguggguggaucccuugagccccaagaguuugagaccagccuggauaauguagcaagagcucaaaauuaaaaaaauaaaauaaaauaaagaugcaauacauguaaucugcuuagaauauugccugguauauaagagcucagaaaucuuagcuacuaauauuauuuggcagauaaguuucccugucauaaucuuuucuucucuguaagauccuuucucugugucuggagaacccacgccacauuucucuccuaguuucuggugacucuuugguguuuuuggcucauggcugcauucuucagucuccacauuugccugcacauggcuuucucccuugugucugcaucuguuuuuaaagccauuuagcugggugugguggcucauuccuguaaucccagcacuuugggaggccaaggugaguggaucgcuugagcucaggaguucgagaccagcccugggcaacauggcgaaaccccucucuacaaaaaauacaaaaauuagccaggcuuuguggugugcaccuguggucucagcuacuagggaggcugaggugggaggaucgcaugaacuuggaagguggaggcugcagggagccaagaucgcaccacugcacuucagccugggugacagagugccacccugucucaaaaaaaaaaaaaaaagccauuuaaauuauuuauucuuuauauguaaaagauuauauguaacaacauagaaaauuaugcacaauaugcuaagugaaacaguucacaaaauuuuauguauuguauguaaacauuuuguaaaaaugccaaguugcuuagcuauauuuuaaauauuuuuaaaaugaacauguauuguuuuaguaauuuguaaaaaauauuuaugaugaguguaaaaagcauuuucuaauuggucaaccaaaaagauauucaguguuucuuuugaucaagacgaacacaugucuauaacuaaaguggacaagaggguauuuuuuucagguucucucaugcauuuuaauguuuguuuuuuuuuccugcaucuuaagugucccucuccuuucucuuauaaggauacucauacuuguuggauguuggaauugcccuaaauccaggauaaucucauauugagauccuuaaccuaaguacaucugcaacgacccuauaaggucccauucacagguacuggugaccugacacaucuuuucggaggacccuacugaaucuacugcaucccuugaguagucaucugugauguguacuuaccccgauggaaaguagacguccccaucagugcuaaccguggucauagcaguggugguugguccaugagagaaacagcucaggcagggugcagucuggucuuuguggcccucuaauaggcugauugggacauuucuuauucucuuaccccaagugaaagccccucagggaaaaaaccagaaguccuuugucuucauccuggagcccaagcagcagggcgauccuccgguggaguuugccacagacaggguggaggagcucuuugagugguuucagagcauccgagagaucaccuggaagauugacaccaagguaggcaccugcucacccgggugcaggugggccuggcauucugagggcuuuggugcucaguugggacuguggguggguccaggcagcaggaugagcaggcccagguccuacucagaauucaggaaggagaccagguggauucagacaauuggagcaccucuuguuagagagaggcagggauaguggaggugcccugggaaggugggucugguugucugguucgaaccuucagaaggcugagugccugcagcaaugcucauugaugaugucuuugcggcccuacauaucuuaccaaggaaguuacugccuuccucauuuugaauauuuucuuucuaaguaucauauaaagcagucuggauccuccugacagaaaacguucacugagcucaccugccuggagcuggaaugggcucugggaacauagcaaaucagcgagacccgguucuuuccgguggaggaacuuccccucuagaugggagugaccuuuucagggcuguccuaccugaaguacuagucucuggcuggaaguguuuugggaaggugugagcuucuggauaagaauaggaggucuggaauugggcagacuggaguuugcauccuggcagggcuggacccugggcaaguaaccacacuucucugggccucaguuuccuugucugcaaaaugaggagccaaauuccuaacucacaaguacuuaaucacugccuuaucauuauaucagagcgacaugggaaagugccacccugucuucgaugauggaguaagggcugucuguucuuguggcugccgaacuggaaagaaauuguaggguuucccaugcacccauuuguuucuaagguagaacuugacccaaagggcugauuaaagccuuccuggggccucuugugcccucugacuucuggcuagagucagugagucucuccuccaagauagucacccaccaguggccaggucauuuuuuuccccuugggagggccucacaucuuggccagucccuggucacgagaggauccuugacucacucaacucuucugcagggaaguguccucuuuaggagacuuugcagaggggacugguccaugggugcccucgcugguggggcaucgucuuucucugacccaggaacuccugggggccuucccuagggcuccuaauucuucccauggcuuuucacaccaccagccaugggggaggaaccaugagcuuguagccagcugcgcuguccuucuggcuuucccagugaaaccaucucuucugcccuccagugucucugaugccacaguacagcucugaggcacagggaggugccacgacccugagguuuauuuaaaaaaucuccaaauagugcacuccagcucucucuacuuugcuuaauguggaaaaguguuauuucccuagaaggcucugucucuccccugccucacaccuccucuccugccgcgugaagguuccugaaaugaagcugagcuguucaagguugcuguuggcggccuuuggucugcauuccucucuaacugguuuuuauauuuacugagauuucaugagaaugauuuuuaaaguccuguuauuacaucugagggguaaaaaaacugggacaguagaguugacggaguucccacacugggcacagcuaccccuuuugcggagcugguguuggggagcaaaggaagaaggccccaucccacucuugggaaaccagcggcggauaaacucuuugucacugccaggaccucugccugucccuaagugcccgcauuguuacacggucuguagccaccucauugauggcagagggcagucacaaaauccuucuaguuaguggguuuccagagccucaccaacuguauugugacuucccauucugagauggcuugaggggugacagcugcaggccuggagaguaauugucaugcuguuuuuuguuuuuuuuuuuugagacagagucucacucuguugcccaggcuacucaacuucuuuguuaaauggagauaauucucccugucaggguguggauugacuuagguaauaucccucaagugcuuagccugugacggcuagagcuaagcaccccccaaacagucaccauuauuaucuaaauauucucucaagguccccccuuggccaauaaaagucugauagaauuuggggaggcccaacaggguugccugcuuuggggugaagugagaagcucauccuuacaugcaaggaguuagauuugauggugggucuucugaagggagguaccuccugaguccauggcacauggccugggcacuggguagugguccccuuggacagagcccugaugggcagucagagcuggggagcaggugugcagguuuugagggugcaggggauagagaguuaugacgaggaugcugggguccacagagcccccgaggauuugaagaacuagaauuugagacacucuaacaguguggcuuuaggggaggggacaggaggcagaguuaaagacagagggguggugacagagaagagcccccuuccauccugaccucaccuauauuugagggcuguggccaggacugagcugcacaccaaaaccucguggaaacagcuuugucgagaauuuucacagugagaggaagaaacgagaggggcaggguugucuucaggaaaggaaaacauucaaccauauuaaagauccgagugugcaagaaagcaaaguggggauggaggaggaaaaaugcagggcgagcugggaagaugggauuucucgggggcgggcacuaaagacagugaacuccaaacaggagaacaacaugaaguacugggagaagaaccaguccaucgccaucgagcucucugaccugguugucuacugcaaaccaaccagcaaaaccaaggacaacuuagguaacaucuuucccaagaacaugcccuauaacuccaaugaaaacuuaacuuccuuuagagucugauauuuucagagggggcagagagugcauucucucauucuuaacuacucccaguagauggccccaccuuggguuuguccuccgagugagggagcugguggcagaagcuuuuuugguguauuaguccauuuucaugcugcugauaaagacauacccaagacugaguaauuuauaaggaaaaagagguuuaauggacucacaguuccacguggaggaggccucacaauuauggcagcagaggagagagaaugagaagcaagugaaaggggaaacccuuauaaaaccaucagaucucgcgagacuuauucaguaccacaacaacgguacaggggaaaccacccccaugauucaauuaucuccuaucgggucccucccauaacacgugggaauuaugggagcuacaauucaaggugagauuuggguggggacacagccaaaccauaucacccacuuaguggguggauuuaguucuuacugccauuaccacaaacuugguggcugaaaacaacauuuauucuugcacaguccuggaggccagagucugaaaucaguaucaugaggucaacaucagggugccagcagggcugugcucccuccggaggggaaagccauucccuucuuccaguuucugggggcugcuggcauuccuuggccuucuccucuucugcuucccuauuauaaggacccuugugaugcauuagguccaccuggauauuccagaauaagccucccauuucaagcuccuuaaucacaccugcaaagucuguucugccauauaaagugacaugcacaggcuccagauauuagggccuggacaucuuugggggccauuuaaaaaaaaaaagaccuucuaccacauucuccagguagcaagcuuuuugaugaugcuguacguauuuuuuucuuuggguguuuugagcugcuuccauaucuuucaucuuagaacagaagaccagccagacaauacuagaccccucaguuaacuuaccgggaggccagucccuaggaacuucuaccuucagggacucagcaggcucagcauguugacugccgggcuaucccaccacagcuggaugggagagaagaugaggccuguccccuucccucuccuccuguucucccuucccugcacaggcacccacauugcaacccuaccugugggcuuuggcaggugauucucaguuuguucaucuugugucuguggucucucuggaucuuccccucccaagaucuucuccuacccaaaaccauucccauucucccucuucuauaacuguaccacuuuuguguuuucuuguucaaggauggugauaguuuaaaaaaaaaaguaaauuacaguaauucuagccuaaaagguggugggaaaacuaggccccuuuuuaauacuuggaacccccagagggcaagaguccacagugauaccaauugggacaauaucaucagaaccccuugaaugucaaagagggagauuccugguuuccuuuuauaaucugagcauccagccauugcagcaaacauuaagaaaaugcacagaugagacacagaaguacugaugaccuuuuucucugugugcagaaaauccugacuuccgagaaauccgcuccuuuguggagacgaaggcugacagcaucaucagacagaagcccgucgaccuccugaaguacaaucaaaagggccugacccgcgucuacccaaagggacaaagaguugacucuucaaacuacgaccccuuccgccucuggcugugcgguucucagaugguggcacucaauuuccagacggcagguaaaggccgacugaagguagucccgucccugcaagguggcgguugcagucacuccaggccgagucaccuugggucagcgauaccaugugguguccaagaaugagugauuuguccgagggacugcacgguucagcagaguaaugguuaguaugagguccagcagcugaauggagggaugagaggaccgaaggcugcuuggcuuacgcaggcuucgugauuguaaguaagugacagaggcugaguuagucuggcuuagaaaaagaaaaugcauuaguucauguaauuaaagcaucuuuggaguucucuucuccaggccuguugcugugugagggcuuucugcucagacuuucuuccagagacauuuacaugcuggcauaacuaacauacacaaacuucuggacacaaagugaucgcauaaaucacggggcuuugugcuuuuguuguuguuauuuaagaccucuuucgagggaucuauucaucaguagccuccuuuacauucuuuuuauagccacaucggauuccacagaauggaacaaucauuuauuuaauaaguccccguggaggcacauguagguauuccccauuauuugcugucauagacagcacugccuucuguacccugacgugagcgccauuccacagauguaggaauaugucuaugggacagaauucucagaaaggcagggugggucaaacagcgcuugcauuuugaucaacuuugcccugaggaaaaccacugaagacgugccugagcuaagccacacugccaaacugcccuccauagagaucgugggcggggaugcaaauagguggagguuggaguacgcucuuuugguaugacuucgcugaguuuuguugaacuuuuugccguuugcacaacugagaggugaaaacugauacaucgucguccauuagagcuucuucuuguaagggacauuaaccaguuuuucccucauuuagggagcaguggcauuuucuuuucugggaacuauuugugcuucuuaccugauguaucuacugcaguagguauuuauagcauagauguaucagaacuaagagguuaaaaauuuauauucacauauuugucauuugaauuaaaauugccuaugcaauuuauugcuacauagacacuuuuagcaaguuugaaucuuuucuuuuaugauucgggauuuggugacauacuuggaaagguguuccccagucugggaguuugcugucuagaaacccuauauuuucuuugagugagauaccuauuugaacagcugccucacauuaauuuggggaaaaggugaaauucauuccccaccuagaaacuccuggccuagggggccagcgugcucaugccugacuuacagcaggcguucacuuuccuucccagauaaguacaugcagaugaaucacgcauuguuuucucucaaugggcgcacgggcuacguucugcagccugagagcaugaggacagagaaauaugacccgaugccacccgagucccagaggaagauccugaugacgcugacagucaagguaaagccagcccucccuuccugccaggggagccagccgcccucccugggggcugggccgaugcugucuugagagcagggaacccaugucuagggaggcugguugucuuguuuaaacgauccccauucaggcaguguuugaggaucuuucuuucuuacaguacacuccggggucguucugggagaagagggaagagaggggaaaccuccucaaacccacuuccccuuguccucugugggggugagguaugacccuaucuuucugggguccuggugaggucagccucuggccggaaagagaaagaaaacaugggaaacagccauuuggucuuaauggagaaguuuuuucccuuacuuuguccaauuccagggcuuuuuaaaauucaucugacuuucagagaaaguguuguugcuuuguaagaauuuuugaaaaguagagaaaugaauugcauuucuccuaagguuaagggcgggcgggugguagggggaagaagcauacguaaacacaggccuuuaaauaaacagcaguuauaaaaagaaugccacacuguuccucagccuuuccuagggguguggaaauccagugauuaagcucugccuugaucagaggcaccugcuugggcauggaugugugcauucaugagcucaggugaguuuuaccuguugagucagguggcauauggggccgagacccaggcugaugcugaggaacugugggaucuaccacaguccaccuucauccacugcagaagguugcuccggcuuuuccagugaaucuaggaaaauuagggcuggcauugaacucauccagugucacucuagaacccagcugcaauccacgcuaggcugccuguucaggaccccagggggguuccaaugcuucccuuuggugucccagguucucggugcucgccaucuccccaaacuuggacgaaguauugccugucccuuuguagaaguggagaucuguggagccgaguaugacaacaacaaguucaagacgacgguugugaguaagucagucaccuuggccccucugcuuuuaaacguccggccagugaauccuuugugggagugcucuucgugggggauuuugcaaugcucuuuaguugucccaggguuuucuuuccucccucuugcccacaugguucagcuugaggaggggauacauacaaagggccacuuucugaaauccuuagacuuuccccagugcuguuugccugccuguaacucaaguccggaaucguaggugaggcccugacacuagguugguccucucugugcaacagcccaaucugauuaaucuccugagucaaaggccaagaggcagagacacagagagagggggugaaccuacguggcugaccugacccagaggaucagccuaaccugggagaucuuagccccuagagggcaggagggacaagaggaaugcuugcucuuccaggaaaagccaggagggaaccgugauuggugggccuucuaaagcacaggauccuugccccugguaaaaaguagcccaaugaacaacucagaugcugaccaaauaaacuggcauuuauggagaguggcaggauugcugcuugccugcucugugaggcugggcucuccccugccagcuguagaacccccugcugguggauguggcucccaggcucuccuccccuuuugucuuuuccaaaauccaccuuccugcucugcaaacaaacaccucccccguucccuugucccugauccuggggcggggagaugggagguggucuccuuccucugcucaccaagggaccagccugcaacagcagcuuccaggauugcucaagguggggugggggagugaagauaauuauucagauuuucuuagaucuuggcauagaugcauauuuauuuacaugguugcuaaggggauucacagcugaaggaugcggagauugucuuaccagaagggggcagcuccaauguggccucucaugagcuuugaucuccuuccagaugauaauggccucagcccuaucugggcuccaacacaggagaaggugacauuugaaauuuaugacccaaaccuggcauuucugcgcuuugugguuuaugaagaagauauguucagcgaucccaacuuucuugcucaugccacuuaccccauuaaagcagucaaaucagguaagaggcauuuuaauuaagauguucgauuugggcuggcguuguacuuugguuuggcugcuggcuucaaaaagaaugaaaaaugauuuuuccugguuuggauggaaucacuguaaaaccgauuggguggcuuggagagcagguguacagccugucguguagcacacaggugggaggaagugggugacaggggaggcuaugccccucaaagugggauguuuacaagcaaaacuggauuguuaguggauccucaaccuggcacugcaguuugauuucauuuugaaauauuacaugcgguuugcuucucccuagcuagggcuaagucugguuugaucucccccuccugcucucuggcuggcagugugagaggguggcaagggagagaccuuuggcaucuuggggggggaguaacaaucucgaggguccaacuccccaaacccuucagaauucaccuucuucuucuauaaaauuggguggguuaauuuacuucuuugaguuguuacaguuuucuucccugcugaagaaaacacaagaucccuucaugguauaagaagggucauuuuguauuuuucugcaaccaagccaagcugggucauacgaccagcucuuaagaacccugcugaaucccagaugacugagcccuuccuacacagcugagauagacacuuccaggugaggggauuugggacccugcugcuucuagagccagucauuuacaaaaacaaaaaaaacuggcucuccuuagcuucuauauaguuucucuaguuuacuuucccacuggaucuuucccacuggauuuuagguauaauauuugacaaauaggcccuugcuggauguugaauuuuccuucuuccucuuccuuuaguauuucugaugcauggugcaugagauaugagaucauagauucuucuggauuccucaagaggucacuguucccuuguuuucugaggaucauuuuucaagagaaagaugacugucauuuuaguuacuuacauaaaaaaauacagucuuuugauauuguuuggaaacguggggcucaaugaagagcugaauuggaucuuuuuuguuuucagacauucccucaacuuccaccuuuuuuuguauaauaucauaaaccugaccauuucugcuacugggcaggagcccaguuucugagcagcaggcaugcuagaaaauccaggugcuggccgggcacgguggcucacuccuguaaucauaaucccagcuacuuggaaggcugagguugcaccacugcacuccagccugggugacagagcaagacucagaagaaagugcagguuccuggacccaccacagggugaugagucagcccaggguggggccaaggaaucugcaucuuuaggcagcuccccagauggugcuuggauggcacuuugacagaaccaaacuaugucaaggcugccuaucuuaccauugaggaaaugaauuccuuagcaaguuacuagaugaaacaagacuuugggaaaauguuuaaaguuucugauuuuuuuuuuuuuuuguacucuagaaauguucauuuucaugaacauugcuacucuagcaauaauaaugaguauucauuuguaagaggccugauauuuggcaacccuucuggguuaacucacccacacuguaaacucccccuuuuuuuuuuuugagauggagucuugcucugucgcucaggcuggagugcagugggugaucucggcucacuguaaccucugccucagccuccucaguagcugggacuacagguguacacuaccacaucuggcuaauuuuuguauuuuuaguagagacgggguuuugccauguuggucugaaaaaaagugaugggauuaaaggagugaaccacugugccuggccuauaaacuacuuuaaacccggcacugaucagggcugugauuccuuaauuugcuucuuuuagauuagucuaauaaggcuuaggaaugacaccaauucuucuggugcaggaaguguagcuuuugguacaccuuuacguuccuagccuugacgcuguaacagauuucuuuuuaugguaacugccugccaguuccucuacugaacucauccagcagagaggggcagcugugcugaaaccccuugguuaccccgacguccucuugaaggaugagggccuugagccucauaaccccucccagugccuugcagagaugucagaguugaugauaaaaccucguuaccuuaaugggcaucaaagugugucaauucaucugcagaaugcaaugacuuagcuuggagauuuggaaaaaacaaaggucaaaaccucaagggagauuaaaaaugugaccuucuccucccccgacugugagauacucucagcagggaccuuuccucacuucuuucuagcuccuagcagugccuggcacauccauauucaugggaggaaugaaauagaaugaacaggaggcauugagggucuuccauacugaaaaaauaaacuucacccauugucauuagagaugcacugaagcuuuuaaaccaguuggagcgcaggaaggaaagcagcagccuuuauuguguuagguaccuuaaacucuuucucuuuuaauccucacaguaauccugugaaagggguuuuaucuuugguuuuaaaauucugagcacuuugaggccgagagacuaugacuuaacuugcucaaggucacacaccuguaggaccagagcugagauucaaacccaggaaugucuaauuaauuucgaaccccguguuccuccucugcaggcugcccucucacugggugcucaaagccagaugcauugaucuuacuuuaaaaggugucuguauuucccuuuccccagugaaaugacuagaaacaagaagaagaaaaacaauuauuuuuuuuuuuuuuauacaaggagggcugcccagugcauaaaaaugggacuugggcagcgagagaagguacauagagcuggagacagcuggucaugagggcagagcucaugucuccgauuuaagaggcacacgccuagugucagauaguacuguccagccuggaaccaugcuauuggaguguaggggcuaccugauagccucccggaaugccauggagcaaacagucauuccaguucauucuaacagucaaucagcagcuagacuguauuaguccguucucacacugcuauaaagacauaccugagacuggguaauuuauaaagaaaagagguuugauuggcucacaguucugcaggcuguacaggcuuuuguuucuggggaggccucaggaaauuuacaauccugguagaaggggaacaagcacauauuuacauggccagcaggaggaaaagagagcuagugaagggggagguacuacacacuuuuauuaaacaaccccaucucgugagaacucacuaucaugagaacagcaagugggaaguccacccccauuauccagucaccucccacccggccccagcuccaacaguggagaucacaauucaacaugagauuuggguggggacacagagccaaaccauaacauagauuucuucaccaauguccacagauuagcucauuagagaugcagaaucucaggccucaccccagacuucccaagucagaaucugcauuuuaacaagauucacaggugauucacauuugcauuaauguuggcauaucacugggcuagucugcaagaauucugagucucuaucaaggcaaaaaacaaacuagcaacaaaaaucacauuguagcgauagggaaaaauaggucagaaaacuucuuuacagcaguauauucaaugagagcaauguccccauaaacccuaccaggaaaugaguggguauaaaacauucagguuuuauacccccucaaacugucacucaaguauaaaaucaaaggauggaugcucucaaacaugcacagcucaggaauucugugucccaugggcucauuuugaagagaacaaaagaggacaaauuuagccaaugaaggcauccacggaauucaguaagaugaugagcauccagccauuaaaaaauauaaauuuguacauuuccuuauguauaaaauuguguaucagaagaggaacacuguaaaguaauacugagcucuggguggugagaugcaugcuggggaaaguauauugaugucuuugucauacuuugaauuguauacauaaauaagauggauugauggguagauaaauccaugacaaaacaaguacagucagcccucuggaucuguggacucaaccaaccaagcuuggguugaaaauauuuuugaaaacauuauguaucgaacauaugcagacuuuuuucuuauuccuuaauacaguauaacgauuauuuacacaguauuuauauugucuuggguauuaaaguaaucuaauuuaaaggauaugggaggaugugcauagguuauaugcaaauacuacgccacugaauuaauuauuuagagacaaggucuucccucugucacugaggcugaaauucaguguugugugaucauagcucauggcagccucagacuccugggcucaagcaauccuccugccucagucuuccuaguagcugggacuacaggugugcaucacugugcccagcuaaauuuuuuauuuuauuuuauuucuuguagagaugggggucuugcuauguugccuaggcuagucuugaauuccuggcuucaagugauccuccugccuugcccuccccaagugcuaggauuacaggcaugagccaccguacuuggccaacuaugucauuuuauaucagggacuugagccuccaaggauuuugguaucuggggagguccugaacgagucccccauagauaucaagggccaacuguagaguaaaaguuucguacaaucuaggugguggguauacaaguaauccuuguaauuuuuuuuaguguugcuguauguuuaagaauuuuauauuaaaaugccagaaaaacauaagccucccuuugugggagaauuaugguuacaaaauggaaugcaaauauuauauaccauguccauacagaaaugacaauacaccuuagggguguaaaaggagaaauuggggagagaaaaggaacagguuuguguaagaaugugaccuuccucuucauaagcagcggaaagugagagauucaguggauauuguuugaaggugauaaagcaacugagaguauaaaauguuccaagagaaauaagcccaaaaucugaaugguggaaggcacagaggaaacagugggaguguccuauuuugggcauuacuuggagaaucaguagauaugauauaaaugcuuucaagacaaacuaggaccacagaaaccaucucugagauacaaugcuaacuggguaaggcacuaucauuugugauuaaaagcaacucaaacauaugcauaggcaaucuugggaaagauacuguuaaccaugguuccuuuuaggacagagaggaggauugggugggagugaccguucuguuucagcccuguguucuuuuauacuaaaacaagccagcaaaccaaccuuugagauguguugccuuaaacauuacugaaugggggugggggagauucggcuccaacuugccccccucagccccaaauaaaaagaaacauuuaaaugacugugaaagacagguccuaauuguaaagagggaauggcuuuaggaggaggaagaucaauacugcuaugaacuacuaagggacagaaagauuuccucccauuggaaaucuuuaaagauaaaacacacucccugguccugugcuuuguaaggcuguaaguggaggaaauggaugaggauucacuacucuuuuggucucaggaguauuuaaggaauugaaccacagcugcaaucacuacacucaauguggaauguucuguggguuuuaauuucuucugagugaaucauuuuuauuucuagaugguagauauuuuuaaccuugcuucccuguauggaccagucagucauggcugccggccucugucccuaaccaucaggauaggaccucuggcuuccacaaagucagcccccagcauggggcacugacuucucuacccuuugaacuaggccuaugaucccgagguagccuccaaaaaaaaucuaaggucugacauuaauuaccugccuuugcauuuuccuccuuguucugcuucaggauucagguccguuccucugaagaauggguacagcgaggacauagagcuggcuucccuccugguuuucugugagaugcggccaguccuggugaguggagaaacaccaguuaaggguucccugagcuaugccugcuggugaggguagaaacggcccgugaauacaauuggcagauggacuuaagcccauucagaauugucuagcccaagcaugagacaucauacaagaauuccuuuuugcuaauuccccagaguguccuggguuuucccucccagcauccuccuuuccuggagaaugcugugugauucuguguaggcaguguaggaaagggugccgguacuuguaaguuccccauaguuucacuucagcaagagccaggccagaugaugccuuccuagauagacucauccuuucuggaugcuuuuuggugccagugcaucuuuaggaauccuaucaaaaagucugauagccuccaaucaaguagaaugaccauaaauuaaucaccccccaagcugagcauuuagauggaauccauuuacaaauaaggcgaucaugcacagcuuuaggugaguaccuuuuuccuccuuuacgccagaauucuuuccuuaggaucaauacucagauauagaauuagugggaucaauuaauuuagcugaaugguaaaacuguaaaaccugggcuuuagcagaagccuuaaaccagugagcaugaagacccuuugcuuagugaagcagacccuuugcuuagugaagcuuaucccuccccagcucacugaagaucugggauuugugcaucuauugcccggggaaagggaaccagugcugcuucucucuauacauaaaaccccuccgcagacacuucacagaaaagucaagugauaaaaaugguuuuagauugugguagggcagcauuugccuaggcccgcugcucugcaaggcuguuguaaacaaccggaaacauuauaaauaauuuaagugauuagguaucaccagcagcagagaaaauuaguauauuuaaaagaaaauuguguugaugcagauuugacuuccuugaugagggaagcuuaaugccggggcugccacuguagggagccaggggcguugugugggguucuaaauggaaagucgacgcucacaaaucugcuuucugaaaguuuucuuuaguucagcugcuaggucuugagauuucauuuaauuccacaucugucaccugguucugugccacucacaggugcagcucggcauuucuguccacacugggaugaagagucgcucuuggaagccgagcugaauugcauucgguagaccugggcuuucuccuuaaugcccacggucauaccuuuuauuuaucaccauauccucuggaagccagggagaaacucugguaaacagccucaaugcagacuuuucugagcaaaugauugauccaguaagggcuaagauggaguuuacucauaaaaccuuugcugagauagaguuuacagccccagaaaacugucaauaagcacuuuacacaccuucugaagaagccauuuacaugucacaauuacuuuaucaagucgcaguccuuuacuuugcuagcaguauguuuguuuaguuuauaaagaguauuuuuagcaccauuuuauuaccuacuguauuuuauuuaagauguaagaaaggugggggaguugaaaagagucccccagauagccuguaucuaacgaccguuaccaucuugguagauuuccauugccuuaugauuuuuuguauaugauauuuccauagucagauucauacaggugcccuuuucuacuucacagacgacuuuaaaugauuuucaaagccauugaugccuguuucaucagguaugggucccuaauucacuuaugcuccuacuaacggagagucaagucguuggcaguucuuuacuuuauaaauaauauaggucuucauguaauauuuucugauuaaaaauuauuucccaaggcuagauauuuagcaauggaauaauaaaucaaagaaaaaaggaccauguauuuuuaucugcaugucaaauuguucucugcaaguaaauaguuucuccuaaguugucguauuauaucccaucuugccauuaacuggaauaggccuccacuggaaugauuuaacauggugagaucccgaagaaugggacuggggaaaauaggaaagcuuaaauagucaucaucuuccaugggcaaacuggccauuucuggagggcacauuugagaaaacuggcugccccacgaccuguuuaguacugauccuggguggacuggguucuguuuugugcuggguaggagcuaaccugcaagggguggagaggcccuucuuuagaguggaagaaaacccaggauguugugcacuagauuaaggcuuauccuagagcagaugcuugaaucccuuuguagaagauugcacacuuuagaauccuggagguccaggacugggagcugcacucuggcacugagcugguccugguuuuugagguugggaaagauuuccuuacaccuggggagaccuggagggacacaaaggcccuccuuaugccucaucagcuaaaguuggucaguuugccuaaugcuggcuccaaagagcaaaaacugcuguguuuaacauccaugacccaagagugugacaugacuacugaacacacaaaaccaugagcaugcaguggaaaaagaggaagacagacuaagguacacaccuggaauagauggcuggcaguugaaacugagccaguggaaaccucagaugaugagaacuguaacacauaacucauaggaucuuucaaagacauccaaggagagcacuggagaaagcuuucuggaauucagagaauagaccugauuuguugcauuaaaaaauucaguauauaaagagaucugcauuagugacaccaaagauaaugugaaggaaaagucucacaaucuagggcaaccccaccaugagauggaaagaaaggaaaaggugggcugggaggacagaugccaaggaccuaauaugaaagcaugucccaaaggacaaaguuaaacagacgguggagagcuauuaaugaaauagcgaauaaaggaaguguuucucuaaucugcugcuucugagggcccacuugguugcaggugagaugaauagaaaacacauccauacccucaguaauauuucaguaaaaauguuaaguuccaaggauaaauuuaaaaaccuggacuuccagcacacuaguuguguauaaaggaaacugaauaagucuaauaucagacuuguccucuuuggugcugaaaacuaaaagacucccaaaguggguagaauguggacuaggaagacggaauaauucaguguccagcccccgacaugucaaggaauuucaagguaugcaauauuuuagauauaucauguauccuacucaagggaaaucuugaggcagccccugaaucgaugauuauuuuagucagaaaagaaaacuuuuagauagggaggugaagagagggaaaccagugaauaauuaauuuugcaguacaguuacaucuuacaggaugaugacagugugauaaaaauuuugucaugguaaauaucaaauaaggauuuuugaauuggaagaaauauaccaugauaaaaaaugacaaucaaaagcuaaaaaauaaucaaguaucaacaaagcaaaggcauggaaagguaaaauaaagguaugcuaaagguuauuucaacuuugacgacuagggaaucagucaguaaauaaacuauacugcagagggagauuuaaugcuacaucugauguuaaaggaaacugugauuuuaguuagcauuguuagacugaggguaaccacugucagaauugaaaaacagacaagaaauaaggaggaaaaaaggagaucaacauaaacuugaccaagagaguaaaaauaauguaaagaaucagaauaaguuaaagcaagguaaaauguguaguaauugaagugaaauggauaagaacuuacauuuaauuuggugaauaggcugaauccuccuauuagaaaagaaaucuaccugcaguguuuacaacaagaggccuaaaggcaagguaaauaaaacaaauaggaauggauggaagaguuacugggaaaauugggaaggaaaaguuaacaucaaucuagaauuuacgaucagaaguacuacaguguauuaagacgaacaauaugugaugauaaaaugcuuguuuucuaaagggauauaaaagucauuagcaaauagcauaguaccuaaguauauaagacaaaaauuccuacauauacaaagacaacuguauaaagaaaaaaucuuucagaauuuggaaagucuuguauauaagaaaucagcaaagacauaauaucaaaauaauuugccuuaagaaauauacaacuuuguguccuacaaauggauaacauacacuauuuucuucugucucaaacuucauaaauuugauugcauucguuagaaaacuuuaauacauuuuuuaaaaauaaugauuuccuaagucauuggcuguaacuggacuagauucaaaagacacaaaaagauggcaaaauugcucacaauuugaagauaauaauuuucuaaauauacuaaaacaaguaaauuacuuagaaaguaaaacauuuaugccauaguuacauuuagaagaggaaagugcuugccuuaaaacuucacaaagaaugaagacguauguacuacuaaguauucaucuucagaacuuuuaaaacaccaauaaaauagaacaaaggaauaaaagagauagaaaccaacugaauaaaacacaaauaaaaauaaaaggauaaaaagaauaaaacauucugguuuaucaaaaaggccaaauuuuguuuugagacaguguuuuuuucugucacccagccuggaauacaguggugugaucauggcucacugcagccuugaccuccugggcucaagugaucuuccugaguagcugggacuacaggcauaugccaccaugccuggcuaauuuaaaauuuguguguguguguggagacagggcccugcuuugcugccuaggcugcucucagauccuccugccuuagccuccccaagugcuggaauuacacgugucagccacuguguccagcccucaaaagaccaguuaaacucuuugccuacuuaauaaaagaauaaagaggaaaaacauguaagaguaaauacuggaaaggagacugaaccccaaauaauaaacuacagcaaauggaugauuaccuuaaagaauguaaauaggcuaaaauuguucugaaaagcaguagaaaaguuaaaacaccuauuagauaaaacagguuuaggaucuagaugguuuuauagcuuaguuuugucuucauuuaaauaacguaauuccaauuucacuccaccaaaguaagaagaacaauggaaauccuucuucugucuugaagcuauacaacuuucauaucaaaacuggagaaagauaguacuccuagcuuuccccuaaccucauucagccguagaccaaugucaugugugaauauagauguuaaacuucaaaaaauagcaaauauccagcuguuuacuagaagagcaauauauuacaacuaagcauuuauucuggaaugcaaggaugguuuaacaccagcacaguuagcaacaaauuaaauaugaaaaaagcauaaacuaguagaugccauaaauguaaacagccaaaugaaauaaucaguauaauuuuagaaaaaaggucgagugaucucuauuguauacaaauuuaaacuguacaaauucugauuguauaguuuacaaaacaggaagacuucaauuuuaaagagacugauguuuauuuuucuuguauuuauugaacguaaccacuucugucuguucuagaaguaacaaacagaaauguggugugggaggaagggacaaaugggacaucccauuugugauacugacaaaaaccauaacacauuuaggaguaauuuaaauaaagguacagaacuuauauaagaaaaaaacauaaaaucuuauuaaaaaacaaaacaccaugugaacaaguagaaauuuauaccaacccuuccaaaauuaauguuggauuggaauuggagguaucaauauaaacucaaguuacauauauauuuauauauauauauucacacguagaugaauaaauguguguguuuacauguuacuacaaauacauacauauccuagcucacucugcugagugccuagaacuuaugacaccccagucauuggauucucaauuccagauauugcuaaauaucauaugccaauaaaaagaaaucagggcuccuuagacaagugguugauuuccagacaugggauaaauaaaauauaaaaaggaccuggagcaucuuaacauuucaguaaauaaagaagugcugaaaaaaugguggaagcacaucaaaggggccuaggaaccaaccagggagcgcucccaauggccacagcuggaaccauuugcauagcaaaauaaugauaauaucagauucuagcacacagaaugaaauagccacaugucugugaaugaaugaauacaugacagagaagagauagcucuuccuuacaaaugaauucugauuaauaaauguagaaggaaugagggaacuagaaaaucacuauugaaacagcauaguacuaacugcugcaguaagaccuacugaugaaugcaaaaugaaaguuggaggagaaauauauuuccauugucccaaaagugucuuccgccaagaaauuuaucaauuagaaagacaaaaauagcagcuuuacagcggauagacccugcagcuaccaucuuaaucagaugaucaacguuaccaaccaccuggaauaaggcagguugaaaucacguacuuccugaggugagacgcugagaaggguacauugcuucugugacauucuugccaaaacugcaucgccucaaacaaauuauaagaagacaccagacaaaaguugcuggacauucauacaaaauaacugacuaguauucuuccaaaguguccugagggaggaaugaggaaaccauacagauuguaggagacuaaggcagcacaaugacuaaagguucugugggaucccggauuggaugugggaacaggaaaaggagacugguggaaaacccagugaaauaugaauaagaucuguaguuuuaguauugcaccgauauuaauuucuuaguuuugauacuuguacugugguugugcgagauguuaacacuguggagucuaggugguugggguaugugagaacauuguacuauuacuguaccuuuuuuguaagcuuaagcuuccaacauaaaacaauuuaaaagguauuggugggggaaaaacuuuauuuuuuuguguauuuuuccccccaacaaacaggagaaaaacuaaaggcagagagugccauaaagauuuugucucaggccagguaaaacuuauuaccaaaagcuucauuuucuaauaaaacaaacuaaauuuuuaagugaaaacucagacucaaaagaaauccaggaaauaaguaucacaaaaugcuuucucuugacuagaguggugguuccucaagucaagagggcugguucauuugcuguagaguuauucacuaaacuguuucuaucuuuuacguucuuuucugaaugugcauuauaucucauauauauacaguguacccaggacuacaguauguaauauagcugcaaauauuuuggcacucaggaaaggugauaaaggguugcaguuauagaagcauucauagaaaaggugaauuuugaacuugcgcccgaauaacaaauacccauuauauagaauaaaacaacagaagccauuuucuucuaggugcagaaaagggaaagagagaccuuucaugguauaguauuaagacuuaaaugggguuuucauuuugcuuuauuuuuugagacagggucucauugucuugcccaggcuggaguacaguggcaugaucguggcucacugcagccuuaaccuccugggcucaugugaucuuacccucucagccuccugaauagcugggaguacaggguaugccaccaugccuggcuaauuucuuucauuuuuuauaguaacagggucccgcuauguugcccaggcuggucuugaacuccuggucaagcaauccucccaccucagccucccaaagugcuggggauuacaugccugaggcacugcgcccggcgacuugauucuuuucuuuucuuuuuccuuuucucugaacuuuauucuguaaaauuuuacuuuaaguuccaggauacaagugcaggacguguagguuuguuacauagguauacgugugccauggugguuugcuguacucgucaaccugucaucuagguuuuaagucccacaugcauuccccauccgccaacuagccaugguguguguuguugcccucccuguguccucauuguucaacucccacuuaugagugagaacauaugguauuugguuuuccauuccuguguuaguuugcuggcugaggaugauggcuuccagcuucauccaugucccugcaaaggacauuacuucauucauuuuuguggcugcauaguauuccaugguguauauguaccacauuuucuuuaucuagucuaucacugaugggcauuuggguugguuccaugucuuugcuguuguacauggugcugcaguaaacuuacaugugcgugggucuuuauaguagaaugauuuauauuccuuuggguacauacccaguaaugggauugcugggucaaaugguauugcugguucuagauccuugaggaaccaccauacugucuuccacaaugguugaacuaauuuucauucccaccgacaguguaaaaguguuccuauuucuccacagccucgccagcaucuauuguuuccugacuuuuuaauaugcuuuauucuuaauagggaggaaagucauuacuaagugaagucauuacugacucuucccaaugccucacuugauacauucacuuaaucaccaaggacagcccauuuuaccucugcuuacucuucaaccuuugcaaacagcuggaauaaucaucuucugucccccuucuccaaagucacaguuccagcuguuacccuggggacuguuuuguuaggucauuaaaggaggaaaaaaccuugcagaguauggucugaguccguguuuuucuaaaaguaaaugacaaaggaucuuguuugugcaccucaacagauguuuuuguagcacaggagucuuucacuugaacuccaucgggaaaggccaauugacuugacccuccugcaaagccaagcuucacagaguagucagggauccucugaaacagaugaggcaaaacauccucauccucccccugcauugaaacccaaacucccuacccugaguggcuuuugucuuuuuuucuccccuagcguaauggacuauuuugguuccugcaacugaaaaguuuagggguaggucuuguuucagucauggcugaaucucugugcucacucaguggcuguuuuccucuuuuucuggcacauuccaaacuucuugacucaauagcaacguggccaugacaggaccacacuuacucuuucagcugaucccaagaaaagaaacucuaccaagagcaccaacgaaagucccacggaugcgucuaguuggccuugcuugggucaugugccuggagguuguacuggugggggaaguagaaaucauuacuggcuacaggugaggcacaugcccaucucugcaagauguaauuuaugauaccuuggcuuuuuuggguaacagcuuugagagauaauucauauaaccacauaucauauaaucacucauuuaaaguguacaauucaaugguuuauagccuauuacguguuguacagucauggccacaaucaauuuuagaacauuuccaacacccaaaaagaaaccucacgcucauuagcugcugccacucacuccaucccccagaccccggugaccuuuaaccuacuuugucucugugauuuugcuaguucuggacacuucauauaaauggcaucgugugauuugugaucuuuuagaguugggcucauucacuuagcauaauguuuucaagguucauccaccuugcagcuuguuaccuugccuuuuaaggcccuuaaaagauuuuaaauuaucugccuccugccugccuuuuaguucucaugucaugcuguuuuuuucuccucugcuggguuccacuuuaagcgugcagcugcuuagacacuuuugcagucagguaaaggccagaaggugacauguagaccaaaggaaaaccggguuagauuaagaaauaggaucuacaggaaaugcagucauuauuucaauguuuugcaauaaaucaacaguguaaagaccaagcacuuuuuaaacugcuugcuucccacacaauaaauaauuguguuuuaucuuucuuugguuaaaauaggcccuggcucuucugggcuaauccaaguugcaaaacuucugccccaugcucccuuugggcaugcuugugagaugccagguucacauuuugguuuggaagguguagucaccacaugguuguucucuccccugcauccuccaggagagcgaagaggaacuuuacuccuccugucgccagcugaggaggcggcaagaagaacugaacaaccagcucuuucuguaugacacacaccagaacuugcgcaaugccaaccgggaugcccugguuaaagaguucaguguuaaugagaaccagcuccagcuguaccaggagaaaugcaacaagagguaggucagccccuccaccugcaaaaacuuuuggggggucucuaggcacggugaugaugggcaccacgggccaggcuucuggaaagcccucugaguugcuuucuucagaaauccuuggccgggcaugguggcucacaggccaggcaugguggcucaugccuguaaucccagcacuuugggaggcugaggagguuggaucaccugaggucaggaguucaagaccagcgugcccaacauggagaaacccugucucuacuaaaaauacaaaaauuagcugggcauggucgugggcgccuguaaucccagcuacuugggaggcugaggcaggagaaucauuucaaccugggaggcagagguugcagugagccgagaucacaccauugcacuccagccugggcaccagagggagacucugucaaacaaacaaacaaacaaacaaacaaaaaauccuuuggcacccuugacucuaguucucuuuguucuagaaauuaaccuacaguaauaccuuaggcgcuugccacuuccccuaaguagaacuguuuccucuagaaggacacuucaauuuaauagcgaaaauaaaugaugaccacugacuuuuaaggaguacuuauuguguuuccaagaaugggcuaguccagcggcucuagacugggucaagaucccccaacagggaugcuugugguugugcuacaggcauguaauggggugcggggcggccgggguugccaaguguuucauaauaugucuaaaucuucuaagaaagaaucauccagacaaaaauccuaauaguagccaccaacgagaaacugugcugccucccuuacucacauuauucucauugaaucuucaugucagccugcagaguagcucuuacucuguuuuaccauugaggagauuuaaccucucugagucucaacgucuuaccaggaacuuggagucugccucucugacacucagcccuauaccauccagcuaugaaugacuggcaaauguacagaaagagaaauguuacagaguucagcacgcagcccauuucucauggcccacugcugauggugaaaucuguuuuauuucagguuaagagagaagagagucagcaacagcaaguuuuacucauagaagcugggguauguguguaaggguauugugugugugcgcauguguguuugcauguaggagaacgugcccuauucacacucugggaagacgcuaaucugugacaucuuuucuucaagccugccaucaaggacauuucuuaagacccaacuggcaugaguugggguaauuuccuauuauuuucaucuuggacaacuuucuuaacuuauauucuuuauagaggauuccccaaaaugugcuccucauuuuuggccucucauguuccaaaccucauugaauaaaagcaaugaaaaccuuga

SEQ ID NO: 191974 - RNA, 5002 nt, Homo sapiens
cgagaagcagcggcccggggcgacugagcggacaaacggaaguguagguuacggucugagacaucaccgccaagcugggcaucggggagauggccgagacugaccccaagaccgugcaggaccucaccucggugguaagggacggcugugagggccggaggccgcggccuucccgggcggcgccgggccaagcccugcuggacagaggcgcgcccaccgcggccgcgcguggcgucugccgaggccccguuucuggaagcgucucuggccgaggcucccggccaccuugacccccggggcgcucggugcgggccagucuccccgcgggcgcccccaagcccgaccccuuccaguagccccauucaucugucgcgaacgcccuccgggucccucccgccuaccucugacacccuccccgcccuucaacuccucacacacccccgggugccccagcccggcagaaacaaccuaaagacccugagcuuugagucgcagcggccuccccagcccagcagucuaauuggacagguuggaaaacggaagcccagagaaggaagaucuugcugaaggccgcacagcuguccagaggcagaaauggggcuggaaccccgggaccagggcuugcguccugaucccaggaaguugucucaggaucgauguggaccguguuuguuuguuucgguuuuucuuaggugcagacacuccugcagcagaugcaagauaaauuucagaccaugucugaccagaucauugggagaaauauccuuuuuaucugcagucggccuccugugggccuuuggagccuauuugccgggcagugguggggauaaaugaguaguuuucaggcuagcuucagccauucacuuguagaauuugagcuuggauuguacuguguuucugagaaggacugcgccgagagcuaggggcaaagcugaguuagacuccuggcucaaggagcauacgucuaccaauccuaauagcuggugugguggaccaugcacugugaacuaagcgcuuuugugugugucuuuugaugcucagcaugaccuuaugaguggguuguaguguuaucaucuuuagcaaaugaauaaauugagguuuagggguuccaucacuaguaagggucagggcuggaauccgaugcgggguagccaugccccacaguccuguacucuuacccaccagcguguaacagugucgaaagaaaauuggaagaccaguuucccuaaagucguuguguuuaaggcuguagucugcagggacgggaggaaaaaggcucaaugagauguuggcacgcguugucuuuaacuucagcacuugaugauaugaguagucgcauugaugaucuggaaaagaauaucgcggaccucaugacacaggcugggguggaagaacuggaaagugaaaacaagauaccugccacgcaaaagaguugaaggugaggaagggggcaauuuuuuuuuucuuuucuuuucuuuuuuuuuuuuuuuuuuuuuuugacacggaguuuugcucuuguugcccaggcuggagugcaauggcacgaucucggcucccugcaaccuuugcccuccuggguucaaacgauuguccugccucagccucccgaguagcugggauuacaggcuugugccaccacacccagccaauuuuguauuuuuaguagagacgggguuucuccauguuggucaugcuggucucgaauucugaccuugagugauuugcccgccucagccucucaaagugcugggauuacaggugugagccgccgugcccggucuuuuuuuuuauuuugucuuaaaagaauagagagaaccuguaaguauaauuuguauguagucagacauucuguagaucaguucccagccaugaucccagcaagcaucacuguauuguuuaccugcuguggacuugauguuuugaaauuuuucaugccaaacucauucuuuacaccgaauuuauuuucccaguuuuuauuaauuagacuucugucacuauuagugaagaccacuggcuaacauuagauaaccacugaguuuuuaucauuccagcuaauaauuaaggugucuuuuuguuggccuauaaagccugucacuggaagauuuuccauugcuuuuuuuuuuuuuuauggaaauaacugauaagucacccacauuaccaccuucuuaaauggcuuaaauucuggagacuuucuugguaacuugacauaggugaacuagauuguggccacauuaagcuuuuacccuggaguucauuuaaauuuccucugaauaguuucagaugucagaggaaagccuaguaauucaaaguaccuacacagcaagauagguaaauguacagaaucacucagcagagugcauggugauccuuuuccucuguaugugugaaaaauaaguuuuagacucacuuuucucuuguuucauuuauaacauuuuaauucucuauaaaaaugaauguugcugagggaggcggagguugcagucgaggucacgccacugcacuccagccugggcgacagagugagacucugucucaaaaaaaaaaaaaaaaaaaaaaagguacuggugcguggugacucaugccuguaaucccagcacuuugggaggcaaaggcaggcagagggcagaucaguugaugugaggagcucgagaccaaccuggccaacauggugaaacccugucuguacaaaaauuagcugggugugguggugcacgccuguaaucccagcuacuuggcagacugagacaggaggcagaguuugcagugagucgugaugaugccacugcacuccagccugggagacagagcaagacucugucucaaaaaaauaaaauaaaaugguuccugaguauuuuuagauucguagaguacuaagcagaauguacaguaaaacaugccuaauuuccuauuuucugggcuugcuguggaccacauuuuaagucacugugaaauacagauuugggauguugaagacagacucuaaaauuugcuuuuaucuucacaguaggugggguucauucacugugugaguaaaucacauaacugcuuucuauggguuaugucaucguuauucuuauccagagauaauuuggaaaaauguccuaccagucucagaugcuucugugggucucuuuuuauauuauguggcaaucaaaacugccaucaacugacugauuaucuuaccacaagaauuucaggaugguagacuggcuagugaugggggucauucaaagaaaagagugggaguaggaaacugacucugaaacuuuuaaagauauuuccaguuaaaucuauugcuaaaauauugccagaagaaaauaaguuuaacucaguaggagaguggaaagggauuuguaguugauaggucuauaugucauuuuuacuugugcucauauaaugaaaaacauguugaugauuuuuccuucuucaacagguugcuaauaauuuauacuggaaucuggcauuuuuccaagccaagagaagaucgaauggcuuuuugcagcuaacuacuauguguagacagguuuuauauuauaaaguaugcauucuuaucaccuaguauauaguuaguuuguagagugauuuccccccaguuucuugaacaugguaucuucacaucuuggaccuuggucaguugugcuauucauuauuaaacacuaaaacuuuggcgguucuugcauaacauugucagauuuuuuaguguauuucugugaagucauuuuuuuucuugucauuccuuuuguaguaguugcuguuuggauaaaaguugaugugugauuuuuuauuaaacaaauaguaaacccuucaauuauaguuagucuuggugaaguaagauguuuguagacuuuagaguucuuuaauucuuggcacaacgugacuguugagcuaacaccaaauaguguguuggcaauacuuuucaaauggcugaaaacaccuaaaaauuguucauucagaaauaucugucacugcucuguugccaaaacucagaauagaacuuagacguaugucugagucccugagaucacaugcuaaagucgaugaaaaguaaccacugccacugucuugugucagaacuuuuacaguacagaaaauaacagaauagccuucuguaaugaggcguuuguuagaguuuugcaugagauucuaauacuucaguaggacccuaccuacgugguucaucuacaaugguuaccauaaaaaaucuggcaggauuuuaaaacucaaucagucuuuccuuugagcuagugacuugaaaagaaagagagaaggaaaagagaccauauuaaguccaugccaguugcuuggcuagaauaugaucaacgacuuguaguagacucaaguuuuuaaaaaacacuauuuuacuuaaacuguuucuuaucuaaauucuugcagagugucaauguuaucauugauuauagaagacagggauaauaccuuuaucucuggccacucaaaaaugcagugccaggagugcuaaaccuagaggccaauacugaugaccuggaaggugauccauaugauugucaccacaaagugcuuuuacacaaaaacuugaaaauuugaaaaacaugauuuuuuuaaguuucucaucucaccagucuugguguuuauauugcaaaucuaucaaaguaagaaauaauuugugcuguauacaaauuacauggggaacauaaaggagugagauccuucugugauaaaaugaauucaccacucugguuacccaacuacagaaccuccuuugaucaggccaguagguugugaugcaggcuggagcccccgaaugccccacacacacugcagcauugaccagaccauccgaaaccugcgucccuggugauguucucaagccucggaaguggcaaauggaaaugauauggccgguugcgguuguaggagaguugugacuuaggcaggagucgaccuccucaaguaauggaacgauuucaaaggcaggcugcccugaccaaaaauaucugccaugaauaaaggugccugaaauccu

SEQ ID NO: 191975 - RNA, 5002 nt, Homo sapiens
aggauuucaggcaccuuuauucauggcagauauuuuuggucagggcagccugccuuugaaaucguuccauuacuugaggaggucgacuccugccuaagucacaacucuccuacaaccgcaaccggccauaucauuuccauuugccacuuccgaggcuugagaacaucaccagggacgcagguuucggauggucuggucaaugcugcaguguguguggggcauucgggggcuccagccugcaucacaaccuacuggccugaucaaaggagguucuguaguuggguaaccagaguggugaauucauuuuaucacagaaggaucucacuccuuuauguuccccauguaauuuguauacagcacaaauuauuucuuacuuugauagauuugcaauauaaacaccaagacuggugagaugagaaacuuaaaaaaaucauguuuuucaaauuuucaaguuuuuguguaaaagcacuuuguggugacaaucauauggaucaccuuccaggucaucaguauuggccucuagguuuagcacuccuggcacugcauuuuugaguggccagagauaaagguauuaucccugucuucuauaaucaaugauaacauugacacucugcaagaauuuagauaagaaacaguuuaaguaaaauaguguuuuuuaaaaacuugagucuacuacaagucguugaucauauucuagccaagcaacuggcauggacuuaauauggucucuuuuccuucucucuuucuuuucaagucacuagcucaaaggaaagacugauugaguuuuaaaauccugccagauuuuuuaugguaaccauuguagaugaaccacguagguaggguccuacugaaguauuagaaucucaugcaaaacucuaacaaacgccucauuacagaaggcuauucuguuauuuucuguacuguaaaaguucugacacaagacaguggcagugguuacuuuucaucgacuuuagcaugugaucucagggacucagacauacgucuaaguucuauucugaguuuuggcaacagagcagugacagauauuucugaaugaacaauuuuuagguguuuucagccauuugaaaaguauugccaacacacuauuugguguuagcucaacagucacguugugccaagaauuaaagaacucuaaagucuacaaacaucuuacuucaccaagacuaacuauaauugaaggguuuacuauuuguuuaauaaaaaaucacacaucaacuuuuauccaaacagcaacuacuacaaaaggaaugacaagaaaaaaaaugacuucacagaaauacacuaaaaaaucugacaauguuaugcaagaaccgccaaaguuuuaguguuuaauaaugaauagcacaacugaccaagguccaagaugugaagauaccauguucaagaaacuggggggaaaucacucuacaaacuaacuauauacuaggugauaagaaugcauacuuuauaauauaaaaccugucuacacauaguaguuagcugcaaaaagccauucgaucuucucuuggcuuggaaaaaugccagauuccaguauaaauuauuagcaaccuguugaagaaggaaaaaucaucaacauguuuuucauuauaugagcacaaguaaaaaugacauauagaccuaucaacuacaaaucccuuuccacucuccuacugaguuaaacuuauuuucuucuggcaauauuuuagcaauagauuuaacuggaaauaucuuuaaaaguuucagagucaguuuccuacucccacucuuuucuuugaaugacccccaucacuagccagucuaccauccugaaauucuugugguaagauaaucagucaguugauggcaguuuugauugccacauaauauaaaaagagacccacagaagcaucugagacugguaggacauuuuuccaaauuaucucuggauaagaauaacgaugacauaacccauagaaagcaguuaugugauuuacucacacagugaaugaaccccaccuacugugaagauaaaagcaaauuuuagagucugucuucaacaucccaaaucuguauuucacagugacuuaaaaugugguccacagcaagcccagaaaauaggaaauuaggcauguuuuacuguacauucugcuuaguacucuacgaaucuaaaaauacucaggaaccauuuuauuuuauuuuuuugagacagagucuugcucugucucccaggcuggagugcaguggcaucaucacgacucacugcaaacucugccuccugucucagucugccaaguagcugggauuacaggcgugcaccaccacacccagcuaauuuuuguacagacaggguuucaccauguuggccagguuggucucgagcuccucacaucaacugaucugcccucugccugccuuugccucccaaagugcugggauuacaggcaugagucaccacgcaccaguaccuuuuuuuuuuuuuuuuuuuuuuugagacagagucucacucugucgcccaggcuggagugcaguggcgugaccucgacugcaaccuccgccucccucagcaacauucauuuuuauagagaauuaaaauguuauaaaugaaacaagagaaaagugagucuaaaacuuauuuuucacacauacagaggaaaaggaucaccaugcacucugcugagugauucuguacauuuaccuaucuugcuguguagguacuuugaauuacuaggcuuuccucugacaucugaaacuauucagaggaaauuuaaaugaacuccaggguaaaagcuuaauguggccacaaucuaguucaccuaugucaaguuaccaagaaagucuccagaauuuaagccauuuaagaaggugguaaugugggugacuuaucaguuauuuccauaaaaaaaaaaaaaagcaauggaaaaucuuccagugacaggcuuuauaggccaacaaaaagacaccuuaauuauuagcuggaaugauaaaaacucagugguuaucuaauguuagccaguggucuucacuaauagugacagaagucuaauuaauaaaaacugggaaaauaaauucgguguaaagaaugaguuuggcaugaaaaauuucaaaacaucaaguccacagcagguaaacaauacagugaugcuugcugggaucauggcugggaacugaucuacagaaugucugacuacauacaaauuauacuuacagguucucucuauucuuuuaagacaaaauaaaaaaaaagaccgggcacggcggcucacaccuguaaucccagcacuuugagaggcugaggcgggcaaaucacucaaggucagaauucgagaccagcaugaccaacauggagaaaccccgucucuacuaaaaauacaaaauuggcugggugugguggcacaagccuguaaucccagcuacucgggaggcugaggcaggacaaucguuugaacccaggagggcaaagguugcagggagccgagaucgugccauugcacuccagccugggcaacaagagcaaaacuccgugucaaaaaaaaaaaaaaaaaaaaaaagaaaagaaaagaaaaaaaaaauugcccccuuccucaccuucaacucuuuugcguggcagguaucuuguuuucacuuuccaguucuuccaccccagccugugucaugagguccgcgauauucuuuuccagaucaucaaugcgacuacucauaucaucaagugcugaaguuaaagacaacgcgugccaacaucucauugagccuuuuuccucccgucccugcagacuacagccuuaaacacaacgacuuuagggaaacuggucuuccaauuuucuuucgacacuguuacacgcugguggguaagaguacaggacuguggggcauggcuaccccgcaucggauuccagcccugacccuuacuagugauggaaccccuaaaccucaauuuauucauuugcuaaagaugauaacacuacaacccacucauaaggucaugcugagcaucaaaagacacacacaaaagcgcuuaguucacagugcaugguccaccacaccagcuauuaggauugguagacguaugcuccuugagccaggagucuaacucagcuuugccccuagcucucggcgcaguccuucucagaaacacaguacaauccaagcucaaauucuacaagugaauggcugaagcuagccugaaaacuacucauuuauccccaccacugcccggcaaauaggcuccaaaggcccacaggaggccgacugcagauaaaaaggauauuucucccaaugaucuggucagacauggucugaaauuuaucuugcaucugcugcaggagugucugcaccuaagaaaaaccgaaacaaacaaacacgguccacaucgauccugagacaacuuccugggaucaggacgcaagcccuggucccgggguuccagccccauuucugccucuggacagcugugcggccuucagcaagaucuuccuucucugggcuuccguuuuccaaccuguccaauuagacugcugggcuggggaggccgcugcgacucaaagcucagggucuuuagguuguuucugccgggcuggggcacccgggggugugugaggaguugaagggcggggagggugucagagguaggcgggagggacccggagggcguucgcgacagaugaauggggcuacuggaaggggucgggcuugggggcgcccgcggggagacuggcccgcaccgagcgccccgggggucaagguggccgggagccucggccagagacgcuuccagaaacggggccucggcagacgccacgcgcggccgcggugggcgcgccucuguccagcagggcuuggcccggcgccgcccgggaaggccgcggccuccggcccucacagccgucccuuaccaccgaggugagguccugcacggucuuggggucagucucggccaucuccccgaugcccagcuuggcggugaugucucagaccguaaccuacacuuccguuuguccgcucagucgccccgggccgcugcuucucg

SEQ ID NO: 191976 - RNA, 52466 nt, Homo sapiens
cgcgcucgcagcuugcaggcgccgcguagccgucgccaccgccgccagcccgugcgcccucggcgcguacccgccgcgcucccauccccgccgccggccaggggcgcgcucggccgccccggacagugucccgcugcggcuccgcggcgauggccaccaagaucgacaaagaggcuugccgggcggcguacaaccuggugcgcgacgacggcucggccgucaucugguaggaacuuuucauucgucuccacgccccgcuccccgggcucgcgcggggccucgugcaccgagccggccuccaggcgggacggauucgggccucccgcgcugucuuccucgccuuauuccgggacggcgugccaggcccccgcgggcuucuccguggccagcgcgucuguuagauuguccucugcaagcgccgcgucgcgcggccaccagcgcugauguguguguguguuuuuuucuucucccaacccaaagggugacuuuuaaauaugacggcuccaccaucguccccggcgagcagggagcggaguaccagcacuucauccagcagugcacagguagggaggcgcgccugccgggcggaugcgcggucguugggagguugucugcacccggggagccccggccagagcgaacccgggaggaaccgguggccacauggggugccccuggcgcauggcgugggaggaacccggugugagcguuuuaaggccucauaaaaccuucuccccucuggacauccgaagcaacagaagugacccaccugccuccgccauccuacaaugccuucuccaggcggggcagcucuuuugcccccugcgguccacugguuuucuaaggucaacuccuguguuuccaaacuccaguguccauccagcucuucccacuguccccuuugaucagucacugagcccaaauacgaacaggcuagggggcugcuuggaagggaaagaaacucagccgcgcccuccuuucucccgcuaucauugucugcccgugugcugauuuuaugugauuuuuaauuugacgaguagaaucagaugcaaaagaguacacaccauaugauuccauuuagaaauccuagacaaggcgaaacuaaucuauggugugaaugucagaaucgagauuagcuuuuggggcuagauagccacugauggggaggggcacaccacccggacugcugggagcugaaaaugucucuguagacauuuguugaucugggaggggguuaugcagguguguacccgcgugaaaaaucaucagacuguauacuuaagauuugugugccuuaggcacuucccuguggcuugugaaccaugaaaagaaagaccacguggcaggcaucgccauaaacccuucgguaguggcagaggcucugugauguugguaaugggaccuuuuaaagagauuggagaaugcgacucccucccaucucuggucuuuaguuggaagcaagcuuucggacaacggcagcacagcccggagguuacggcguggacccugagccagacgguguggguuacuuauuuauuuauuuauuuauuuauuuauuuuugagacagaaucuuccucuuuugcccaggcuggagugcagugguacaaucucagcuaacugcaaccuccgucucccggguucaagagauucuccugccucagccuccugaguagcugggauuacaggcgcccacgaccacgccuggcuaauuuuuuguaauuuuaguagagaugggguuuucaccauuuuggccaggcuggucucuaacuucugaccuuaggugaucugcccaccuuggccucucaaagugcugggauuacaggcgugagccacugcgcccggccgacgguguggguucgaaucccugaacggcugcuuccuggcugugugguuuggaacgaguuccuuaaucucugggggucuugguuuccucaccugcacucucacagugcuguugcgaggauaagugagucaguauguauaaaaugcucagaacagugccuguacaagcuacaugauuguuugcgaaauaaauaaaaaguacaaaauugugccagggaucauguggguguuucuuuccuuaacugcuuccauaaucaaauuauauuuugcauuuaguucaauucaaaggguauuuguggugugacuacuagaggaugggugauacugagaacccgcgugcgcgcacacacacacacacacacacacaaaacuaaaauuacuccuugagcgcugccuguagacauucauucauugcuuuuguaaacaguuggccuaaaaucgcagcauaaagcacugcaacgauguggagaguuggcagggcaggauuugaacccaggccuccgucccuccgccucuguaguugaaugcuuuugcaaguggaguaagugcaaacucuuaacuuucuccccuccgguccgugaacagccaggagagucagcaguauuucugcuuugccggcucugaggcuaugcuuuacagaccagcuucccucccuaaauucagcuucuuuccucccgcuggucacccaucccucccuucccccaucaaaccauguucugccucugaagcuacuguucucuccagcaaguagaaggggaugaggaaaagagcauccaucccaucaggaggcuccuggcaggugcucccaggccucagcccacucugguguagugggagaacacuucccuccucccacaggcuugugguuuucugcucagacccaccuccugccccccagggaugggaguggggaguggcgcgugucuggcgaggaagcuaaaaaugcuucccugcuguguguggauccucaugaaugggccaugggagcuucagcugcagugcuuucuuuccccagccaucuguuggacaaaugcauaggagaauuaugguugccgugucugcucuuguuccucucggaaacgcuuguuccuuccugucgucguguccucauaacccagggacaauggacucaacacuggcacuggcuggauagcagucaccacgcucgacgugccuuaucuuggucauaccucagaacagccugguguggcagguacuaagguuacuccuauucuacagaugaggaaacggaggcccagagagguuaauaggcuuccugcauucacccagcuagaaaguggcagaguugggacuugaacccaggcaggcuggcucggggcaggugcucuuggcuucugaggagguuguuuagauucucaccucucgugggauugcuugcagguugcaaaugacaugguugcccacuugugacucagagagggcucuuuuguggccccaguucccugccagguauccugacaggccugagaagaaagguuccacucugguucgggcuuccugcuuccaaacaucucacaagguggccagcagacuuggaaggccagaaacagcacccaguuucuuccuuauaaccucagggugugggccuuccugggguccugcucuucucccaacccuccccacucuggcacucaggcauucucucugaaacacccccuucccuggcccucccaccucaggcuacugucccuucuccccuuccucccccacggcuuuccagaaugggaucucuccacccagccuccccuccucauuucuucccagccuccuggccuggccuuuccucccucagagcuguuuuccagagggccacggggugucugugcugccaggccaguucccucccacccccgcacucauccucccaaucuuucugccugcucugggucugcgcugcuucuucccgagcuugccuggcucccggccuuccucgcugccugccccuccgcuaccuccgcucuugcuucuugcuccauagcucaguucgccugggauggucagagaccuugcgagggcggugagaaaugcccagugcagauuaauguaagcagaaaauccacuguggccucuagccuggaaacuccaggggaaguccuagcagcagcaaagacugcccgaacuccaaacagccucuccuccuccuccuagcucugucuucauccuucaccuccauucuugcggggaggggggagguuuagccccugggcagagccaucuugguggaaagacggagcaagccucuuugccagugauuuugggggucccuggacugucuuuggcccugaggucaugugcccaucccuagaccaaucauggagacucugcguggccaggccuggaucacaugcccaccucuggaguggguggggggcggggcagccccacucaaaccaggagacugacuugaggagguggcuuccuagggaagaauggcaugccacuuucacaaaaguguccauuugccccuuaacaucucugcuuuccucuucauagcaacagucuauuugcccuuaaucuuccuugucugguauccacucuguccucccuugcugggguaauucuuucuacaguacauuucuaaucaagucacuccucugcucauuaaccuucuauggcucccuucugccccauuggauuacacucaugcugucugcuuggcuuucuagucgguuuguccccacccauaucuccucucuaguagcuccacacacccucccucacacaucugcagcccaacacuguaacauuucccgucuuggugcuuuugauuuuggagguuucuaccaugcgguauuccucuuccccaucucaacucauuuaggacucagccacccaccuagcuuagugugauuccuucuucauuucaacucugaguacacuuuggaaucagaaacacucuaguccgggcgccguggcucaugccuguaaucccggcacuuugggaggccaaggcagguggaucacuugaggucaggaguucgagaccagccuggccaacacagugaaacccugucucuacuaaaaauacaaaaauuagccaggcaugguggccggcgccuauaaucccagcuacucggagacugaggcgggagaaucacuugaacccaggaggcagagguugcagugagccgagaucgcgcuguuguacucuagccugggcagcagagugagacucuaucucaaaaaaaaaaaagaaagaaagaaagaaagaaagagucauucuagauugacaucuccgcucugcuucucacucauuguguguguggccuugggcaagugccucccucccucugugccucaguuuuuaggucuguaaaaugggaauccugacaugccuaccucugagggugacugggaggguucacugaaguaaugcaccuaaaaugagagcacaggccacgguguguguuggcuaccccuaccacugcuuuucuuuuuuuugagacaaaguuuuucucugucgcccaggcuggagugcagccucugccucccggggucaagagauucuccugccucagccucccaaguagcugggacuacaggcaugugccaccacacacggcaaguuuuuguauuuuuaguagagacgggguuucaccauguuggccaggcuggucucaaacuccugaccucaggugauccaccugccucagccucccaaaaugcugggauuacaggcgugagccaccgcgcccggccucaaauaauuauuuuuacucugauagcacucguagaggcauuaugcuuuccacucggaagcuuucaguacacguccccacucagcacaaaguaggcaccuggcccaggcugguaugcaauaggcauuuggccccauguggacacgcauuagacccuuggcccgggucugcaugaaggagcaugaugagaggugcuuagcucaguaguucaagguuuggguuuuguccgauugccuggguucaaauaccugccauucaugugcucuggagcaggugaguuacccaucugguaaccugcuacaguguggucauuaggaggauuaaggaagcaaguccuuaugcugcuugggacauagugagcacuccauaaaugucaauuacugcgauugccauuuuuguuuuuggaauucaagugauguggaaguagcguucaagagcaccaagaagauggaagggggagagaugaugggaaggaaaugggugcugagcugggcuggagggucacagguucaccugacagagccacugggagccuggagcaaucagggcucagcuggcagagguggagggaaaggggccauuugccagaccgguuguaugaucuaccuggccacagcagaaagggcuuacagaucacguauguguggcgaggcaguggcuggggcugucugugaaaucacauuuuguuucugcaccauucagauaauacauauucucuguggcauacucauaaagcaagacuaaaccaaaagaagagaauaccaaguagauauaguucagauauaguuuugcaaacacucaggaacuuguuccuuccuguguuuauuccuucauucuccuguuuauucauuuaauucauucgacauaugggacugcuacucuguggggcacgacuguaggcacugaggauaaauacagaagcagaaaaggcgccuguccucguggagcugacauuuuauugucaucucccaggacagaccgcuggucucauuuuuaucuauauucuugaaauaguuuucuguauguaauucuacuacaaaaggggaucauagauauuuuagagccaccucccacaacaacuguaaugccaaaguuucuucccuaucuuccccucuucuucugcaauaccaguuuaaaaauggcuacguaguuucucucauacaaaugugacauuguuaaagcaauccucuauccauggaccucaaauuauguguugcaagcaguuuuauuuuagaaggaauccaggcaucugggaaugaguccaguuuucuguuggugcagauuuuagagcugauugguuaagagcaucaguggugaggcuggggcgucuugcuuugaacgauagccuugcugugcugugugaccuugggcagaucucccagggucuguguuuucucgucuguaaagguggggauaaugauugcauguagguugcuguaaggauaaacuggcuuguuccauauaaugcuuguagaguacugccugacacagaguaaagcucaauaaaugugguuauuguuaaaguagcaccuucagaagguguuacauaucaauggauagguugaaauaaauuugagauguggggugguuaccagaaaaggcuucuucaugaagggcagcaucaugaagaugcuugguuggaggcaggugcccugugacauuuguuggaugauggucuggguggagaugauauucccaugaggcucuggucagccaguaguguuuaacccaaaacaccacagagagagauguagagauugauguuuuuuuuucuguccagcauucccuccuuugggggaaccucucccuuccauuucauaauaauccuggucaaccaauguaguuccugugagagugcacauaacccagaccuguccaaucagagcaagccacucuucugcuaaccgauugguucaagggcccuugugacucaaaucuagccaaucagauucaucccugagacuuuggacagaguuguugguaaagagucuuuuuaucuuucucugggauuaaaacaaauaagaauaaugagggcuuggagcucacagggcaugucuaccauuuauagagaguaccugucugagaacucaggaacagagccugguggugggaguggagacaggugacgugccagaaaacucugggauccagccaugccugaagcuuucucuuuagacgguucacuuucaugagccaaguaauauuuuuucucaggccagugugaguggguucuggauuuaguuuccaucuaaaagaguccuggccauagucuccagguuaggcagcuggacacagucucagaggagaggagaauccaggcuggacaaggaauuuaaagccucucaugugagaacugacugaggaaauugggcauauuuaaccuugugagaccaagaggagagauccuugggagacaccaguguugucuucagauguuugaggggcugucaugugguaaguguggacuucuuguguuccuacccccacaccaacccuaugugguaaaugggaccacgcaguaggaauucagggauaguguguuagucucuucucacgcugcuaugaagaaauacccgugacuggguaauuuauaaagaaaagagguuuaauuggcucacaguuuugcauggcuggggaggccucaggaaacuuacaaucauggcaaaaggggaagcaaacacauccuucuuuacguggcagcaggagacagacugagagccaagugaagggggaagccccuuauaaaaccaucaguuuugugagaacuaucaccaaaacaguaugggggaaacugccccccugagucaauuaucuccaccccguccugcccuugacacuuauuacaauucaaggugagauuugggugggaacccagagccaaaccauaucagauagauuuuggguugaccuggagaggaagaggcccuuaagguagaacgggcuaccagaggagaaagugaggcccccaucacaggagguaugucaggagaguccgacuaaccacuuggcauagauguugaagaaaggauugaaggaggccuuccuugccucugcacucuccugucucacagccccauuuucuggccugcuaugccuccaggaagacugacuggccuuagugcaggccuaggggaugccucuuggagguggcaucagcccuaccuggaugacagagacugagaguggcagagaggugguuccuacggaaaacuggaguauagcgaccaaaagaagggagcuggaaugcgaaggagucaaauucacuugcuguccaugaccucugcguauauggcaauacaacacacagagagccggcagucuauuuaucgugcuguuuugcaccugaauauuuuuucccuagcugaacauacacacccggguuucagaaauuugggcgagaagggaaggagagaaauugcuuucuuuccuaaggucuaagggaaugugacaucaaaaagaagcuccaaaucugugacagggcuuugggcaguuauaaagugcugaacagucuguccguuaaugcaugcgacaaacauuuuauuggguuccuacuuugcuccagaaacaauguuggguuuuuaauuuaauuuaauuuuugagacaaggucgugcccugucacccagucuggagugcaguggcacgaucuuggcucacugcaaccucugccucccagcucaggcgauucuccuaccucagcgucuccaguagcagggacuacaggcgccugcuaccacgccuggcucauuuuuguaucuuuuguagagacaggguuucacuauguuguccaggcaggucucgaacuccugggcucaagcgauccacuugccuuggccucucaaaguguuggaauuacaggcgugagccaccccgcccggcuggguuuuuguuuuuaagugguacccugaagggcugcgaaaacauuaccuuuguaauuuucugcacuauccagucucccauugccuucuuugcccacagaucuguugcugggaggcccugagccacgcugcauagcuuuuuuguguguccacaggggcgugggcuuugugguagcucuuucagucuacugcauggugauguuugugcuuucuuuucuguuuguggcugugucaccacaaacagaaaaugaugaaggaugauagauguguaucuuccugguaaguacagugucucaaguucaaaaaaagcauucccuaaacacuaggugaauuggguuuuugucccuugaaaauauucagaaguuaaugcaaacuuuuugaaagcaucccuuacagauuuuauagguguuauaaauaccuccuugucucccauccuuucuuuaccccauuucauucuggugcccacccacacccagagcauggagcucuaugucuaggucuuugguaaauauuccaguugccagauuuaguggucauuucuuugucucugauccacuuuaccucccuccagcauuugccaguggccagcaccuccugaaaagauagucccccucgcuugugcuucugcuucugcguggcuagacuugccuaguucuccuuuuaugucucucuccugucauucucacuuccuucugcugcugcuucugcuuccugcccgauaagucuaggcguuucuuagggcuccacccuugaucaugaccuugucuucuccgggacauuucucgagcaucuacuaugccccaagcccuuugccaaguacugaguugaguccuuucccugaccccagugagcuugcaguccaggcuagggguggcuuucuaaccuucaggucagauugcucccccgccucccacuuccaacaccuuuucuccauaagguccaaacgcucagacaugacauggggugcccuuuaugacaggugcuggccagccgaccccuccaguguguguccccaacacacacgaugcugaccuuagggaugcccaagucccaggcccuacguaggagcucugcguguguuaguuuaucuaauuuaucuucucucugagggaguaaugagcagagugacacccacaaguagaaauuauccccacuucacugaggaggaaccugacauuuuccuuggagagccagagucgcuugcuggagaugcugcaguugggaagaacugcacuuugaauccagaucuguguccgaggcucucagcucuuccccugugccgcgcuggccugccuucccgcuucccuaggccuguggacucucuucccucugccugcacugucuucaucuguuucgccuuccuggaggacuccuacacacccgucaaggcccggugugaauguucccucugcucggaugcccuccuugucuuugugguguuggugucccguaugguggucgugugcaugucuguuucuucaacuccuuggcgaaguccuccuggagagagggacuuugucccuuugguggugguauccuuggcggggaauccccauccuucaugguuagauggcugccaaucucuuucccccauggguguguugcucccuugagugggcccaagucaugggcugaauccugggucauaggcuuuucccagcacgugcuggcuguccacuccuuugucucuugcuuauagaagagaacccguaaugccuggguucaaauuucagcucuacuucuuaugggcuguaggcgccugggacagaauccuacaguuacugcugugggcaccugggacagaaucccucagggacccuaagaggaacauggagggugcagcccugggaggcgggggcacguagccaccgacucuuaucccccauugguugagggguccuuuaggggcuuuaggguuucugcacuccaggcugugccucugugagguugagcagcuagacguggcaggaugucaugguguacccaaguggcuacgcccacuaccacugaaaccagacauggccuuggagaaggugacaaggagucaaaaagcaucuccuugcagcauuuagcagugccuaagaucauagccacaugugcaguuaugcaccuguuuaucuugugacuuuccugggagcauccaagccccguggggcaaccaggucagcuuuguucucugcaguauuggcagcgcugggaacaguaccuggcagccugcacagauguuguugaguaggcaaaugagugacaguccauguagaugucugagagcuaagcucacacaggagggcccgccguccccuccuccaaaguaacagcccaguggcccacaaggcucccggccgcuaccacuggccaugugacugcucuggccccaggccucuuacuccagagcccaggcaucgccaccuuccucucccacuuaagcaagugccugugacuuuucugauucagcucaguggccucagcaguggcagguccccagaggcugguuuuugaaggcaggcauggcacgucagcauuuaauauuuuauuucaugagugcauuuugaaauuaaccugccauagaucuuguuuuuaguucuguacuuaguuuauggucaucacgcuuuucuucaugcacuuauucuuacuuugucuucuagguacuuagguaagcuuccuugcgagcaauaaauaaauaaguugauaacaacaaugguuaacaguggaccuuuauuaggccaggcauuagccagggucauuguguuacuuuccuauggccacuguaacaaaugaccacaaacuuggugaauuaaaacaacauaaaugcaucaucuuauaguucugcaagucaaaagucugacaugagccucacaggacuaaaauccagguguggacagggcugcuuucuccuggaggcuccaggggagaauccauuuucuugccuucuugugcuuccagagacugccugcauucuuuggcuuguggccacuuccucugucuucaaagccaguacuggcaggucgaguccucaugaugccagcucucugguucuggcccucuuccccacccuuccccauuuaaggacugcagugaucacgugggugucacccagauaacccaggagaaucucccaucucaggauccuuaccuuaaccacacccucaaagcccuuuugccaugugagggacauauucacaguuuugggguuuaggacauagaugucuuaggggccguuguuuugccugccgcagucacuugugauuucauuuaauaugcccagugacccagcaucgcgggcccuguuguuaucccauuucacagccgaggcaguacgcaggccaggcugcaauucuuaccuggcgugugugcuucucgcccccacuccugacacccccugcaccccagcuugcaauguaaaaucuuugugaaacaagaagggaagaccacgggaggcucuucuguggaacaccguggggcagaccuaaggcccaggcccaggccauggggggccgugggaaguguuuagaggccacuguuguuuagaggccauuucugccauuguuguugacacagaaagccugugcgugugucuggggagcaaugcuccuuaauuccugaacccgaguguucccuccugcccuggagagacuuucccaggaaaucccgauuucccuacuuuugccugcagggcucgccuuuggaggucugcucugacccggaagcacuuuucuccccguuucuggcuagaauucuacgcugcuuauaaaauggaguguauuguucauggcuugcaaauaaaagcugcugcugcuucaggcgggccaggggucagcuggagcugggggaggggugaaaagaaccuggcuugagaugcaaagagccaggcuccuggcggccccugugugaccccuacagccacagcccccucugggccccugccuaacagagggacagagagagggcuguguccacccugcagcucucuggauuuggccaaaccuggcugcuguguggcccauucuugggaacaccacacucucuuccugggugacuuuggucacucauccccccaacacauauaaacugagcacucacggucugcugggcacucgugcugggagagcucaguggggugcaucaccaugcacaaccuugugaauggaccgaaacccacugaaauguccacuuucacagggugcaguucaugcuguguaaauaauaucuuaggaugaaaaagcauaaagaaaaaaggaggaugaggcuccugggugggcaggaggacaggaaccuaguagggccauggggugggggccgugggaggggagcguggguggggagugaggguggagagcagggggugagggcuguggagggugagugugggguggggagcaggggguggggaccguggcaugagggcuauggccggugaguguggauggggagcgcagggguuggggaguaggggguaguguaggugggggccauggggugagggcuguggagcagggagcauggguggggagugggaggggagcaugggugagaaggcgguuggggaguaugggguugggccgugguggggcagcgggagggagaggggaguugcggggguaguagggaguggggagcauggggugggggccaucagggagggagguggguggggaguggcggguagaaaguggggggagguggguagcuggcagggcccagggugcaguggccccgggagccaugugaggccucuggguuuuccuggagcagugcgcauuuuauucugaucacuuuuguuucauguccuccuagaacuuugccuuggcccuuucuguggcucauucccagcugggcagggucuuauucugccacuucuucuggguccccaggcaugaugcgccaaccccacaggcccugagcagcccuuuucccugagcacagcccugccucuccccucugaacucccggcucccccacugccuccauucgcuucauagucuguugccauugucaccguuggucccaaggccgccuuguccuuaucauccucaccuagcgcuucccaacacuuccugugugccaggcccgauucccagggcaucacccccucagcuggcugaugaggaucaacgugcugugucaccgaugaggagaccuccagggggaggcuugcugguccccugggcucucagugggucccccuguguuuacggcagagcugugacgccguguuguacccacggccggguuuccaguguguucacucagagccuggcgcagagcccuggcugagucacacuucguugccucaguccuuugggaagaggggagguucugccucggauguugcaugggguaaugaauaagugaauccguagaagaguaaagugagucagcuguccccgugggggcuggugugcgcaggcuugcgggcuggaguguuguuaaaguccacggggaaggaaaacuggcugcgagucugcccccaccaaccaggggcucccaggcagagauggagaggccuccggggaacuggggggcagagaggggaagucgcugggccauuguuacaugggaggaaaggggcagagccaggaccugaacccuggucuccaggcucucaugccgcugagguuucaagccagcugcgucccucugggcuaccguucuuggugcaugugaaagguggagaagcagcuuccuuguuacgcaggcaucacugacucuggcaucgcugacuccagcaacacugccuuuuuggccuucccuuuccaugcacuuuuuuuuuuuuuugagaugaagucucugucgcccaggcuggagugcaguggcaugaucucagcuuacugcaaccucugccuccuggacucaagcaauucuccuacgucagccucccgaguagcugggauuacaggugugcaccaccaugaauggcuaauuuuuguauuuuuaguagagacaggguuuugccggguuggccaggcuggucucgaauuccugagcucaagugaucugcucgccuuggccucccaaagugcugggauuacaggcaugagccacugcgucuggccacaugugcuuuuauuaaaccacaaauuugucaaaacaaaucaguuguuaugucuguccauauccauucguuccugccugucuauucauuccugcucucuggggguggaagucacacuuuaaaaauccugacaaagaauugguuuuauucuuuuuuuuuuuuaauuaaaagaaaaaaaguuuuuugagacagagucucacuguggcccaggcuggagugcaguggugcgaucauaguucacugcagccucaaccuccugggcucaagcaauccuccugccucggccucccaaaguguugggauuacaggugugagcugcugugcccaucugcuugguuuuacucuuauaaaauggcaccccccccacccccauugaacugaaacgcagcugcaaauuuggaacugaaaagccucugagaagucaaagaugccauguagaugcccuucauuuauucgggaaguauguauugaguacauguggggcaucgucugggugcuuuggaugugcuagggaacgagauuccuucccuccuggaguagggcugagcaagcugaaggaggccuguagcucauucugagccuuuaagcucuuaguuugcacacaguuaucaucagcugcaucauaugcccuucuggcuuguggugagucggaaaaagagagaagggcugguggaggaaggcguuuugaacuugccagcagaggcuguugcuuugucuggaguucugucacaaucucccucucaaauugucaacaagaacccucuuuguccuuacccuguucucuggaggaacucugagucauccuucaagacccugaucaggaugggugcgguggcuuaugccuguagucccagcacuuugggaggccaggauggggggaucacgaggucaagaguucgagaccagccuggccaacauggugaaaccuggucuauauuaaaauacaaaaauuagcugggugugguggagcgugccaguaaucccagcuacucgggaggcugaggcaggagaacugcuugaacccgggaggcggagguugcaugagccgagauugugccccugcacuccagccugggugacagagcaagacuccgucucggggggauaaaagaaaaagacccuaaucaaacaucaccuccucugcaaagccaguccuggucacagcugcccaggcagagcggauuuccuucuuuccuugaugcuccuguaacugccagucacaacucuuugccauagcaguaauuucaugguauucacacacuacauuuuuguuugcuaugguagacuguauauuuuuugaagguagggauugcauuuucagcaaaaucccuguaucacagauugucaguaaguguuugucaaauaaccaacccacagcgauggaagaggcagcacaacagugaaaagcagacacaagaguauaaagcagugugugccagggcuguucagugauugggagccagacgcugaaccccucaguggcgcagcgucuccuuauagaugcuauagauacuguaauaagguccucagagccuccagggacugcuuuacagccacucuucucuaagucagaggguggagucaggucuaacacacuaacucccauuuaaggaaguagagaauuaucaugaaagaaagugcuagugcuuugucauagggggaaaaccuuuagcucucgguuuaauuuggguauccagaucagcuuauacccuggagguucugccgaaguaaucaucuuucuuuuccucuggccauccuguacuucauuuucuuauguucucugucaagcuaggaaagcugggucauucacaccuagugaaaaugcaaugaaucggggaucauuugaggagucuccugcgugggauaucaaaccgcauuuacagugugagcuccaaugcagaaacaaugugccuacacgcagauacccacacaaugcggaucacauaaagaaacagagccuuggccgggcgcaguggcucgcgccuguaauccuggcucuuugggagacugaggcgggcaguucaccugaggucagggguucgagaucagccuggccaacacggugaaagcccgucuguacuaaaacuacaaaaauuagccgagcaugguggcaggugccuguaaucccugcuauucaggaggcugaggcaggagaaucgcuugaacccaggaggcggagguugcaguaagcugagaucgugccacggcacugcaggcuggacaacagagcgagauuucgucucaaaaaaaaaaaaaaaaaagagccuuuauucaugcccuauaaggaauaaaccaaaaggaguuuagaaauaaacagaguaauggguuucaguuuuuacacuuuuuaauacuuuugcaaaguuuuuugagcaggacaggaggguguuuuugguuugguuuuguuuuugucaacugcagggaguuacgaaagucacucugaaaaaagacagcaagugguauagugauaucaggccucuuaguaaugagagcucucccuucaacuucagcaacgaaccuggccccuuccagccccagccucaggcccccucccucuuacagacgugggcggccacugagcccuccuuccucuuugguggcaagaagacauuucuccuuccccagccuugcccucucuccccuuagcagccugcuagaagccagccgcugccauggcgacugcccagcuguccccuugcucugggcagcaggauguaagaauucuuucccauuuccuuucauccucgcuccagggagcucccucgguggaagcugacagcucagcuuuuugguguguggguuguuuuuucccuuccugagccguguuugcauaaccucuccggagucucuguaaaguuagggcagcuuuagagugagcugcaaucuugccgcucucuggggcaacuuccuccuguccuccccuucccccuuucuuuggccuugcucuaaaguucaguguuggguggaaauucugaaaugauucuuuuuucuuuccauuggcccacagauaacguauaaggugccuaugacaugccuggcauggugaucagugcuggggccauaacaagacccagacagaugugaaaguagcugaaaagauccaaaggacuuacgcuaaaaaguuucuaggguggugggggauccuuaauuucuucauuuugcuuuuuuguguuucucauuauucuacaccuaguauguguuuuuguaaugaaaaaagguuguucaaaacauuugcaaaaguguuaagaaaguuacacagugcucgacccauagcagauccuccuuccucggggguuugguccuccagccaggacuggcuuuggcgauacgcagaggagacuagaaucucuuuggggaaaaggcagaggcccccagucaauguggauccugggugggggccgcccuggugagaacacugggugccuggucagaaucucuuccucagugcugaccugagccugagauuucaaguuugggugggagggggaagggggggaggggcaagccuucagagcuuaguggggaccauaugccguuuguaacuuuuggggaguuauuagagcggcucauccugguggcuuuggugauuacagguaauucuugccuuuaccccccucccuagccccuuuguggucauccucuguuucuguugucacuggguuuucucccacauccccaucccuuugacugcccagcagcuccagccugaucacccccgaccccgcuuggacccccccugcuugcucccccccaccccugccgcuugguccccgccgcccccacuugguucucccgcuuggucuccugcuuggucuccuugugugguccuucccacccccacugucucuccuuuacccccucuggccuuucccugccccaucccucucucuuccagagaggucgggguuggugggggggguugggggggagaaggggaggaggaggcacagauggggaggaggugggagaggcguaaaggcaccuccaggacccaggggaaaggucagaggagagccaggagagggaaaggccagagaaaagagcauguaacagccaccagggccggcugcugaguucacagcucugcgccaggcgguauccugagaacguuaggaugcugauuuguugacacagaugaacuuacuuaguaaaugaaggcagagaaccuugaagagaugaccugggcauuggacugaggcucccuuuaccuaccuucagggcccugccuggggcuucuagguccccacggguccuuugcaggagccaaagcuccaucauuggcuucugaugaggcuucauagaccaguggaaggaaggguccggcucuuuugagagugaaguuuuauuaacguuaaacauaacagcugugucuuuucaugaacaagacucucucugggugggaaggggagggcauccauagucuucaaaucagggacauccagcgugcaauuggccugggcucugagugcaugacaccgaccagaaggaaaccaccguccucaggauggggcuccugaccuugcuguauccucagugacggcagcccugagauggggcucagugugaugcuaugauaugcaucugaauccucguggcuuaugggcaagcagaggagcuagaggcagcacaggcagaaaggccuccugguacccagggcugauagucaguagcucucuugcuaaugauggcuguucccucucuuggggugugggauuuuggggagggagcacuggagggacuguccugguggucuuugaugggcgugcucaggaaccacggacucugcaggaagcugcuucaugcagucauuugcuuaaaauaaaaggcagacaggcagcaaggagggcgugggggcugaacucugagcacuucagcuuuucuguccuugagaccuuugucucguccccucucccaacagugaguucucaccauuuccucuucuccaccucuuccucuaagucagugggucucaagguuuggcagccucagaaucacccuggggcucauucgagcacaguuucagagcuccacucccagcgucuggaucaguagggcugaguggagccugaguacccacauuucuaauaaguucccgggugcuguggugcugcugguccgaggaccacacuuugagaacugcugcuguggacuucagcagcucugcagcgggcagggagaauuguguggcucauucucacuucaccucuccaagccucaguuucuucaucugugaaaugggacugcgaucugugcugcccucacagaggagaagaaucugcagugugcagauucuuagaguggggacuggccccucauaagugcuuaguagacuuggggcucaguuaccucucagaccuucacugucuuccaucucuccucaagaaagacucacagaaggagugacuccgugacugugugccucggagugccucacucugaaacccagagcuggaugcagaaagugguccccauucuacagcuggaacagcugaggcucagagcaugaagcacccucaucugauguuccauagcuagaaggaagccggcugggaugcggccccugcuaggaugcggcccuggcugggaugcggcccuggcuggcugaucucuggaguuugugcucuucuaagugcuccagauugccuuagcgaacaguuguguguaaggggugcgaggugccaggaaauggcgagaaacagagggcagacucuguccaccuuguuaaggacagagcaguggagaguugugagggcaggggcuggugcgucaguguucuguggugguagcugagaucucccagggagagagugucaggggaaaggagaggaugagguggaacccuggggaguguguguguggagacagaggggguggaagagccggggagaaaguagaaggcgggaucagugcucugagaaccaagauggcaccaugcccugggugccgugggaagggagagguucaaggagggcagaauugauaauggcgugaaacgccaccagugggcauggagaagaugcuguuggcuuuggcaauuaggaggccccuguggaccccugagggcaguuucacuggagagguguugggggucaaaaaucagcaaugauucccaucagccaacccuucagaucucauuucuuuuucauguaauccucccaaccacuuuaugagguaaguauuugacccauuuuguggaugaggaaacugaggcuuagagacauucaggacucugggcugggucacaaggcuaguacauguggggguaaguuucuaaaggauucuggaauuugaacuugcacccuggacauugcagagaagguuaaggguauagaccacuccccugugcugagggcuccagcagaaggagcucauggcaucugucucugguaccuguguuugggugaaguccugggucccccgucccccacugggguugcccagucucccugucuccucugcguagaccuggacucucagcuucaguuugaagagauggaccauuggcccuguuggggaccaaguggcacagugagggugauggaaagcccagguaccaaccuucuucugggcaguuuugccgucuuagugcauacacacacacauauacacauacauguauauauaacacacauacacauacacauacauguauauauauaacacacacauacacauacauguauauauaacacacauacacaaauacaugaauauauauacacacauauauacaccuguacucacaaauguauguauauacacacauauacaaacacaccuguacacauauagacacauauuauacacacaaauauauguauauauacacauacacaaauauauacgcacacacauaucacacuaauauauacaggacagcguuucucugugcccuuuaguagauaugccaguguucccgcguacaggagugacaauagcccgacauagacgagggagccuagggcuccccacugcugauguggggcugugacugccacugggguuuguggacccaauuuguucagaagagggaaaguaacuaaaccagggaugaagaacuagcgauuccccuuccacugcccagugugaggucaaaagggaccgagaaccuccuucagggugagcaggguuggggagaggccuccagucugccgggcagcugcaaaaacggugcgcagaccaacagguuuuccgucuccgacucagcugacccgucacugucgugccagaucucuagcagcaaacauuuguaagcauaacgugacucggauuuucaaaaacaggccugucagcaaucuuguugaccaaaccauugucggauaagcacgcagcagucaccuagcaaaccacgucccucuuuaccccgcucccccacgaucauuuaaaugacaucaggcugugguucuggaagguucccaguguccuugggguuguggguguaacuuacuuauuguacaucuaucuugugccaggcccugggcugguacuugggacacagggacaaugccugugguucuucaacaagaaucugugacccuccgggggcaaaggguguugcccaagguagaccuggggaggucugaaagaggggaaggguggauguggaggguuggaggugcgcagagcauggccggcauguggaggcacuuggcagccagcagagagggcagacgcuggaaaagccauggagcuccgcagaggagccagccagagccgugggagggggcgacacugagaagagagagaggcugggagagcuggcucagcccgaagccuuggccaugggcugaacacaugguugagguccccaaaaacugcguuggcccaaagcagggcugguaacuuaccuccauggaggcuugggccagggauggguaguuuggauccaaguccgggcugaccaauguggaaaugggaacccgagagcgguuaccauggaaacacacucaccguguucuuuugcuugugaaaugcagucggaggcggauguucagccccuccucccccucaggucaaggcugccauuuaauuaagcacuuugguguugaugcucugacgacacuccucaaaacagagcccuggcuucccagacaccacggggacugcugagaaaugcucucgagcuaaagcgcugcucccccacacuccaagucugcaccagccgccuguggcugcgcacuuugcaccuuacaagugaggaacugccaucucuugcaccagucucguuuccugugcgcuguggccaccuggcagccccgcccugugucaggagcuuuagguuggagguuccacccugaugggcuagguggguuuuguagcuuucacuuucagucaucauggucaacugauaagggaggcgugaaaucaccccauuuuggaaggaucccaaaugucuaucaacugaugcacugauaagcaaaaugugcucucuccaugcaauggagugcuguucagccauaaaaggaaugaaguggugacccgcacaugcggcagcagggaugauccuuggagaugugacgcugagugaaagccagaccgcagaggccacauagcauaugaguccauuucaaugaaauguccagcacaggccaauccauagagacagaaaguggaagaguggcugccagggccugggggaaugggguggagaauggggagugacuguucuugaggacgggaguucucguuggaguggugaaauuagauaguagcgaugauggcacaacauugugaguguccuuaaagccacugaauuggaugcuuuaaagugguuaaaauggccgggcgcgguggcucacgcuuguaaucccagcacuuugggaggccgaggugggcggaucacgaggucaggagaucaagaccacggugaaaccccgucucuacuaaaaauacaaaaaauuagccgggcgugguggcgggcgccuguagucccagcuacucggggggcugaggcaggagaauggugugaacccgggaggcggagcuugcagugagccgagaucgcgccacugcacuccagccugggcgacggagcgagacucccuucucaaaaaaaaaaaaagugguuaaaauggugaauuuuguuaugugacuuuuaucucaauaaagaaaagaacguguuuuacaggugaggcagcccaggcugauguuugggaauucaggcacaguccccggggcaugggagguggggcccucaccccucggggucuccugugcccuggacuccucuguccucaccuucucacauccaguuggucaccaggcccuguggauucaccugcgcagugucccugagaccauccuuccuucuaucccugcugcguuguuaccuacugacccccagauagccauggccugguggggcauuucccuggagaaagggggcugagcacacacacccaagguguccaggcccuuggcucuggccucguguugagagucuggccacaucacguggccucugagccuccagcccuuaucaaugaaggugauuuggauguugaugaugaaaguggccaugacgucucuaccucaucugccucccagcguuguuacaaagaccaaaugagaugaaauagaagcauguuuuguaaacugaaaaguggugugccaaugugaguggugaugacgaucaguuuccuuuaagaaguaaguguuguggagucccugacccuggacugcagcuaggaucacgcauucauggucugcugagagcugcguguuccuuagcucccggggacaaauggaugacccguuagaccacccggcuucuuguugaaggcgaacgugcugguuacccccuccgguuuugagauaaucaccaggaagugagcuugucagcugcaggccaguaucuccuguagacaggugguuuguguccuugggucuuggugcuaaccuacaugcuucgugcgggacucugcagggacguacuuagauucuaggaagaaacgcagauugauuuuuuuuuuuuuuuuuaacucagugugauccuuugaccaguagcaucagcaucacugggaagcuucuuagaagcguagaccccagagcuguuuaaucagaagcugcguuuaagauuuccccagugauucaaauccacacaauguuugagaagcaaacauaucgcucuacgauaucauuaggugccugagaaacccucacaccagcaacuaaacgcccugagagagcaucaguuuaugcaaguggcuaauacaaggugaaugacuccaaaccaguggcaucccuaugugccagcaaccaccacuuaggaauuguaaugagaucuuggugauaauggcaguuaaaauaugaacuguuugugaaguaagcugaauaaggauaugugauccccucaagaggcacagaacuuuguuggaaaacacaaaaggggucccaauuaaauggggacaccaacgguuuacagcagagguucucaacuggggguguucugcccccuuuggaggacaucugcaauguauggaggcauuuuuguuugucauaacugguggggccaggugaggggugcugcucagcacccugcaauuuacgggaugguuccuaccagagagaaugaucuggccccagaugccaguugagcugauguugaacaauuuugguuuauccuagugggguacacaugcacccgcaugcacacgcacacacaugcaaugcacacauacacaugcacgcacauauuuuuauuuuauuuuauuuuauuuuauuuuauuuuauuuuauuuuauuuuauuuuauuugagacagggucucaguuggccacccaggcuggaguacaguggcguaaucucuacucaacugcagucucaaccuccugggcucaagugauccucccaccuuagccucccugguagcugggacuacaggugccugccaccgugcccagcuaauuuuuugguuuuuuuuuuuuuuuuuuuuuuuuuuuuuuuagagaggugauuucuccauguugcccagguuggucucaagcucuugggcugaagugauccucccaccuuugccucccaaagugcugggauuacaggggugagccaccauaccuggccaauacacacaucacuuuaaaaauucaaaaaaucaggcugggcgcgguggcucacgccuguaaucccagcacuuugggaggcugaggcggguggaauacaaggucaggagaucaagauucauccuggcuaacacagugaaaccccaucucuacuaaaaauacaaaaaauuagccaggugugguggugggcgccuguagucccagcuacucgggaggcugaggcaggagaauggugugaacccuagaggccaagcuugcagugagucgagaucgcgccacugcacuucagccugggcgacagagcgagacucugucucaaaaaaaaaaaaaaaaauuccagaauaucaaaugauauuuugauaauacagagcaguggagggugggggaacuuagcauaguggauugugaaacaaauuuuaaagucaugauaauaaaaacaguguggcauugaaauaaaacuuaauguggaucaauggaacaaaauagcccucaaagccauuuuaauaaaaaugacuauauaagauagaacaagcauaacacagccaauggaaauguguucagaauucauuguugaccuaauugcccuagucauaagugaaauauccucggagccauaucccgggccaaauuaagagccauuuucuuuguuuccucuucauacccagcaccccccuugccccuccugucucucuacaguguagagucucauuccaaacugcaaagauugaggcaaaaagaguugaugaauuucuggucuacaaagaggaugaauuucuggucccuaaauaagauccauaauuugagccuuuuuaaauuuuuauuuuuaaauuuuuuuuggcugggcccuggcacugcuggcggcacccacaucugugcaaugggcccacccagacuuugagccuugauuguaggaaggcuguaggcguugcagccagaaaggccuggguuuaaaucccagcaugaccuugaauucccucacaaccuugaaagugccaugugacuucucugaaucuccauuucccaucugugaaaugggcaugaagccugcagcacuguugccaggauucaggggagugugacaagggcagcggaugagugcuucccuccuguccucugcacauggugcucccagggaacugcaccggucuccugcugugcugcuccaggcgcacucguggcucacagccucuccccagggacaugacauggggguguuuuaacgcagcaccauguucucuuuucgcuuuuggccacagaugacguccgguuguuugccuucgugcgcuucaccaccggggaugccaugagcaagagguccaaguuugcccucaucacguggaucggugagaacgucagcgggcugcagcgcgccaaaaccgggacggacaagacccuggugaaggaggucguacagguacugaguuccuccagagucuggaggucaaagcucgccaagggucaccauccugcaaggagggagagggcuggguucgacuccugggucuguagcuuagcugugacuugggacaagccaugcuaugucucugcaccaguaaagccauuggugaaaugucaccagaauuguuucaggaugcuggcuaggaggaguuaacuguguuuacgaucccaccuaucccauaacagaagcuuggcagcugggugccugccuccguggguggggcagguugcuugcuucuagagacgggaacugguggggggaccagaauagcggccacuacccugugguguccuggcugacugucggcgguggucgcaaggaucccgugggagaauucauuuguacccucucugaacagugccuacuuuaagucuuuuccauucuggccauuaaagaaaauggacauuugcaaugucagaaacuuccaagguuguucacuugggguacggguaacacggucauguugagaaaagaaaaucugaacuccaaaagguaaccccgggguaggguagaugagggagagaggucuuucccuacuaaagggaucuccauuucgcaaaaggauuucucacaacccaugaaguagggaaucucucccucuuacugcgccuuuaaacuguuguucaggugaccagaaacaguguguuacacgucccuucagcagcuugucuguuacagagggcgggggguaccacugcccauccuccaccaugcacauuauuuuaaagauucaaagcaauguaauugguccaugauaaaacaaacguuuaaaaacaauagacucagcugggugcgguggcucacgccuguaaaucacagcacuuuggaaggcugaggugggaggauugcuuggcuaaggagucugagaccaaccugggcaacauagugagaccccaucucuacaaaacauaacaaaauaaaaugagccaggcaugguggcacauggcuguagucccagcuacuugggaggcugaggcgggagguucgcuggaaaccaggaggucaagggugcagugagccaugaucgcaccacugcacuccagccugggcaacagagcgaauuccugucucaaaauaaauaaaaaacaaauaaaaaauaauagucuaaugauggaagugggugauagcuaaagacacaggguuucuuuuugaggucaugaaaaugcuuuaaaauugacuaucauggugguugcacauaucugugaauauaccagaaaucaccaaauugucaaaaacaaaaacgggcugagcacagugacucacaccugucaucucagcacuuugggaggcuaaggugggaggauugcuuguguccaagaguucaagaccagccugggcaacauaguauuaauaauacuccaucuguacaaaagaauaaaaaauuagcccugugugguggugcauaccgguagucccagcuacuugggaggcugaggugggaggauggcuugagccuaggagggcgaggcugcagugagccaagaucucgccacugcacucagacugagugaguguagucagacugagugagacccuguugcaaaaagaaaaacaaacaaaaaaauaggcuaucugcaaugugcuaucuugaauuggaccuuagaacagaaaagcuguugaaauauaaauaaagucgggaguuuaauuaauuguaauguaccaauguugacguuuucacugugacaaauguaccacaguaauguaagauguuaacaguagugaaauauguauguguguguuaagaggaagguaauauggaaacucggugcuaccucuugcaacuuuucuguaacuccaaagcucuucuaaaauaaauuauuauuauuauuauuauuauuuuuaagagagacaggaucucacuauauugcccaggcuggccucgaauuccuggacucaagcauuccuacaccucagccuccgaaagugcuuggauuauaggccaccacgcccagccccuaauaaaacuuuuauuuaaaaaauaacaauauggccaggugucauggcucccuccuguaauccuagcacuuugggaggccaaggcaggcggaucacguaaggucaggaguuugagaccagccuggccaacauggcaaaacucugucucugcuaaaaauacagaaauuagccgggugugguggugggcaccuguaaucccaccuacucaggaggcugagacaggagaaucucuugaaaccaggaggcggaaguugcagugagccaagaucuagccuuuuuuggagcgagucuccaaaaaaauaaauaaaauaaauaaauaaauaaauaaauaaugauaggacauaauagaguccuguggucccccugucaguucccgcuuuuggacgucccuccuggccacucucuggacgggcucgccuccugccuuucggcuuugcuguggucccagccuauaggucacacucucaucugcagcugcuuuuuuuaagguuaauguaauuucauaaaugauauggaugcaccaccuuuguaauucaugguuuucugguagcagaguguccugguucacaaguguaccgucauguacuaaauguuccccuguucuuggccucuuaaguugcuuccaauuuuuauuuuuauaaagaauguuccaaccaacauuuuaauacaugcagcuccuuucugucuucuguugaguuauucuuuuagaaaacaaucucgggaggugggguuccggaguuaagaggcgagauaaucauuuuuaaaagguaugggcaucagauuggcuuugagcagugcuagcacugugccugggaccgaggaaaugcugacaaaggccauuuguuucacauguagucagcguuccugguugacacugcugucugcacccugucuggccugggagcccuuguuuuggaaaaccacuuauucaacccuacaggcuguuuuucuccaggccaguuggguuuuaaugguuaaccagcuuccaggggucuuccgaguggcagcaggauggaaaaugaaaaagaaguccuguucuguggccaaaggucuccugcugaauuccgcccgccgugcuuggcccacuccuggacgucgccgggaggaaagggagcagagggagggggcucgccaggauguguacacggggcaccacauugcagaucuugcaauucucuuuugucuuccuauuuaaaaaacugugguaaaauacaggccaggcgugguggcucaugccuguaauccuagcaccuugggagaccaaggcagccggucaccugaggucaggaguucgagaccagccuggcgaacaugccaacacaaaccccgucucuacuaaaaauaccaaaaaaguagccaggcaugguggcacguggccuguagucccagcuacucgggaggcugaggcaggagaauugcuugaacccaggagaucaacucaggagacugagccgagauugcagcaagacucugucuaaaauaaauuaaauaaauaauaaaaaauuguaaaauacaauaacauaaaguuuaccauuguagccauuuuaaaguacaauucagcuacauuaaacagaguuccaauguuguguagccaucacugcugucuaguuccagaacuuucucaucacccccaaaggaaaccucauacccacuaaggcagucugcagaguuucuuuccucucuagaacucuuuucaguuuggguaggugcgccggugacugagggggauuggaggaaauuaauucccugcugggaaccuuuaggugggaguaguggugauaauucuuacguuugcaagcucaaguaaguugaagcacaaagaggaauugcuuggcucuugguagugggaagugcagggguuucggcuuuagguguggcuagaucgagggcucaugcaguauuuucaucucaucucucaguucuguuuuucucugggguuggcgucaggcagccucugcacagccaaagaaacgguccaugcuaugguggucccucugggucaggaucccagaagagagaggccucuuuccucaguguccgucaaucucuuaagaggacccugauuggcccagcuugggucacgugcacacgccuuugggcagggaggcgggguuucaugauuggcagcuccagcgugaucccaguuguuagagaaagggaugcuggugaaugaagaagcgcagaugugcauugcagugggggagcuggaauacuggccugaacuacaggugcaggcucauauuuugaccauuaucauuugcauuuuccaccucuccacuuacgaauguuaauuaucugaagcugcuacaagaccuuacauuuauacugcaguugcaaauauagccauuuaggugacaaaggguccauucugcugguauaaugcugucuuuccacggccgcuaaaaccaugcagagacuggcaugccuaucaacuuccccucugcuucacggggauucagagcggauguucucuaagggaccuuccagaugggcccauuccgggugccaugucuuggggaccaggucacuuccccagcugcacuuuuugccaucauuuccauaugaagaagaaguagauuggcuuuuaguuuaagauuacuguauuaauaaacccuugacuuuuugacaguaauaaaguaaugcacaugcauucuugugcuuugugugaaacguggaggguguaaauuaauugcacggucauugauguggaggaacuugaauccaggggggcgauuuuuuuuuuuuuuuuuggagacaaucucacucugucacccagucuggaguacaguggcacaaucucagcucacugcagccucugccucccaugcuuaagcaauucuggugcuucagccucucgagaagcuggggauuacaggugugugucaccacacccagcuaauuuuaguggagggaucuguaugucacuaaccaccugccugaccaugggcaagucucucccucccugggccucaguguccucauuuguaaaaugaagaaugggaugaguugacuugcugugucauauucuauuuuggcguauucuggaaauuuuucuuuucuuuuguuuuaauggaguaauuuguuuaugaaggcauuuuaccuuuaaaugaaccuuauuuuacuuugccaagggggaagguguaguacgguggacuuuggagccagauggcguggguucaaauuucagcuccaucacuuacuguguggccuugggcacauggcuuacccucucugggcucagucaccugauguauaaaguaagggcaauauagugccugccuuguaggguugugguggggauuaaaugagcaaauauagggaaagugcuuagaacaaugucuuaauuucugggacccggaaguaguagcuguuauuuccaguuuucuguuuagacaacaccgugaugcacaguucacgcaagaaauguuucuacacuguagauuauuuccuuaggagaugcuagauacagaugcucagcuccaggacacagggcgugaaucuuguuguucacggauauugccagccgucagccacacaggaagggucuggccucacccacacuugccagcgcugaccucaaaaagcucauacuucaccuguggccggcacacaggugcaucagcauauggggaaacugaggcccacagcagugcuaggaccugcccuaaacucacaguuaaugagugauagagcuggggcuagagccuggaagaauuaggagugaaguucaacucugauccucuuuaaucuguauucagagccugagaaacugagaggcgucuguggcugggggaaaacaagacaaaacaagacaaaugccagcaaggccacggggcagcaggggcugccaggcaagcugggcagggcgauugcgaugcccagacuccaguccggggaaugcgcugaacgcacagcacgcacggcuggcuggccacagcuguugucugccacacagaaguacccggcuggugcccaggacagaaccucgcuccuaucguucucgugucucugcaggauuguggggacaaugcagugaccgcugguagugaccugcgaugugccagggccaggcucucuugauuuagagccaugcuuggucagugcugcaucaugcuugucuugcaggauggguucauucaccugauccuuuuauugauucuuuaacauaauaugaacguucacggagccaggaauccagaaggcaugcagcucagcuuucaggaacagaggacaacagaggcugcugccuccaaggagaaguggaggugggaaggauggacgugccagggauggugugaacuagccaauuggagucuauucugauagcuucugagccccaggacuaaccaggcuuaguggcgcacaccuguaaucccaacauuuugggagaccaaggcaggaggauugcuugagcccaggaguuggagaccagccuggucaacauagugggaccucgucucuacuaaaaacaaaaaaaaauuagcuggggcauggugucgcaugccuguugucccagcuacucaggagucugaggugggaggaucgcuugagcccaggaguuggaggcugcaugagcugugcucgugucauugcauuccagccugggugacagaggaaaacccugucucaaaaauaaguaaauaaauaaauaaaaauaaaccccaggggcaggaucggcuucauuucugggaccagauuuagccaccccuccccucugagggccucuuuuggguaccaauguggcaauaauaugaauaacaauaguuuuauuguggcccuacuaugugccugacacucugugaaggacuuuccguguauuaaaucauuuguccuucacgaggccaggucugccacuugcccuguuuuauagaugaggagcuugggauccgaagaagcugaguaacuugcucaagguccgggugcuuggacauggcaaagcuaugccuggaauccaggcugugggcucagagccccgacacggccacuucaccacacugcacauuucccaaggcuucuggcaccagggaagagguucgaaggccgcaagcagggcuggaugcuccuuuuguagacucguguugcacaugaaauuaguuuuuaaauuuccugauucucgaucuuccuugaugguggaagcuuuaaacuggaacgugaacuuuuuugcucugugcuuacuuuaaaaaagugcugcugugugaaauggagaaaguuacggcguguaggggagugagacucaaguugauauucuggcgccaucagcucacagguguaggacuuugggcagguauuuaucacuagaauuucuguguuuucacuuaggaaaaagagaauguaaaauuucacagagugguuggaaugauuaaagaaaagcaguaggugugaaaagggcuucuccauuuugaugccuggugaacuauucauccuucaaaacccggauuucuuaccccauucuccuaccagccucaaucagaauuaauugugccuauaucuguaucuacuauggucuagauaguauuauaauuaaggaauuauaauuaaguaacuaacaaggaaauaaucuccuaaaaggcagaagccauggcugcuuugugauuguacuccuagugcuggaagauuacugugugcuagcacauaacaagggcuaagaaaugaagaaaugaggccgggcgccauggcuuaugccuguaauccuaguacuuuuugaggcuggagcagguggauugcuugagcucaggagccugaaaccagccugggcaacauugugagacugcaucucuguuuuaacauaauuuuuaaaaauuaagaaaugggcugggcgcaguggcucaugccuguaaucccagcacuuugggaggccgagguggguggaucacuugaggucaggaguucgcgaccaaccuggccaacauaguaaaaccccgucucuacuaaaaauacaaaaauuagcuggauaugguggcaugugccuguaaucccagcuaccagcuacucaggaggcugaggcacgagaauugcuugaacccaggaggcagagguugcagugagccgagagauugcaccacugcacuccagccugggcaacagagcaagacuccaucucaaaaaaaaaaaaaaaaaaaaaaaaagaagaaauguaucugcucauguaggcucuuuguguauuaccaggacagaagcuuauaaaugcucaguaacuguucucugcauuaaauuaaauuguggaagcuaauuacacucaggggacuuggggcuagguugaaauuuccaaaucucugcuucuguuucaauagaaagcaggaggcugagcgcaguggcucaugccuguaauccuagcacuuugggaggccaaggcggguagaucaccugaggucaggaguucgagaccagccaggccaacauggggaacucucaucucuacuaaaaauacaaaaauuaggcugggcauaguggcacacgccuguaaucccagcuacuccggaggcugcggcaggagaaucgcuugaacccaggaggaagagguuggagugagccgagauugugccaccugcacugcagccucggugacagagugauacuccaucucaacaacaacaacaaaaaauuagagaaagcaggagugagagcugacuggggcagccgggagaaccuacaacccuccaugggaugagauuuacgaggcugcugcucccccuugcaaagcaugaguuaccacuuagcacucugcggaccauccacagacuguucgcugccuucaaaggguuucagcuguuuauuucuauguggcguguuuacacuuccuuaagccagugguucauggaaggacgguauuugcauaaccagaagggccuuuuuggccugaugcauuucaccugggccugggcucaggccgggggcacuucuuguugcucaugucauacauacauacauacauacauauauuuauuuguuuguuuguuuguuuuuagauggaaucucacucuguugccuaggcuggagugcaguggcgacaucuuggcucacugcagccuccgucuccuggguucaggcgauucuccugccucagccucucaaguagcugggaccacaggcaccugccaccaugcccagccuaauuuuuguauuuuuaguagagaugggguuucaccauguuggccaggcuggucucagacugaccucaggugaucugcccgccucagccucccaaagugcuggcauuacaggcgugagccaccaugccuggccucaugucauauauuuuuaaaacacaaauugcacaauugaaaaauaaaaagcucccaugcagccugugaauggugggaucagguaucguauauggagggccaggcuuauucauccaugagccgggggcuguacugaccccaauauacagaugaggaaacugaggcuuagggaggacuaguucuugagccaaggugaguguucagguggaagccagauggugggggacuggaggccacuuuaaauguggggcuuuuauaaugggagggcagugaggagcccugggaagaucugaaacucaaaagcgaugcaucugcuuuguugaucuuuuacuaaagagguuaagagcccuuaggggagcugaagugggaggauugcuugagcccaggaguuccagaccagccugggcaauauagugagacccugcugcuacaaaaaauauaugaaaaaauuagccgagcaugguguuauguaccuguaguccaagcuacucgggaggcugagcccaggaggucaaggaugcagugagcuaugaucacaccacugugaggaugcaguggcacuccagugugggcgacagagcaagaccuugucucaaaaacaagucuuagagggaaaaacagucuccuaggagaaagaaggagaucccugcacccuagguuugggccuggcauguaaauaaagccaccugaauaagcaaagaauucugcccagcgggcugugaccuggcugcccuccaccaaacuccagaccagugccagcccuuggccagccugcccuagccugguaccugccccaggcaccugccagcagcuggccuccggacgcuguggugcagugauucccgacacagucgcuagcacgguauacagucgcugugccgugaggaugcagcauucgaacguguacaggucuuaaccugaagaaaugaaucuggagagcucuuugugugugaagugcauguuucccagccuucaugaaaggccgaaggcucacugcacucuacaucuugccccuguguaugagugucuuuccucccccucuucucuuccucuucccuggaccacugcauacuuuuguccaccucuugucauucuuuauucucggacaucuugccucgugagauucccuuaugaaacaagcacacacgcuuagucuucgccccguggugguuuuauucuaagucgcugugguuugccgaaaggguuccgacaaaaugcaggagcuaagugaucagccacuaccccccaccucacacagaggggucugccccuucccguggagcccuugccacagccuuuagcagagcagagauauagccuguguccuuucucuugacauuuccuaaaugcuuuuuguuuuuauaauuuguuuuugagauggcauuuugaucuugucaccgaggcuuggagugcaguggcacgaucucggcucacagcaaccucugccucgugguucaagugauucuccugccucagccucccaagaagcugggacuacagguguaugccaacacacccagcuaauuugguauuuuuaauagagaugccauguuggccagacuggucgcgaacuccugaccucaggugauccaccugccugggccucccaaagugcugggauuacaggcaugagccaccaugcccggccuguuucuauuauuguaauggccaaauauuauuuuguaaguggauguaguacaacauauguaagucugugauacccauuuugugugugugcacaccucuguaugguggugugugugcaugccugugugugggaguggaugugugugugccuguguguauauauguguaugugugugcacuacuguguaugaggguggaugugugugcaugcauguguauauguguguacgcaugcuuggaugugcaugugugugcauaccugugugcaccugugugugcaugcauguaucuguguguaugcaugcaugugucugugugugcaugcgucuguguguaugcaugccugcauguguaugugugugugcauaccuguguuucuaugcaccuguguguguauacguuuguguggacauaucccugugugucuguguguguaugucugcacaugccuguaugugcaugugcauguaugugugugagagggugugugcaugccugugugugugcaccuguguggguacauuccugugugugugugugcacacuugugugggugcaugccuguguguguguguaugccugcguguguguguguuggugugugcauaucuguguuugugugcgugcaugccugugugugucuguuccuccaccuggugaguucccuggcguggagugaauccugugaucugcuggcuacuucacuuccuuuguccucaguuuucucaucugaaaaauguguaugauaauaucucauggaauugugaaaauucaauaagauaccauguauaauaauugccuggcguauaugaaguguuacguagauaguauuuacuuauuuauccaacuuuugcugaaaaauggaaacagccugguauuuacuggcaaugaacaucuuugaguauguauguuguuauuuuuuaaaaauucuguuauuucuuugggaaaaauccccaaacauggauguggcugaggaauaagaaaugcugggcacaguuuugauggggcagaaguugaagaucugaaccuggauuuaaucucuagcuugucaacugaucaauaagcuugggcuauuuggagcuccggguuaagggagauucugagguuaagccuggacucgguggggaaagugccaugauuaauuugugaugucuccuguggacaccggagagaggagaguauguuucccacuugcuuuccaugccuggucuagaugaagccguaguuagaaauuaggcaaggugcguuuggggcuucuguaaaucucuguggucaggaaagccgagccugagacuccaggcaguugcccaaaugcugaagaggucaggggcccugucggggucacagauccaggcauaggaacagccgccucuauuugguuuuggccaaaacacucacagcgugcuucuaggacaucacagugugcuucuaggacaccaugccuuccaucuucauuagaugguuacccuguguccacccgaaauacagccgugugccucugucuuggcuuuuguuccucaaguacagcagggucgcgucacuccugagcuacgaggguuugacacaggugccuuuguuccugaaucugucaaacccgagcccgugccauuuugaucuguuaguuuuucccuuuaucuauaaugacucaugccuauuauaagaaccuguuccggccaggcaugguggcucgugccuguaaucccagcacuuugggagaccgaggcagguggaucaccugaggucaggaguucaagaccagccuggccaacauggugaaacccugucucuacuaaaaauacaaaaaauagcugggugugauggcgcaugccuguagucccagcuacuugggagacuguggcaggacaaucgcuugaacuuaggagauggagguugcagugagccgagaugguaccacuguacuccagacugggcaguggagcaagacucugucucaaaaaaccaaaaccaaaaccaaaaccaacaaacaaaaaagaacccauuccuuuugaguaaauuauaccuugcugguagaguuuuuaaaaccucggucuuucaagcacuuugaauaguugugggagggagguguaggggccucggugggguuggcagcaggugcccaguggguuucauagcuguguguuuucauuuggcuccucuuccuuggggauugccuugucuccuagcaagauucagggugcuggggacuguggcuguauuucuucagcaguucagagucuuugguuuauuggucaucaucacccacuuguggaaaagacacauucauguguccagcacaugucuugucuauccccggcuccaucuuaugccugcgggaggggagauucuaguccccacaccguguugugaggguuugggaaggaccugaagccagcaggcagccuucauugugagagcuaugcucugaucccaaagcugacuuuuccaugccagguuuccccauugcccuaggaucuggugucccugguggaacuucgucccgugucuaugugcucuggaggcuuagguguaggaucccuggaugacugguggggaaaggcugggggacccuguuguccagccuucuucuuucacagagguggaaaccagggcccagagccauuaaauacugccuuccgggcauuucagagcccgcugcuucuauuuuucuauucucagucugucagagagaccaguaaguaccagaauuuugacuucccagagccuaggagaguguauggcauaugacagguguuuauuaauguguguucgugggaagaacaaauugugucgcuuucauugucuuucaauacaaugaagaucaguuccucuccugggccccacuucauagaaauaugcauuccugacuucacaaauggaacugcccaagaauccccacucauguuuucuccccggagcuuccccugcacccacauucucugcauugguuaggaauauccucauaggcgcaacacuccugaauagcagaccuuacacuuguaccccgacaggccuccuuguucccugaagcuaacccugggccuggcuuugggguuugcagccggauuugucaucuucugucugccaguuucacugacuugguuauuccaaggaauuccugggacuucccuuuguuaaaaaauaaacguuaggaaugagaagaggaacuagcuacugccugugucuucacucugagugacugagggaacuucauuaaaucucagauuccccuaacgauccugagaaugaaggugaacccacaguccuguagaacauucucucugacuguugagcacuccgcuuuguaccagguguucucaucaagugugcaagccccuuuuaugcucauacgacccucccaacagcccuaggaugugaagcugcuauuguccgcauuugcagaugaggagacucaggcucagggagguugaguccccagggaggcucaggccacuggagaugccuguggacaagggugccuguuuguauuuggccuggaccugcucccagcaugcugggguuuaaaccugggcaguugggagccauuaaaaaaugaaaaggggucaggugugguggcucaugccugugaucccagcacuuugggaggccaagggggggagaucacuugaggccaggaguucgagaccagucuggccaacaugaugaaacccugucucuaauaaaaauacaaaaaugagccggccguggugguacgugccuguaaucccagcuacuucagaggcugaggcaggagaauugcuugaaccuggaaguggagguugugcugagcugagauugcaccacugcacuccagucugggcgacagagugagacuccgucucaaaaaaugaaaauaaauaaaaauaaaaaugaaaaggaugggcugggcguggugacucaccccuguaaucccagcacuuugggaggcugaggcgaguggaucaccugagguccggaguucaagaccagccuggccaacauggugaaaccccgucucuacuaaaaauacaaaaguuagccaggugugauggugggcgccuguaauuccagcuacucgagaggcugaggcaggagaaucgcuugaacccgggagguggagguuacagugaacugagauugcaccacugcacuccagccuaggugacaagaacaaaaacuucaucucaaaagauaaauaaauaaaugagaaaagaaugauuuaaaaccaagacaggagaacaugcacuuuaaaauccagcguggcaaauagauggcuagacucuguacagagccccuguaccuaacccguacccucugcuauauuacccuccucagaaagguggagacagguuucaauggauguuuauuuugcaucuuugaggcaugaaucuauaagcacuugagaaaggucacagggacaaaacuugucuucauucaugaccagccuggccaacauggugaaaccccgucucuacuaaaaauacaaaaauuagccaggcgugguggugguugucuguaaucccagcuacucaggagguagaggcaggagaaucacuugaacccgggaggcagagguugcagugagccgaucgcacuauugcacuccagccugggcaacagagugagaguccgucucagaaaaaacaaaaacaaaaaaacuggucuuccacuugcugguugcauaauuccaaaccauucaagcagcuucagccgcuuggagugagacuucgucggaugaggcccuuggaagaaaauccugcuuuggcaagaaaagagaagucccccgucuggcagcuaugagagagcgacaccgaguucccagacaaaacaaagagcuuucuucagccacaggugacggugcccccagacugacacauguugcugugcagucucuggcagguuguggcagcugccucgagggcuuggcagucuagagcagccccuggaggcgggauguggggagaaaguggggcuggcaccaggaacgcauccccagggcccugccgggaaguugcuguguccccugggaugaacugcguccccucucuggguuguugcugguccucuacauaaugaagaggugaauggcaggucucaaggguggagugcaguggugcgaucauggcucacggcagccucgaccucccaggcucaagugaucuuccugccucagccucccaaguagcugggacaacaggcgcacaccaccacuguuggcuauuuauuacuauuauuauuauuauuauuuguagagaaagggucccacuguuccccaggcuagucuuggaacuccgggguucaagcgauucucccuucucgaccucccaaagugcuugggauuaccggcgugagccacagcgccccaccucccuucacuauuuuguucagcugaaacacaauuuacauagaguaaaacgcagagaucuucggaauacuacucguugaguguguguguguguguguguguguguauguauauauauauauuuuuuuuuuuuugagacagaguuucgcucuugucacccaggcuggagugcaauggugcgaucuaagcucacugcaacuuccgccuccccgguucaagcgauucucccgccucucacacccagcuaauucuuuguauuuuuaguagagaugggguuucaccauguuggccaggcuggccuugaacugcugaccucaggugauccacucaccucggccucccaaagugcugggcaugagccacugcaucuggcccaaguuuuguguauuuugaauguucaugaugcauaccuuugaagccaccacccagaucuggacauggcgcagauguccaccccugucggaugggcucuaaugcucugcgauucaugauucuguuugccugaucacauuauucuuucagacgcuuucguguucugucuagaccugcgcuguugcuggccacguguggccacugagcgccugaaagcgcacccagccauaucagugugugccguauacccggagggcacacagcguuucuaaggcuggguucaaaagaaaugaauguaaaggaccucgucaguaccuuuuagcauugauuacauuguggaaaugacaauauuuugcauauauuggauuagauaaaauacuauuaaaauaaauggcacugguuucuuucuuacauuuuucaauguggcuaguagcaaauugaaaauucccggccaggcaaaguggcucacgccuguaauucuagcacuuugggaggccgaggucaguggaucacuucaucucaggaguuugagaccagccugggcaacaugguaaaaccccauuaucuaccaaaaaaaaaaaaauuagucgggcauggugguguguaccuguagucccggcuacuucgguggcugaggugguaggauugcuugagcacaggcgguggagguugcagugagcugagauugcaccagugcccuccagccuggcagcgugggugacagagugagaccugucuaagaaaaaaaaggaaagaaagaaaauucaaaauucuggccuuugggaggccaagauggguggaucgcuugagcccaggaguuggagaccagccugggcaacaugacgaaaccacgucucuacagaaaaauacaaaaaucagcuggacgugguggcuugugccuguauuucuagcuauuaggaaggcggaggugggaggaucgcuugaaccuaggagguugagccugcagugagccgagaucgcaccacugcacgccagcuugggugacagagugagacuguguuucaaaaaaagagaaauuaacauucuguguguguccgcauugcucuaggcccuggaagucuccuucugaugaaggacuugccuccugagucuugccaccugccccugcccccguggguguugguggcaugugggugcuggcaagugcugugucuugaggugugugugguguagggguggccacgcuuugcaugcauauguucccucugguuuccagccucaggugcaaggcagacuucagcugcuccacgcaggcucccuccaguuucaggcauugcucccaagucagagucugucugcccagagcuguuuugcucagcuucugccucguuuugaaaacaugcaaugaagcccacuccccaguggugcuugcaacucccuuaucucaugggagccgcuggaaggcguggagguggagagguguggagguuguugucaguugguuuuuaggcugaggcucagguuagacauuuuggggacauucuguggaguccacgcccugaauggaaggugcuggcucaccuuuguaagccucugggggcuugggagcaccccguguaggauggaggccugcuaguacccccuccaugcggccugaccaccugggccccugcagaguugcugcuggcccuauagaaggugggagcggcucgguguccacucaggagcaggcugggguccagcucuggcugcaagggaacugaccacuguuggucacaggcccgucucaccgucucacccauguguccacgugacguccaggcaaugggcccgugcaugaccagucugccggugaggugacagcggggagccgaucccagggggaugauuggauggagauguagacacuuuauuuggaaggugcuaggagucacugccaggcucaaagaacggggaagggguggacaagacacaggagcagcacgaggaggagacacaaagaggggagggaagcugaugggcaggggggagagaugagcggacccaggugcaaggguggagagcagugggcuggggcaugacugccgcuuaaccagccucauggugucacucgccgagccucaguuuccccuucugaauugaggggcaagagaugaccucuaaggaccaccaacccugcugucuaugaggccauggugauacuaaggcccagagggagcccggaccuccaguguccuccguccaucccuucucucugcucggcuuugcacuggcgugggcugcaucgagucccaggcuguacaccuuggcagucacgcggcgggggcucucgugugaggacgggagcagagccaaaugcaccagcugucagccagacugaaggugaagggagccaacaggcucaugucugaauacaaggucuucagcccaccccuggaggcaguaugucaggauucuuccgaacagagaaucuggggucuguucuaaaggggccuagagcauggccauggucacuguaucuucagaaauguuuaaaguuuugucuuucuuggucauuggaagaggcaaaaaaggaaaaaaaaaaaaagcaggaaugagggaagacucaauuuugcacauucucucuguguuccccugaggauaaauuggaaacgaaauaggaauacaggacuuuuagguaugagccaguucaguguguuaagacacuugcuuucuaacccuuugcuuuuuggcaguaaucggauugcuggacgacuugucuuuuaagaccucucuaaguacugaugauaaaaacagcccuucaacagggaaaauaaccuuccauucuauuuucuaccgagcagagaggaaagaacaucagcugagccaggaggguuaucaaguugcaggaugacccuguuuaucuugugagacucaguuugcuuuaaauguuuucagagaucauaugguugcuuuuguauauacuuuuguuuguauaacuuggaaucauuuuucugcuaaucuuuugauuuuaaauaugucucugguauguaguacaagguuugaggguuuuuuuuuuguaguuugaaacauagcauuuuuaaagauaauuuuguucauuuacauuuauuguuauguuuuacuagaucugcugucuguuuugcuuguuuuuguuucauuauaauuugauuuccuaaguacuugugguuuuagguugaccugugccuagcuccauguaucuuucauuugagauuucuuagaccuuaucaaacuuauuuuucuuuuuuugagauggaaucucgcucuguugccaggcuggagugcaguggcgccaucuuggcucacugccauuucugccucccagguucaagccauucuccugccuuagccuccugaguagcugggauuacaggcucgcgccacuacacccagcugauuuuuauauuuuuaguagauuaggguuuucaccguguuggccaggcuggucucgaucuccugaccucaugaucugcucuccucagccucccaaagugcugggauuacaggcaugagccaccauccauggcucucaaacuuauuuuucuuaaucuaaaucuucuaauagcuaaccgacuggaacuucaaguguucuuauuucuguagauugccauauauagcuaucacaaagcagaggaacuuuggacuuuucuucuauaagcaucuuaagcuguuggcuuccuccuucugaaagcucucugccccucccucaugccguggggcucaggguugagaaauacauuaauucucaauucuccuuucuggcucuuacauccaacuuguguucuuucauugcacggaucacauacacuuaguaacacacuguaguggggugggaacagaaaggaucucaaggguguucugucauucugggcaaaucucuccaagcccagcccaugagucuuaucuucaaaaaguaaaauaaaauaaaguuaauauacugagggcugaacgagaacaugagugaggcuguuccuggcacacaucagcugcuugauaaaaauuaaccucccguucuccacuuuguuaguguucucaguggcuuugcgcgccaaaugcauugucuuuuuauuguaaagcuugacuucgggaugcuccugggcucaucauucuuggcaauauggcgacuuuuuuguuuuuuauuuuuuaauugugguggaauucauuuaacauaaaaugaaccuuuuuauguuuauuuauuuauuuugagacagaucucacccugucgcccaggcuggagugcaguggcgcgaucuuggcucacugcaacguccgccucccggguucaagcgauucuccugccucagccuccccaguagcugggauugcaggcgcccgccaccacgcccggcugauuuuuguaguuuuaguagagaugggguuccgccauguuggccaggcuggucucgaacuccugaccucaggugaucugccugccucggccuccaaagugcugggaugacgggcgugagccaccgcaccuggccugaaccauuuuaaaguguacaauucaguggcuuucagaacauucacaguguugugcaagcccuaccucugucugguuccaaaacuuuuucaucaccccaaaaggagaugguggcucuuucaagacgccagcuuuggcaucaacuggaccuucugguugucugacuucggacaagcauuguaauuuccagccuuuguuuccucaccuuuaaaauggaaauaauguugaucaccuuacgggccuuuuuaaaaagaacuugauugagguaugauguauguaccucaaaaucaagucauccuaaguguacuuuuucaguacuuuuucgugaauuuguggaguugugcacccauuaccacaaucccaauuuuagaacgucucuaucauuuccuguucccaucuccagcucuguguaaccacgagucugcuuucugucuguauggguuugccuuuuuuagacauuuauaccaauggcagcugacaguacauggucuucaugccuggcuucuuucacucagcauccuguuuccgagguucauccauguaguugcguguggcagcgcuucauuccucucuguggcugaggaauauuccauuguguggacggaccguguuuugauaauccacuccucuguugauggacauagggguugcuuccaccuuccaugauucauauuuacuacugugugucauucucaguacuguggcacugugcugguacacauaagugcuuaauaauugugguuagccgggcgugguggcucacgccuguagugccaacaccuugggaggccaagcugggcggaucacuuaaggccaggaguuugagaccagccuggccaauguggcgaaacccugcuucuacuaaaaauacaaaaaauagcugggugugguggcagacgccuguaguucgagcuacuugggaggcugagacaugagaauggcuugaacccugggggcagagguugcugugagccaagauugcgccacugcacuccagccugggcaacaggcuuuucucucaagaaaaagaaaaaugguggucauuguuuauguuauuuccuuaugggcuuuuuuuuuuaauguggaugauuuucuuaccuuuagacguguuauuugugguuuugauagcuuuuuuuugucaagcuguccgucaucguucugaaauuuuguuuguuaaagucuuaugauccacauauggcaguaacuguguaucaucauggcuuaagggugucugauaagccaggucaccugguucccucauucaugccacaagcguuuacugagugcaucaugggugccugcggguucuaugggugaaaccuguguacugcaagaggaaagacugacugcauccauuuugcugagcccuguagccccacagccuggcgugguauuuguugaaagaaggcagagccucuacccucguguaacucagugcggguggagagcccauggcagacccaggacuggaggcuccugcgucauuaggaacauugguggcugaagcuugcuugucccagcuggcgagagccaauuacgccugucuccuuccaccuccacguauggugacaucacuuugauagcuugacgucagccacugggggacuauuuacaucauggauaugggcaaaagacaccaaucugagcuuuuguccuuuucuuuuuuuuggagugccugcacacccgugagccuuuccaaccucguaaccuauuauuuuccugacgagauaguuuuuuacagaugagaaaguugaggcacagagaauugaagggacuuggccaagguaacagcccaaauucaagccccagcuuccucgggccauccccacggacaugggaagacgcagcaucagaucugccccacucccuccucccagucagguuuuuucugccagaugacucugcuguucaauuuccauugacucugcugcugaauuuccauugacugacucugcugcugaauuuccauuuccaucucucaucaggguuuucagugcuuugcuucccaguguguugccugagccacccucacauccugugccuuccuucuuaauaggaacgcuguguuuuccuuuguucuugcagaauuucgcuaaggaguuugugaucagugaucggaaggagcuggaggaagauuucaucaagagcgagcugaagaaggcggggggagccaauuacgacgcccagacggaguaaccccagcccccgccacaccaccccuugccaaagucaucugccugcuccccgggggagaggaccgccggccucagcuacuagcccaccagcccaccagggagaaaagaagccaugagaggcagcgcccgccacccuguguccacagcccccaccuucccgcuucccuuagaacccugccguguccuaucucaugacgcucauggaaccucuuucuuugaucuucuuuuucuuuucucccccucuuuuuuguucuaaagaaaagucauuuugaugcaagguccugccugccaucagauccgaggugccuccugcagugaccccuuuuccuggcauuucucuuccacgcgacgaggucugccuagugagaucugcaugaccucacguugcuuuccagagcccgggccuauuuugccaucucaguuuuccuggacccugcuuccuguguaccacugaggggcagcugggccaggagcugugcccggugccugcagccuucauaagcacacacguccauucccuacuaaggcccagaccuccugguaucugccccgggcucccucaucccaccuccauccggaguugccuaagaugcauguccagcauaggcaggauugcucgguggugagaagguuagguccggcucagacugaauaagaagagauaaaauuugccuuaaaacuuaccuggcaguggcuuugcugcacggucugaaaccaccuguucccacccucuugaccgaaauuuccuugugacacagagaagggcaaaggucugagcccagaguugacggagggaguauuucaggguucacuucaggggcucccaaagcgacaagaucguuagggagagaggcccaggguggggacugggaauuuaaggagagcugggaacggaucccuuagguucaggaagcuucuguguaagcugcgaggauggcuugggccgaaggguugcucugcccgccgcgcuagcugugagcugagcaaagcccugggcucacagcaccccaaaagccuguggcuucaguccugcgucugcaccacacauucaaaaggaucguuuuguuuuguuuuuaaagaaaggugagauuggcuugguucuucaugagcacauuugauauagcucuuuuucuguuuuuccuugcucauuucguuuuggggaagaaaucuguacuguauugggauuguaaagaacaucucugcacucagacaguuuacagaaauaaauguuuuuuuuguuuuucagaa

SEQ ID NO: 191977 - RNA, 13786 nt, Homo sapiens
uccuggcggagccauggcugcgcagcgggcuggccgggggucuccugaacccgggccccgccgccccgaccgcccggccccgccgccggggcuguccccgccgcguccguagcgcguccugccaggugggccuccgcgcgcgcccacccuccagcccgggaccgccaggaagccgcgcccggccggggcggggagcuggcggagaucgggaggguccccggccaccgcgagccgcgaccccccugcgccccuuggugccggggcgggcgggugggcgagugggggcgccgcggccgggggaggggccgccgcccccgcaggugacacaggugcggccugugcggaccgccccgcgcguggcaggugaguggcccccgccccgggccgucccgacuccgccuccucgccgccggcuggagccugcugggcggccguugcgcugaguuccgccugggcugcgggguccgagcgaacgacagcggcguccccggagaccccgccggcgagccggugucagcagcgucgcuuucuccaacgcugaggucgggagggagcuuggggaggaggcgcucugggaaacccccggccggacggggccugcggucccauguuuacuggaagaccuuuuccagugaccugggauugucacugugcuuggggguggccuugacccuucaccugcuuccaaaaagcgucggaggccgcugacguccaacacggguggaaaucagaccccacccccacgcacuugcaggagacagcagggagccuccggccccgcgaacucucucuagguaucuuggccuagaaaauaaagcguugagcguuagaaggccugguugauucugggcaggcugccuggggcgguggagagagagggcaccugcugcuugcuguucugugaccuugggcaacccccccuggggcacccgagcgccaggucucacugugggaacgacggugucaccucucagcgugaagguggaaugaagucgaguccgcggugggcaccgcaccaacgcuggguuucuucucuucccucucugggcucuccagcauccuaggggagggccggggugggaacagcuugucauugucacaaaguuucuaguuugucgagaggaauccaguugccccuucucucccuaggggaguugcacgggacggacugugcccgaauucauuccuuccaugggaacacuggagugcccucccuguguccccaguuaucuaagaacagugcugacuucuugucacauuguucuuuauuagugaagacuauuuguucaauagguaacaaacucuucucaugaacucaaauagcgggggaaaaaaauccucuuuaaaaccuucgucucaguaugugacuugugcuaauauuaguuggcaaagucccuucucuguguucccuuccaucuuugaagcaccugccccucccccugccucccccgccccccacacaccaaagcuuaacucugucugcagugaucccccacccaagagccaggcaguguagccuaagaguuaagagcaugggcgcuucccugagcuggaaucccaauucugccaguucccagcugugugacgccgggcagcuuauuucaccucacugcucucagcauccuccagucacagugcuggccucaugggguugcaguggggacuaagugaagaugcagagaagcacuuggggacagugugugucuagaauguacuguguacaugguagucaucacuguaccacauccucaucugcaucaugauauuuuuaaagugugauacucucgaacccgggccucauucagcagcgugucauggugauggauccagguuuugaagcuggacagaccgaggcgugauucucggccguuuacuagcuuugugaccaugagaucaauauccucaucugugaaaugaaauaagugauaucagccuggccaaguauaaucuuuguggggguuaaaugagauggcacacuuaagucacuuagcuugguucgagggcuguagucugggcuccgaaaugauaacuuaucauuauaaccuugauguagccaaaagguaauuauuuguaggaagugaaccaaaugacaugauaucagauuuuagaugauaaaggaaugggaguuaaauguucuguccaauucuaacaacccgaugauuucucaacucgguguaaaagaguucuuuguagugcacgguccucccucccuccuucuuccgugugacuguuuucacugucauccuugguaucugcuagcagggccugaaauuaaugaaugaccuagaguuaugacugcaugcucagaaauccuguucuucuccuagggcugaaaucucuuuaaugauggagggaagcaggcagacgcgagugucucggccauacaagaucagcgaaucaucaaaggucugugaauguucacucaccaccuaugcaaauugccuaagaagugugauccuuuuucugauucacucauuucuaaucacagacugauuuuuuugucauugguguugucagucuccuuaaugacaaguaaagguggaaacgggcaaggagcagaaauugucauaaaaucagacagugggaaguaugagggaugguagagacgcuauggccagaugucuucauuuuuccaugugacauuccggagcuuucuuuuugugacaacuugacucauucguuaacccaaggagguggaugggacaggaagaaaacugggauucccaugccugcuugggggcucaaaaacuccaaggacagguccauugagaacccagccuucuaccuuagggugagggcaacacaccguguacccggaccccaagggccuggagucgucuucccuggucaugauucccugcgaccuaagagcaagugagggcaaguuccccagagccaggcuacugggggaguucuaauuagaaauauguagccuguucccaccagccacauuaaaauccaagagccagacccggcugcuauacuuuccacaaacuccuguccccacagcugcuguugguaaagagugggggagccauugguaugagguuccugguaaccuguuuccccguuauaaauauucguaaugcccucuguucuuuagagguaucccuuuuggagauuaaaucuuaugguuaccucagaucauggauucucaaugaguaugauauugcccugaagugggagaaaauugguucucgggaggguggaaggaauuuuacuccuuuuaugcauaagacacaauuauacauacaguacaugagcagacauacagugcaucugugauguuaagauuuugcuggggaggcuauuagggaaaaaaaucuuaaaagccuucuuguggggcaauaaugaaaaaagauacagaaacacuucuuuagaugaagggagcuggcagcagccuauagaguugagaaaaagggggaaagagauucuacagauucuaaaagaaaaacuggcugucauuuucaagagagguuggcucucuugagauaugaccuccuguucucacgugaguuccccaagaagguuccugccaagcccagcuuuaucgauugugaaaacccagagaggucucgccgcucgcucacaagggcuuuguuugggagcuuagcuugggagacacugcugcuuucuaaguuugacagcacuggaagucuuuguccauuaaugccaggacccugaguuuguuucugucugaacugaaucucuuaggacuaggcuucuguaucacuggaugauguuucuaacuuuuuuuuuuuuucgagacagggucuugcucugucacuuagguuggaguacaguggugcgaucauagcucacugcagccucuaccuccugggcucaagugagccucccaccucagccuccugaggagcugggaauacaggugcaugccaccaugcccagcuaauuuuuguauuuuuaguagagacgggguuucaccauguuggccaggauggucuugaucucuugaccucgugacccgccagccuuggccucccaaagugcugggauuacaggcgcgagccaccaugacuggccuguuucuaacuuuuuauuuuuaaaaaguguacccauuaauuucuagacauuaaacacaccuauguugccagcacccagauggguaaaaaacagaauacuaccaaacccucccaguuguuacacucaagauagucgcugucccaaccccaccgcugugguuugaucugcuuuugaacuuugucuaaacgggauccgaggucggguacucuugugugugguuucuuuugugcaacauugugccucugagccucacccguguugcugcauguaguugguagugguagguuuugcuuucucagcauguuggugucuucccacuguguggccacagugucuguucaccugucugcccuaagauguguugcucagccaggcacaguggcucacgccuguaaucccagcacccugggaggccgaggcgggaggaucucguaagcucggaguuugagaccagcuuggacaacacggcuaaaccucaucucuacaaaagauacaaaaauuagccgagccugguggcauacaccuguagucccagcuccucaggaggccgaggugggaggcucacuugagcccaggagguagagguugcagugagcuaugaucgcaccacuguacuccaaccuaagugacagagcgagacccugucucaaaaaaaaaaaguguuguuccuuuuugaugcuaaauucuuuuuccacgucuaauaccugguaccugccgccuccucccagguguaagcccccgacaaccugaguuucucccucuacuuggccuugcaucugauuaaggcacugaaauaggaaauaaagaaaugaacaagacucauaucaucagagaaugcuguggauuggagcuucuaaguuaccugaaaugcggaaacucuguuaccaaugucccuuuauaauugggaaauaggccaggcgcaguggcucacgccuggaauccuagaacuuugggaggcugagguggauggaucacuugaagucaggaguucgaggccaacauggugaaaccccgucucuacugauauauguauauaugccgggagugguggcaccugaggucaggaguuuaagaccagccuggccaaaauggcaaaacccugucucuacuaaaaagacaaaauuagcugggcauggugguacaugccgguagucccagcuacucaggaggcugaggcaggagaaucgccugaaccugggaggcggagguugcagugagccgagaucgagccacugcacuccagccugggcaacagagggaggcucuguauccaaaaaaaaaaaaaaaaaaagggaacucgugugccuguguuuuuggaaaguugucuaugcagcugugcuaaaacaccagaagcagauugcagcugauuguacccggguacagcaucacuccagcccacuuagagcagaaacccaguuuuggaaacaacacugcucuugcccccugccccagcucacuggagcuggugucuccccucggcagccguucacuggggcuuuccccaguccugcccccugggcucuuucccuuuugacacugcagucugggguuguguguaucuccgucuaagcaugguagggccagcacccucaccagcguggagacagccaggguccccggguggcagauagccgccucaugcccucauaugcgucucucaggccgcuaagccuguacuaugacuugaucaccgccacuguaguacuuuuuaauuuccuuccuucagcucacacccaagaggggccuccagucaaugucuguagaagcacugaccauuccugcauaauuagaagcugaggccuagcacgguggcuuauaccuguaaucccagcacauugggaggcugaggcaggaggaucguuugaacucaggagcugaagaccagccugggcaauguagugagaccccauuucuacaaaaaauaaaaguaaaaaauagcuggauaugguggcacacaccuguagucccagcugccaaggaagcugaaguggagggauugcuugagacuaguuuuguuuuguuuuguuuuguuuuguuuuguuuuguuuuguuuuguuuuguuuuguuuuugagauggcguuuuguucguguugcccaggcuggagugcaguggcucacugcaaccuccgccuccggagugcaagugauucuccugcgucagccuccugaguagcuaggaugacaggcgcccgccaccacaaccagcuaauuuuguauuuuuacuagagacgggguuucaccauguuggucaggcuggucucgaacuccugaccucaggugaccugcccaccucggccucccaaaguacugggauuccaggcaugagccaccacgcccggcugagccuaggaguuucaggccgcagugaucucugaucuacuguugcaugccagccugggaaacagagcaagacccuguuucuaaaaaugagaaaaaauuuaaaagcccgguguaggccagccuggcucucuuuguggguaaccaggauaaauagagaucuccacgugugugaccugugaacugaaaagccagccuggaauggaagagcgggagagcccguccucugaacucagaaggaaaugccaagucggaucugucuggcauccuccacaggcugugagaauguggccugcuccuguagcauggacagagaaguugcuguuggaauugacuggauguggaaauaccacagggaaauaaagugucucaaugacaaacgcauguauggcaacaaaaagaagauuugaaagggaagaaaaaaauaaaacccacugcuguaggacacauguuaagaagcaacuuuuaagaauucagagccugggcaguuuagggagacguugucccugcaaauuauaaaaaucagacaggcgugguagcgugugccuguagucccaguuacucaggaggcuaaggcggaagaaucacuugagcccaggaggucaagggcgacauagugagaccucgucucuacaaaaaaauuuuaaaauuagccaggcaugguggcacacacccguagucccagcuacucaggaggcugaggugggagaaucacuugagcccaggaggucaagggugcagugagccgagauugugccacugcacuccagccugggcaacagagugagacccugucucaaaaaaaaaaaaaaaaaagucgaaccacauagcugcuaauaccuaauagcccucggucaguuuucuuccuccaaccacauuuccccucuucaggcuagugcccagccaguucuucaccucagucacccuggaauagaccagcuaucuaugugauaguuuucaguuaccuguuucucccuauguugaauucauuuauuuauuuauuuagagacaggguuucuuuuugucguccaggcuggagugcaguggcacaaucauggcucacugcagccucaagcuccugggcuugagcgauccuccugccucagccuccugagcagcugggacuacaggcgaaugccaccacgcccaccuaauuuuuaaauauuuuguuaagacaggaaucucgcuauguugcccagguuggucucgaacuuccuggccucaagugauucucccgucucagucucacaaagcauugagauuacaggcaugagccaccaugccuggcuugaauuguuguguuguuugguuuuggguuuuuuugguuuguuuuuuguuuuuucuuguuuguuuuguuuuguuuguuuguuuuuuguuuuuugagacggaguucuugcucugucucccaggcuggaguguaguggugugcucuuggcucacugcaaccuccaucuccuggguucaagcaauucuccugccucagccuccugaguagcuaggauuacaggcacacgccaccaugccuggcuaaauuuuguauuuuuaguagagacaggguuucaccauguuggccaggcugcucucaaacuccaguagccgggcugucgucccagcuacucaggaggcugaggcaggagaaucacuugaacccgggaggcagagguugcagugagcugagguugugccacugcacuccagccugggcgacagagcaaggcucugugucaaaaaaaaaaaaagaaagaaagaaagaaagaaguuauauuaauaagagaaggaaaaaaaaaaccacgauacacaggcauacucagaaacaccuguacuuccugcagugcccucugaugcagcauuuuauuuccuguuuucuucaguuucauuuuguugaaaaugcuggucaggacccacuggguuggaccagggccgagcaggcugcugcgccguuucuaaugugucuucucuguccagguauaccgcugggccgaccacucaagcacggugcugcagcggcugaacgagcagcgucuccgcgggcucuucugcgacgucguccugguggccgaugagcagcgugugccagcccaucgcaaccugcuggccgugugcagcgacuacuucaacuccauguucaccaucggcaugcgggaagcuuuccagaaggagguggagcugaucggcgccuccuacauugggcucaaggccgugguggacuuccuguacggcggggagcuggugcuggauggcggcaacauugacuacguccuggagacggcucaccugcugcagaucuggacggugguagacuucugcugugaguaccuggagcaggaggugagcgaggacaacuaccuguaccugcaggagcuggccuccaucuacagccucaagcggcuugaugccuucaucgauggcuucauccugaaccacuucggcacgcuguccuuuacgcccgacuuccugcagaacgucuccaugcagaagcugugugucuaccugagcagcagcgaggugcagcgggagugugagcacgaccuccugcaggccgcccugcaguggcugacgcagcagcccgagcgcgaggcccacgcccgccaggugcuggagaacauccacuucccgcucauccccaagaacgaccugcugcaccgcgucaagccggccgugugcucgcugcugcccaaggaggccaacugcgagggcuucaucgaggaggccgugcgcuaccacaacaaccuggcggcccagcccgucaugcagaccaagcgcacggcgcugcgcaccaaccaggagcgccugcuguuugugggcggcgaggucuccgagcggugucuggagcucagugacgacaccugcuaccuggacgccaagagcgagcagugggucaaagagacgccgcugcccgcccggcggagccaccacugugucgcggugcuggggggcuucaucuucaucgccggcggcagcuucucacgggacaacggaggggaugcggccuccaaucuucuuuauagguaugacccccgcuguaaacaguggaucaaggugagauuaaagccagauuauuucuuuucucuugaggacucucucgguuuccuuaaccuagccuugacuuuccuuaccucucuggggccuugacaacuauccugcuucugaaugaggugugaugauaaagugacgagcagaauaccccggggccuacauccuggacagggagagggagagccgacccaccccuucgagggguccgucaucguucagagcagcacugccuggcggggcuuucugugcagauggaagggucugucuguacuucccgauacgguagccacagccgcauguggcgacugagcacuugaaauguggccagugcgacugaagaagucaauuuucaauuuuauuucacuuuaaccgauugacguguaaguguauguggccgcacgaggcguggcuacccuauuggacaguagcaugggucuagauguuugauccaugguucaacauccccagguccuggagucucuguggggcuccucuggaagcauuuugggagauaguuuaaggagaccacuagugcucacgccuggcccuugggcauguauuguguccugauucugggaagagcgugggccuugaugucagaccugaggucucaucccagccuggcuaagucauagcuaggaaauuucagauucuuguccucuccacauuuuggauuccccuucugggaauacgugggggacagggagugcaguagcucauguugacuggcaagccccuggcguagggaaggugucuccuuucugcugggagcgcucuccagccacucgguccccgggacaguccaucucagccucuauacucacaccucagcgucgcgcccagcucagugcuguucucagcucaaaacccagucagaauggacuccagcugaccuuuugauuuuacucucagaaaucugagacugcccuccaaggucgaagugucaccacuggaaagggucccuggcuuuggagccuccucccgaagccuggcagcaguggcagcaguguguuugccuuggauucguuuaaaaaaagaaaaaaaaaaguuggcucuucuacuuuuugugugugugugugugagacagaguuguucugucacccaagcuggagugcaguggcacgaucucggcuaauugcaaccucugccucccagguucaaacaauucuggcgccucaaccuacugaguagcuggaauuacaggcgccugccaccacgcccggcuaauuuuuguauuuucaguagagacgggguuucaccauguuggccaggcuggucucgaacuccgugaccucagguaauccacccaccuuggcuucccaaagugccaggauuacaggcgugagccaccgcgcccagccucuucuguuuaauuuccugucgaaugccacguccugcucuguuaacacggaguggcagagcagcacuaacuuuacaaaucugauguggggagaggaaagaugaauuuuuauuucauaaagccacuagaucagcaauucugaccccugugaccacagaguucccauccacgcggcuaacgacaugaccagagaaguucggggguucagagcaucuccaucccccuuuuggggacucagagcgucuccaucccacuuuuggggauucagagcaucuuggugaaaccucgggggcucagagcucccaccugaagaagcccucuuuauucaggugcaguucccuuucccaaacauucuccgggguugugcauuccgcagacacauuugggaaccgcagcgccagauguugaugcugucccggguucggggaagggaagguacagguaucucaacuccacagguggccuccaugaaccagcgccguguggauuucuaccuugccuccaucgaagacaugcugguggccaucggcggccggaaugagaacggagcgcucucuucaguagagacguacagucccaagacugacuccugguccuauguggccggcuugccaaggugaucuggggcuugguggaagguucuccaaaugggauguuuuuaagggacauaguucaguccacgugccucacuuucugggcauguuggccuccaauuccaggaaugaaaucuuccggcuugucaggaagaguggguacaccaugaggggcggagggcgugacggugcacaguccgggcuccgguuucagacuuagggcaagggucagcucugccgccaugacggacaucccuccauggcugagugugugcaguugcugagcuucagagggugaggccugaccugaggaucucccugagcuugggcaggaggaguucaaagagauggggguauaugugcuagaucuaagccucaggcaugggucuucaccccgcucggccuuuaguuccucaucuguagagguagacgauaaugauacccaccccacagcacuguugugcagagcagaugcagugcugcuugugaaaccugcauccacaugcagggagugccccaggguggccgccucacccuccucagucuccccugcguuccgaugugcauguaucgagcauuuauuaucuccaugggauuagcagaaggugcacaccauuuuuuccaccaguucccuguugccgcacccagcagugcacuuucugaaccagucuuugcuguggaauacauccagguguccguaagaguuagaagugugugggguaagcgcucguauuuuuguuuuucugagagagagucucucucugucacccaggcuggagugcaguggcgcgaucucggcucacugcaaucucugccuccugaacucaagcaguucuccugccucagccuucugaguagcugggacugcaggcgccugccaccacacccagcuaaguuuuguauuuuugguagagacaggauuucaucauguuagccaggcuggucuugaacuccuagccucaagagauccacccaccucacccucacaaagugcugggauuacaggcaugagccacugcaccuggccauauugauccuuucuuauucacuaaaggcccugguuuacaucaggguucccacuuccuggcacaguuguguggguuuugaggaacacaaagcaacaugaauccaccauuacagcaucacgcagaaucauuucacugcccuaaagcccacugugugcgugcuguccaucccucccuccccucuccccacaguccuggcagccacugauuuugcugucucuaugguuuuaggcaaaacuuuucccgagugccagcacaguuagaauuggacuguaugucguauuuccucuuugaugugugauucaucgggugcaugugugccugcuagcucauuguucuagucguuuccagccauugugaaaagggugaugguccugugauuauucccauuucccagauggggcaagggagacucagagagagugaagcuggguucuggcccaggcggccugacugcaaagcuguccacuuccccgcccugcccugccauuucuuugcuaaugacggcuacugucuauagaguguucauggggugcccacucccuauauucuuaaauccucauggcccucuaagacggcaggcuguuccccggcucggaggggguaagccuggcacagcccugagcucucccucugucucugcccgucgacccugcagguucacguacggccacgcgggcaccaucuacaaagacuucguguacaucucggggggccacgacuaccaaauuggccccuaccgcaagaaccugcuaugcuacgaccaccggacagacgugugggaggagcggcggcccaugaccacggcgcgcggcuggcacagcaugugcagccugggugacagcaucuacuccaucgggggcagcgaugacaacaucgaguccauggagcgcuucgacgugcugggcguggaggccuacagcccgcagugcaaccaguggacccgcguggcgccgcugcugcacgccaacagcgagucgggcguggcagugugggagggccgcaucuacauccugggcggcuacagcugggagaacacugccuucuccaagaccgugcagguguacgaccgcgaggccgacaaguggagcaggggcgucgaccugcccaaggccaucgcuggcggguccgccugugucugcgcccuggagccacggccagaggacaagaagaagaaaggcaaaggcaagaggcaccaggaccggggccagugacccuagcugcgccucuugggaccauccucaccgucaccucccagggcucuguagaccagcagcaacuucuuaguauuccggaaacauuauguacaacuuagcagcuuuuuuuacuuuuaugauucuugguauuucuaugauaucacaguaaccaauuaaauacuaucuguaacuuua

SEQ ID NO: 191978 - RNA, 13786 nt, Homo sapiens
uaaaguuacagauaguauuuaauugguuacugugauaucauagaaauaccaagaaucauaaaaguaaaaaaagcugcuaaguuguacauaauguuuccggaauacuaagaaguugcugcuggucuacagagcccugggaggugacggugaggauggucccaagaggcgcagcuagggucacuggccccgguccuggugccucuugccuuugccuuucuucuucuuguccucuggccguggcuccagggcgcagacacaggcggacccgccagcgauggccuugggcaggucgacgccccugcuccacuugucggccucgcggucguacaccugcacggucuuggagaaggcaguguucucccagcuguagccgcccaggauguagaugcggcccucccacacugccacgcccgacucgcuguuggcgugcagcagcggcgccacgcggguccacugguugcacugcgggcuguaggccuccacgcccagcacgucgaagcgcuccauggacucgauguugucaucgcugcccccgauggaguagaugcugucacccaggcugcacaugcugugccagccgcgcgccguggucaugggccgccgcuccucccacacgucuguccgguggucguagcauagcagguucuugcgguaggggccaauuugguagucguggccccccgagauguacacgaagucuuuguagauggugcccgcguggccguacgugaaccugcagggucgacgggcagagacagagggagagcucagggcugugccaggcuuacccccuccgagccggggaacagccugccgucuuagagggccaugaggauuuaagaauauagggagugggcaccccaugaacacucuauagacaguagccgucauuagcaaagaaauggcagggcagggcggggaaguggacagcuuugcagucaggccgccugggccagaacccagcuucacucucucugagucucccuugccccaucugggaaaugggaauaaucacaggaccaucacccuuuucacaauggcuggaaacgacuagaacaaugagcuagcaggcacacaugcacccgaugaaucacacaucaaagaggaaauacgacauacaguccaauucuaacugugcuggcacucgggaaaaguuuugccuaaaaccauagagacagcaaaaucaguggcugccaggacuguggggagaggggagggagggauggacagcacgcacacagugggcuuuagggcagugaaaugauucugcgugaugcuguaaugguggauucauguugcuuuguguuccucaaaacccacacaacugugccaggaagugggaacccugauguaaaccagggccuuuagugaauaagaaaggaucaauauggccaggugcaguggcucaugccuguaaucccagcacuuugugagggugagguggguggaucucuugaggcuaggaguucaagaccagccuggcuaacaugaugaaauccugucucuaccaaaaauacaaaacuuagcugggugugguggcaggcgccugcagucccagcuacucagaaggcugaggcaggagaacugcuugaguucaggaggcagagauugcagugagccgagaucgcgccacugcacuccagccugggugacagagagagacucucucucagaaaaacaaaaauacgagcgcuuaccccacacacuucuaacucuuacggacaccuggauguauuccacagcaaagacugguucagaaagugcacugcugggugcggcaacagggaacugguggaaaaaauggugugcaccuucugcuaaucccauggagauaauaaaugcucgauacaugcacaucggaacgcaggggagacugaggagggugaggcggccacccuggggcacucccugcauguggaugcagguuucacaagcagcacugcaucugcucugcacaacagugcugugggguggguaucauuaucgucuaccucuacagaugaggaacuaaaggccgagcggggugaagacccaugccugaggcuuagaucuagcacauauacccccaucucuuugaacuccuccugcccaagcucagggagauccucaggucaggccucacccucugaagcucagcaacugcacacacucagccauggagggauguccgucauggcggcagagcugacccuugcccuaagucugaaaccggagcccggacugugcaccgucacgcccuccgccccucaugguguacccacucuuccugacaagccggaagauuucauuccuggaauuggaggccaacaugcccagaaagugaggcacguggacugaacuaugucccuuaaaaacaucccauuuggagaaccuuccaccaagccccagaucaccuuggcaagccggccacauaggaccaggagucagucuugggacuguacgucucuacugaagagagcgcuccguucucauuccggccgccgauggccaccagcaugucuucgauggaggcaagguagaaauccacacggcgcugguucauggaggccaccuguggaguugagauaccuguaccuucccuuccccgaacccgggacagcaucaacaucuggcgcugcgguucccaaaugugucugcggaaugcacaaccccggagaauguuugggaaagggaacugcaccugaauaaagagggcuucuucaggugggagcucugagcccccgagguuucaccaagaugcucugaauccccaaaagugggauggagacgcucugaguccccaaaagggggauggagaugcucugaacccccgaacuucucuggucaugucguuagccgcguggaugggaacucuguggucacaggggucagaauugcugaucuaguggcuuuaugaaauaaaaauucaucuuuccucuccccacaucagauuuguaaaguuagugcugcucugccacuccguguuaacagagcaggacguggcauucgacaggaaauuaaacagaagaggcugggcgcgguggcucacgccuguaauccuggcacuuugggaagccaagguggguggauuaccugaggucacggaguucgagaccagccuggccaacauggugaaaccccgucucuacugaaaauacaaaaauuagccgggcgugguggcaggcgccuguaauuccagcuacucaguagguugaggcgccagaauuguuugaaccugggaggcagagguugcaauuagccgagaucgugccacugcacuccagcuugggugacagaacaacucugucucacacacacacacacaaaaaguagaagagccaacuuuuuuuuuucuuuuuuuaaacgaauccaaggcaaacacacugcugccacugcugccaggcuucgggaggaggcuccaaagccagggacccuuuccaguggugacacuucgaccuuggagggcagucucagauuucugagaguaaaaucaaaaggucagcuggaguccauucugacuggguuuugagcugagaacagcacugagcugggcgcgacgcugaggugugaguauagaggcugagauggacugucccggggaccgaguggcuggagagcgcucccagcagaaaggagacaccuucccuacgccaggggcuugccagucaacaugagcuacugcacucccugucccccacguauucccagaaggggaauccaaaauguggagaggacaagaaucugaaauuuccuagcuaugacuuagccaggcugggaugagaccucaggucugacaucaaggcccacgcucuucccagaaucaggacacaauacaugcccaagggccaggcgugagcacuaguggucuccuuaaacuaucucccaaaaugcuuccagaggagccccacagagacuccaggaccuggggauguugaaccauggaucaaacaucuagacccaugcuacuguccaauaggguagccacgccucgugcggccacauacacuuacacgucaaucgguuaaagugaaauaaaauugaaaauugacuucuucagucgcacuggccacauuucaagugcucagucgccacaugcggcuguggcuaccguaucgggaaguacagacagacccuuccaucugcacagaaagccccgccaggcagugcugcucugaacgaugacggaccccucgaaggggugggucggcucucccucucccuguccaggauguaggccccgggguauucugcucgucacuuuaucaucacaccucauucagaagcaggauaguugucaaggccccagagagguaaggaaagucaaggcuagguuaaggaaaccgagagaguccucaagagaaaagaaauaaucuggcuuuaaucucaccuugauccacuguuuacagcgggggucauaccuauaaagaagauuggaggccgcauccccuccguugucccgugagaagcugccgccggcgaugaagaugaagccccccagcaccgcgacacagugguggcuccgccgggcgggcagcggcgucucuuugacccacugcucgcucuuggcguccagguagcaggugucgucacugagcuccagacaccgcucggagaccucgccgcccacaaacagcaggcgcuccugguuggugcgcagcgccgugcgcuuggucugcaugacgggcugggccgccagguuguugugguagcgcacggccuccucgaugaagcccucgcaguuggccuccuugggcagcagcgagcacacggccggcuugacgcggugcagcaggucguucuuggggaugagcgggaaguggauguucuccagcaccuggcgggcgugggccucgcgcucgggcugcugcgucagccacugcagggcggccugcaggaggucgugcucacacucccgcugcaccucgcugcugcucagguagacacacagcuucugcauggagacguucugcaggaagucgggcguaaaggacagcgugccgaagugguucaggaugaagccaucgaugaaggcaucaagccgcuugaggcuguagauggaggccagcuccugcagguacagguaguuguccucgcucaccuccugcuccagguacucacagcagaagucuaccaccguccagaucugcagcaggugagccgucuccaggacguagucaauguugccgccauccagcaccagcuccccgccguacaggaaguccaccacggccuugagcccaauguaggaggcgccgaucagcuccaccuccuucuggaaagcuucccgcaugccgauggugaacauggaguugaaguagucgcugcacacggccagcagguugcgaugggcuggcacacgcugcucaucggccaccaggacgacgucgcagaagagcccgcggagacgcugcucguucagccgcugcagcaccgugcuugaguggucggcccagcgguauaccuggacagagaagacacauuagaaacggcgcagcagccugcucggcccugguccaacccaguggguccugaccagcauuuucaacaaaaugaaacugaagaaaacaggaaauaaaaugcugcaucagagggcacugcaggaaguacagguguuucugaguaugccuguguaucgugguuuuuuuuuuccuucucuuauuaauauaacuucuuucuuucuuucuuucuuuuuuuuuuuuugacacagagccuugcucugucgcccaggcuggagugcaguggcacaaccucagcucacugcaaccucugccucccggguucaagugauucuccugccucagccuccugaguagcugggacgacagcccggcuacuggaguuugagagcagccuggccaacauggugaaacccugucucuacuaaaaauacaaaauuuagccaggcaugguggcgugugccuguaauccuagcuacucaggaggcugaggcaggagaauugcuugaacccaggagauggagguugcagugagccaagagcacaccacuacacuccagccugggagacagagcaagaacuccgucucaaaaaacaaaaaacaaacaaacaaaacaaaacaaacaagaaaaaacaaaaaacaaaccaaaaaaacccaaaaccaaacaacacaacaauucaagccaggcaugguggcucaugccuguaaucucaaugcuuugugagacugagacgggagaaucacuugaggccaggaaguucgagaccaaccugggcaacauagcgagauuccugucuuaacaaaauauuuaaaaauuaggugggcgugguggcauucgccuguagucccagcugcucaggaggcugaggcaggaggaucgcucaagcccaggagcuugaggcugcagugagccaugauugugccacugcacuccagccuggacgacaaaaagaaacccugucucuaaauaaauaaauaaaugaauucaacauagggagaaacagguaacugaaaacuaucacauagauagcuggucuauuccagggugacugaggugaagaacuggcugggcacuagccugaagaggggaaaugugguuggaggaagaaaacugaccgagggcuauuagguauuagcagcuaugugguucgacuuuuuuuuuuuuuuuuuugagacagggucucacucuguugcccaggcuggagugcaguggcacaaucucggcucacugcacccuugaccuccugggcucaagugauucucccaccucagccuccugaguagcugggacuacgggugugugccaccaugccuggcuaauuuuaaaauuuuuuuguagagacgaggucucacuaugucgcccuugaccuccugggcucaagugauucuuccgccuuagccuccugaguaacugggacuacaggcacacgcuaccacgccugucugauuuuuauaauuugcagggacaacgucucccuaaacugcccaggcucugaauucuuaaaaguugcuucuuaacauguguccuacagcaguggguuuuauuuuuuucuucccuuucaaaucuucuuuuuguugccauacaugcguuugucauugagacacuuuauuucccugugguauuuccacauccagucaauuccaacagcaacuucucuguccaugcuacaggagcaggccacauucucacagccuguggaggaugccagacagauccgacuuggcauuuccuucugaguucagaggacgggcucucccgcucuuccauuccaggcuggcuuuucaguucacaggucacacacguggagaucucuauuuauccugguuacccacaaagagagccaggcuggccuacaccgggcuuuuaaauuuuuucucauuuuuagaaacagggucuugcucuguuucccaggcuggcaugcaacaguagaucagagaucacugcggccugaaacuccuaggcucagccgggcgugguggcucaugccuggaaucccaguacuuugggaggccgaggugggcaggucaccugaggucaggaguucgagaccagccugaccaacauggugaaaccccgucucuaguaaaaauacaaaauuagcugguugugguggcgggcgccugucauccuagcuacucaggaggcugacgcaggagaaucacuugcacuccggaggcggagguugcagugagccacugcacuccagccugggcaacacgaacaaaacgccaucucaaaaacaaaacaaaacaaaacaaaacaaaacaaaacaaaacaaaacaaaacaaaacaaaacuagucucaagcaaucccuccacuucagcuuccuuggcagcugggacuacaggugugugccaccauauccagcuauuuuuuacuuuuauuuuuuguagaaauggggucucacuacauugcccaggcuggucuucagcuccugaguucaaacgauccuccugccucagccucccaaugugcugggauuacagguauaagccaccgugcuaggccucagcuucuaauuaugcaggaauggucagugcuucuacagacauugacuggaggccccucuugggugugagcugaaggaaggaaauuaaaaaguacuacaguggcggugaucaagucauaguacaggcuuagcggccugagagacgcauaugagggcaugaggcggcuaucugccacccggggacccuggcugucuccacgcuggugagggugcuggcccuaccaugcuuagacggagauacacacaaccccagacugcagugucaaaagggaaagagcccagggggcaggacuggggaaagccccagugaacggcugccgaggggagacaccagcuccagugagcuggggcagggggcaagagcaguguuguuuccaaaacuggguuucugcucuaagugggcuggagugaugcuguacccggguacaaucagcugcaaucugcuucugguguuuuagcacagcugcauagacaacuuuccaaaaacacaggcacacgaguucccuuuuuuuuuuuuuuuuuuuggauacagagccucccucuguugcccaggcuggagugcaguggcucgaucucggcucacugcaaccuccgccucccagguucaggcgauucuccugccucagccuccugaguagcugggacuaccggcauguaccaccaugcccagcuaauuuugucuuuuuaguagagacaggguuuugccauuuuggccaggcuggucuuaaacuccugaccucaggugccaccacucccggcauauauacauauaucaguagagacgggguuucaccauguuggccucgaacuccugacuucaagugauccauccaccucagccucccaaaguucuaggauuccaggcgugagccacugcgccuggccuauuucccaauuauaaagggacauugguaacagaguuuccgcauuucagguaacuuagaagcuccaauccacagcauucucugaugauaugagucuuguucauuucuuuauuuccuauuucagugccuuaaucagaugcaaggccaaguagagggagaaacucagguugucgggggcuuacaccugggaggaggcggcagguaccagguauuagacguggaaaaagaauuuagcaucaaaaaggaacaacacuuuuuuuuuuugagacagggucucgcucugucacuuagguuggaguacaguggugcgaucauagcucacugcaaccucuaccuccugggcucaagugagccucccaccucggccuccugaggagcugggacuacagguguaugccaccaggcucggcuaauuuuuguaucuuuuguagagaugagguuuagccguguuguccaagcuggucucaaacuccgagcuuacgagauccucccgccucggccucccagggugcugggauuacaggcgugagccacugugccuggcugagcaacacaucuuagggcagacaggugaacagacacuguggccacacagugggaagacaccaacaugcugagaaagcaaaaccuaccacuaccaacuacaugcagcaacacgggugaggcucagaggcacaauguugcacaaaagaaaccacacacaagaguacccgaccucggaucccguuuagacaaaguucaaaagcagaucaaaccacagcggugggguugggacagcgacuaucuugaguguaacaacugggaggguuugguaguauucuguuuuuuacccaucugggugcuggcaacauagguguguuuaaugucuagaaauuaauggguacacuuuuuaaaaauaaaaaguuagaaacaggccagucaugguggcucgcgccuguaaucccagcacuuugggaggccaaggcuggcgggucacgaggucaagagaucaagaccauccuggccaacauggugaaaccccgucucuacuaaaaauacaaaaauuagcugggcaugguggcaugcaccuguauucccagcuccucaggaggcugaggugggaggcucacuugagcccaggagguagaggcugcagugagcuaugaucgcaccacuguacuccaaccuaagugacagagcaagacccugucucgaaaaaaaaaaaaaguuagaaacaucauccagugauacagaagccuaguccuaagagauucaguucagacagaaacaaacucaggguccuggcauuaauggacaaagacuuccagugcugucaaacuuagaaagcagcagugucucccaagcuaagcucccaaacaaagcccuugugagcgagcggcgagaccucucuggguuuucacaaucgauaaagcugggcuuggcaggaaccuucuuggggaacucacgugagaacaggaggucauaucucaagagagccaaccucucuugaaaaugacagccaguuuuucuuuuagaaucuguagaaucucuuucccccuuuuucucaacucuauaggcugcugccagcucccuucaucuaaagaaguguuucuguaucuuuuuucauuauugccccacaagaaggcuuuuaagauuuuuuucccuaauagccuccccagcaaaaucuuaacaucacagaugcacuguaugucugcucauguacuguauguauaauugugucuuaugcauaaaaggaguaaaauuccuuccacccucccgagaaccaauuuucucccacuucagggcaauaucauacucauugagaauccaugaucugagguaaccauaagauuuaaucuccaaaagggauaccucuaaagaacagagggcauuacgaauauuuauaacggggaaacagguuaccaggaaccucauaccaauggcucccccacucuuuaccaacagcagcuguggggacaggaguuuguggaaaguauagcagccgggucuggcucuuggauuuuaauguggcuggugggaacaggcuacauauuucuaauuagaacucccccaguagccuggcucuggggaacuugcccucacuugcucuuaggucgcagggaaucaugaccagggaagacgacuccaggcccuugggguccggguacacgguguguugcccucacccuaagguagaaggcuggguucucaauggaccuguccuuggaguuuuugagcccccaagcaggcaugggaaucccaguuuucuuccugucccauccaccuccuuggguuaacgaaugagucaaguugucacaaaaagaaagcuccggaaugucacauggaaaaaugaagacaucuggccauagcgucucuaccaucccucauacuucccacugucugauuuuaugacaauuucugcuccuugcccguuuccaccuuuacuugucauuaaggagacugacaacaccaaugacaaaaaaaucagucugugauuagaaaugagugaaucagaaaaaggaucacacuucuuaggcaauuugcauagguggugagugaacauucacagaccuuugaugauucgcugaucuuguauggccgagacacucgcgucugccugcuucccuccaucauuaaagagauuucagcccuaggagaagaacaggauuucugagcaugcagucauaacucuaggucauucauuaauuucaggcccugcuagcagauaccaaggaugacagugaaaacagucacacggaagaaggagggagggaggaccgugcacuacaaagaacucuuuuacaccgaguugagaaaucaucggguuguuagaauuggacagaacauuuaacucccauuccuuuaucaucuaaaaucugauaucaugucauuugguucacuuccuacaaauaauuaccuuuuggcuacaucaagguuauaaugauaaguuaucauuucggagcccagacuacagcccucgaaccaagcuaagugacuuaagugugccaucucauuuaacccccacaaagauuauacuuggccaggcugauaucacuuauuucauuucacagaugaggauauugaucucauggucacaaagcuaguaaacggccgagaaucacgccucggucuguccagcuucaaaaccuggauccaucaccaugacacgcugcugaaugaggcccggguucgagaguaucacacuuuaaaaauaucaugaugcagaugaggaugugguacagugaugacuaccauguacacaguacauucuagacacacacuguccccaagugcuucucugcaucuucacuuaguccccacugcaaccccaugaggccagcacugugacuggaggaugcugagagcagugaggugaaauaagcugcccggcgucacacagcugggaacuggcagaauugggauuccagcucagggaagcgcccaugcucuuaacucuuaggcuacacugccuggcucuugggugggggaucacugcagacagaguuaagcuuugguguguggggggcgggggaggcagggggaggggcaggugcuucaaagauggaagggaacacagagaagggacuuugccaacuaauauuagcacaagucacauacugagacgaagguuuuaaagaggauuuuuuucccccgcuauuugaguucaugagaagaguuuguuaccuauugaacaaauagucuucacuaauaaagaacaaugugacaagaagucagcacuguucuuagauaacuggggacacagggagggcacuccaguguucccauggaaggaaugaauucgggcacaguccgucccgugcaacuccccuagggagagaaggggcaacuggauuccucucgacaaacuagaaacuuugugacaaugacaagcuguucccaccccggcccuccccuaggaugcuggagagcccagagagggaagagaagaaacccagcguuggugcggugcccaccgcggacucgacuucauuccaccuucacgcugagaggugacaccgucguucccacagugagaccuggcgcucgggugccccaggggggguugcccaaggucacagaacagcaagcagcaggugcccucucucuccaccgccccaggcagccugcccagaaucaaccaggccuucuaacgcucaacgcuuuauuuucuaggccaagauaccuagagagaguucgcggggccggaggcucccugcugucuccugcaagugcguggggguggggucugauuuccacccguguuggacgucagcggccuccgacgcuuuuuggaagcaggugaagggucaaggccacccccaagcacagugacaaucccaggucacuggaaaaggucuuccaguaaacaugggaccgcaggccccguccggccggggguuucccagagcgccuccuccccaagcucccucccgaccucagcguuggagaaagcgacgcugcugacaccggcucgccggcggggucuccggggacgccgcugucguucgcucggaccccgcagcccaggcggaacucagcgcaacggccgcccagcaggcuccagccggcggcgaggaggcggagucgggacggcccggggcgggggccacucaccugccacgcgcggggcgguccgcacaggccgcaccugugucaccugcgggggcggcggccccucccccggccgcggcgcccccacucgcccacccgcccgccccggcaccaaggggcgcaggggggucgcggcucgcgguggccggggacccucccgaucuccgccagcuccccgccccggccgggcgcggcuuccuggcggucccgggcuggagggugggcgcgcgcggaggcccaccuggcaggacgcgcuacggacgcggcggggacagccccggcggcggggccgggcggucggggcggcggggcccggguucaggagacccccggccagcccgcugcgcagccauggcuccgccagga

SEQ ID NO: 191979 - RNA, 79973 nt, Homo sapiens
uuaaaccaacuuugugauuuuuauugaugggcgacaacuuuauacuccuagauaucacuaaacuguguacaauuagggacgcagcauuagagaagagcagacagcagaauuaaacagagcagacugaaggagagaucuucauuauuugcccauuuuucauuauguguacacagaagcaugaaugcaauuugaaaucuuuuaauggcaauaaaguuacaaucacccaucuauguagacuaacauuuuaacuccaaauauuugaucugcaauguguacguaagcaguuucucucaguacaauuauuaaaauuuuuccuguuaggaaccagcaacuuauuuuuuauguuuauuuuucuuuugaaguaagaacuaguucuucuuugauaacuggcucauuuuuaucauuuaucaaaaacuaaaggguagggaagaaaagugugauggauuaaaaaauuucuuuuuuaaggaaagauaaaauucauuuucacaaauuuacaaguguuguugcuggugcaggauuuauucuacuaagcaaugagacuggggaucaaauccacuuucuuaucucaggaaucagcauuauuucagaaauauggguuuuuguguauuuucuaaaaucaagcaacagucuguuucaaccaaaugauuuugauuuggaaguuagagucaacagaagcuguguugugcacgaaccccaaggcaucuccuuuucauucuagcccauuuuugcaaagggagaaagaguuucucucuaaagagccacuaaagagaggcgggaagugagugugaggugguguccuacgaagcgggcacugggcgcacacacagcgcacacaggguuuacagcagguccacucggcgguaauacaggagguaggcugugcguucagcaguugguuucaccaccugguacugguugaucaccuugacugucuggucaucgaugcgcagccagccauucagaccgaucuggaagacgucuguaguguaauggccgcccgucgcacuguugccgugaugguagaccacuggaagagagcccagcaggcagcagagugagaacagcacugcacacgaaucauuacaggucuccgccgacuucccuccagggaugcauccuauguguaaaaccccucuccaaagcaggugggacagagagaugucaucacacaaaccaaugcuauuucaacucaaacacgcaagcaauccauaauaaaaacuuuucuauaacugcaagguaaggguaagucagauagguacaugugugcauguacgcauauuaaccacauauuuaaaaugucccacgccucacacagacacuccuacacagccaucagcuguacaggccuacagaccuggcucaugcccuuggauguggcugacucuacuucuagacuguccugaagagauuaucugaaucuuggacagagauuaugaugucauuuauaacagugaaaaaacggaaaaccucaauagccacuagaagaaaugacugaugaguaaauuauauuaaaauaacacaauuuauuuuuucguggaauagauuaagaauggugaugcgggaauacgcuuaugguauauuaaaugagaaaacaagguccuuaggccuucuguggcccaucuauccuaaagacacgggacacaaucucccggugccggcccacauggcaggagggacccugggacugcuaaccacgguugcuugagcguggagcugugguggggcacugcggagauggugcugguaguuacgcauuugccuuuaaaaaaaauuacccauuuuucuauguuuuaacagaacaaaacacacacacacacacacacacacacaguuauuuacuuaaaaaaaaaauccuauaaccaagaagccuuagucaaaggccuaaaacaaaaaaucuguagaagaugucaugaaaacauuaagacagccacagaacacauccuccacuucuauggagcagaggggcacaggucugccuggccagcagcagacaccagccucgggaaggcggcuguccggcagcauuccgcggggaaugacagggcagccugcuaagcugcgcccaccaucaguggcacaaaagaaaaggaaccaggagagaugcaagacuuggcugguagggaauuucagcacuaaaacaagaccaaacaucaccagguucuagucgcaguugucacguggaggggcuaaaugacagcaggaggccucaguccucucugggccagggaccuuggcuggcuagaggacagugcuuaugacugaggccaccagucagacuccugggcucugcacaaagaaauccucugugcagggaccccggaggagacugaacagcauagggacagcaagacuguggggcccguacuucggagagccagggacacagccaauccaagggcauagcuucauccugugcugcacaagucacagccaucuugugaaagggcaggaagcacccaugacagcagcauguccccuggaucccaaguucacuuugagacuucuguccuagaucuucaccucacagaccuaacugacugggcuaagaguuuugcuucaaagcgaccaucaguagaaucugcagggccuggggguuuuacuaacuugucuuucccacaagacaucuccauucuaaaaugucaagggggacugcaugucaccauucuaguuucauaagcagcagcccaguuaacuacccugggcugagccgugugucacucacaccugcaagccccccugacaggagcgcugagaaccgccugaaaagcuugugcgcgagauugcuucucccaggccccacaaucacagcaguucuuaaaaaguguuccuuugcucacucuacagguaauucuaaccaguccggugaccucauuuccaagaucagaauaggcuuccagccuggccaaaagggcgaaaccucgucucuauucaaaauacaaaaauuagcuggaugugguggugcacagcuguaaucccagcuacucggggggcugaggcacaagaaucacuugaaccugggaggcagagguugcagugaauggagacugugccacugcacuccagccugggcgacagagcaaaacucuaucucaaaaaaauaauggguuaggggaugaggauucaggagggcaggggagagcaacccaggcccaggucccggggcgaggcagguugcagagucggggaggggugugugugcucacacuggggcccugaccaggagaggagcaaucccuagccccugccccugcccagugaugucccccgcaagagccuccaggggaagaggugcagggagaaggcggagaaacugcuggccacccacugggaccugggugccacacuccaaggagccaggcaggauaauggcuggcugcagagucugaggacucagaccuuccauuccagacagggcuggagacacccacaagcgcguggugcccauggccgucccaucugaggcccagcaaguugaggaggaauugugaucggggggagaaaagaagagagucaaaaggaacaaugaauagugagaggaagagagggaagccuggcaccuugcaguguggcucugggccucacccacugggcccucaccccugggcccccaccgcuaggcccucaccccugggcccccaucccugggcccucacccacucgccaaacuuccuaaaacaucgggcgugagcugagguggacaggagcuugaagcccugcucugccacugcaggccagaguggugaguuuucuuccuugaguucugguuuauucuuuuauaaaacagggaucccaccucccaucuccuaggacacauguaaggaaaugaaagaauaucuugggaagagguucaauacaugugugaaggucaauaaauggcaguguuauguuacgauacaaacagguucaccaaaggccacaccagaggagggaagacacagaagcuagaaacauguaguaaaaacagccugggaagcaaacaaaagugcggcaaacagcaacaauccaaagagguaaagacucagaggcauaaaagaugacgcuauaaaagagaaagaaggauaaaagggaaggcagaaaggaaagggaagaugauguggcagaaaaaaugauacugcagggagccuaagccaggagacagaagaggucucaagguccacccaugagggaacagggggugccauucacccuguugggagauuucucaugacugacugagggccuggcagccgaggagcuuguguaaucgggcccacccucucaagcagcccuaacaauaccugugggggaggacgcagggaucaccggcugggggcgcgcucacccaaccuggcugggugaccaggugucguggaaacuccacagcacugucacccacaggugccacaagcacagccgggagaggucacauucucaaacagccagccugggagccugaaacucccuccucugacucaaagacagaaauguucgcuuugagcaaggucuucuguuaucuguccucagggccaagaugauaauccgucaucuacgcagaguuucagguaaaacucucacgugacuccccgacucacaaggccacagggauaccugaguacagcaucuggucgcuaugcuaaguugcagcaaaccugugcccagcuguaaaccccuucaucaguguuuuaaugaagaaguaaugucguacaaauuuacucaccugcaaagagccgauagguucgguggcauuuaaaauucuuauuuuuaaccccuggagaaagcaguucuggaaaacaaaauaucaauggcuugaagcacuuuuagaaagguucaggguaacagcagcagaaaauggcuaacaacauucuccccagcaaguaaacugccugucagaccaggaacaaaacaacacucuaucccuucaguugcacaaaaauugacucaugaaggaaaugagccaugugacguaauaggacacaaaaugugcagccagcucacuaaagaaacaggagcaacggccgaggcugugaugcuccugugggaggccccuuaaaaacaggugcucuacaaaauggaaaagaaaaaagcugcugacuuaaaaacaaaaacaguugugaaaaauccaaggcaagaauuaaaauuuuacauaugcgucagaucauaaaacuucaauuacaggccaggcacgguggcucacgccuguaaucccagcacuuugggaggcugagacgggcgaucacgaggucaggagaucgagaccauccuggcuaauacagugaaaccacgucucuauuaaaaauacaaaaaauuacccgggcgugguggcacgcggcuguagucucagcuacucgggaggcugaggcaggagaaucacuugaacccgggaggcagagguugcagcgagccgagaucgcgccacugcacuccagccugggugacagagcaagaaaaaaacaaacaaacaaaaaaaaaacaaaacaaaacuucaguuacagaacaguaacaugauuucuccaaauaggaaccagucuaccagcugcuacgaggcgggaacucccugcucuuacugugcgcagaaguaccacuuacaccgacacaagaguccgucggaggcaugcuguucgaggcagccaucuguacuucugacccaugacccaagugagguccucuugucccccauuuauguuauuuauuuauuuuuuugagauggagucuugcucuguugcccaggcuggagugcaguggcaugaucucagcaaccucugcuucccagguucaagcgauucuccugccucagccucccaaguagcuaggauuacaggcacccaccaccaugcuaggcuaauuuuuguguuuuuagaagaguugggguuucaccacguuggucaggcuggucucgaacuccugaccucaggugaucugccugccucggccucccaaagugcugggauuacaggugugagccacugcgcccagcccccauuuaugucauauuuugauaauguauuggagguggcagcggauauaaaaauacagcaagcaagaaaagauauaaaaauaaaaucacuguagcaaaacauccaagucagcucagacagcugaucuggaggcgagugaagaugcaggagcagaggccgaggaugccuucuuugacuuagccggcauuccagguuucccgauggauagaauaaaauggggaggaggaucuguuacaugauucucacuggcaucuuucuuccucuugcugguccucaaaugggauuaaaaagcaaucggcugaugagugauaaggcagcuagaagugugagaggagcaacggacacuaaacccggcacagcagccaagcccgucagcagaaagcacagcucuugugugcaggccugggagagacagugucugagucuucacgggaagguauagggcgccccuaggguagacagggagccggcuagaagccagccaugcccacaguuccugggucaucuauauggaaggagguaugaggugggguugcugugccaggggacggagagaagaggacucucgguucagguuuguuccucugcaggacccaggagugaggcccaguguccucuuuucugcuucccaaacaccucgauauucugagaauccucucuagcuaaucacagucccaaucaagccucaguguuguacuauacguuuucacaaauucuaaagcuuucaagaaaagucuucuugaagcugugcuuuuagcaagaugccuuuaaccuggggcucuuuaaaauugcuuucaaaaagugccgagcccgugaccugacagagacuugaggcugguaagugccacgucuuauuugugcgccaccacaacuagagguuagaagggacucucacugccuaugagaaaucauucuuacuucacuaaaaaccacuuaacugggcuagucaacacagcuguuaauacucgguggaaggcaaacugcaccauucaucccugaaauauucacagaaaagugauguucuuuuugauagacaaaagcugcuauuuuucuaaucuaguaagauuauagaguuuaguuauuuuugccucuauuuucaacaggccauuuucaugagaauuuuaguauuaaggucuauuacaagucaagaaacuuaaaacaaguccacguccagcaagagaauguccucacucuugacaucauaaagaaaugcuacaggguugagcuucugaugugcaggagugugucaccacgaacacucccgaccuuauguaugcauuaccuuuacuaauuuccaaguccacaggauauucaauauuuuugauaagcuucuggcacccaccagucuucucauaaacgaaucguuucaggugcagcacgaggacaggagggaguuuuuccagagucacucuucgacuuaucucaaccuaagacacaaagcacaccaggacacaccgucccugucuuacuugcaacagcuaacaccacauccaccuuccgcucaaagacguccucugagaggugaggcccaagaguccuguggcaggacuucauggcuuuuccugccccacagaagcucugagaucuaccaaugcuccucuuaagaaaaugcacauacccagaugcaguggcucaugcccauuaaucccagcacuuugggaggcugagacaggcggaucaccugaggucaagaguuugagaccagccuggccaacauggugaaaucccgucucuacuaaaaauacaaaauuagccaggcgugguggugggcgccuguaaccccagcuaccuggguggcagaggcaagagaaucccuugaacccaggagguagacguugcagugagcuaaguucgcgccacuguaccccagccugggcaacacagcgagaucuugucucagaaaaaaagaaaaaagaagaagaaaaaugcauacguucccauaagcacaacugcagagagccucuugggucccugaaguccagucguaaacucaaaguuaagaacuuuacucuguggcauuacugacaaauuagcauaaaaauuaaaaagcuaacuuaguaccaccuuauuuauguacugacucccccgccuuuuuuggggggagggaguucucacucugucgcccaggcuggaguacagugguacgaucugcgcucacugcaacauccgucucccggguucaaacgauucuccugccucagccuccugaguagcugggauuacaggcucccaccaccacaucuggcuaauuuuguauuuuuaguaaagaagggguuucaccauguuggccaggcuggucuugaacuccugaccucaggugauccaccugccucagccucccaaagugcugagauuacaggcgugagccaccacgcuaggccuaguauugacccauuuuaaaauaacucugauaguauugauaaaacugauaccaguaggauuagguggguuuuuuuguuuguuuguuuuuuuaagacaggaucucacucugguugcccaugcuggagugcaguggcaugaugaggacucacugcagccuugacuuccugggcucaggugauucucccaccucagccucccaaguagcugggacuacagccaugagcccagcuggucuugaacuccuagacuuaagcaaccugcucgccucagucucccaccgugcugggauuccaggccaauuagauguuuuaaauaaccuuuaaagcuauuuauucuaaucaugaguuuuaucaauguaaucuguuccugaaguacuuucacaggucugaugaaugcugcuuuuaaauaaagccagguuuuuugucacuaagaugcaucuuuacaaauaacaaucccuuuaucauucucuguacuuacaaagucuuugaugcuucccauauucauuuggauaacacuuuuuuuuuuuuuuuugagacagucucgcucugucaucgaggcuggagugcaguggugcgaucucagcucacugcaaccuccaccuccaggguucaagugauucagccuccugagaggcugggacuacaugugcacaccaccaugcccaguuaauuuuuguauuuuuaguagagaugggguuucaacauguuggccaggauggucucgaucucuugacuuugugauccgccugccucagccuccgaaaaugcugggauuacaggcaucagccacuggagauuuuuuuuuuuuuuuuuuggggacggagucucgcucugucgcccaggccggacugcaguggcgcuaucucggcucacugcaagcuccgccucccagguucacgccauucuccugccucagccuccugaguagcugggauuacaggcgccugccaccaugcccggcuaacuuuuuguauuuuuaguagagacgggguuucaccguguuagccaggauggucucgaucuccugaccucgugauccacccgccuuggccucccaaagugcugggauuacaggugugagccaccucgcccagccaacugaggcuuaauuucuaaucacucaacaaaggcagacauuuucuauauagcaaauauuucauauaauccuauuuuccccaaaaccuucacauguucccacagaaaaauacuucugaucuaaaacauaauaaaguuaaagguggcauuuuaaaaacuuaaaaaaaaacacauucaagaaaauauguaauuugcuccuuauagauacuuccauacaagcugucccaaaucuuccugaaacaucugcuguugaaagugguccuggccucaucugguaacacaccaccacaaccacgcacccagaacggcuggcagcauccuuuuuaucuuccggaguccaccaaaaugccagcuuuccuuuauuuuuauuucuucuuauguuuuagagacacgguuucacuaucgcacaggcuggagugcaguggcgugaucauagcucacugcagccuccaacuguugggcucaggcaauccuccugccucagccucccaaagugcugggacuaagggcgugagccaccacaccuggcccgccuucuuucuggaagccuucauccaaaccugcuauuuaggauaaaccauucuuucuucacuaccgucuaacaacaggcuaacaacuaccugcgccucaaccccugcccccacaccgccaccccuaccagcccaccccagcaaagucaaacuguaauugcagcagaagcaaaagagaaaaacagacacaucacaaaagggucuucccuaggcagcccauggaaaggcugaccaccuccccaacagcauggguggccaaagacucccauagcuggcucaagaaacagcauaagcagagugcaccagcagccagggccagggagcuaucucuggaguugcagcugccacagaagugagccaagccgacagucacccacaaugcacaacugaaccacccaaccaaccuccccaacacaaauaccacuuuuucccucucucucuuccacgagguccaccgccagacucuucuuagcucauucacugaagucaacuaccaaguuucugccucuggcuccuacugcuucuauuuuuuaaacaaaaucacccaugagaugcaagucugcaaauacgguagaagauuaggcauaacuucuacugauccccccagagccugggugaaccaguccacagcaggacaccccgaaggugcuaagggucccuauguccuacuuugcucuuucugacucagagcacacaagauaagccaaggauagauccaucccagucaugcaaugugaugacaggucuucuacguuggggcaccuuauuuuaccuuguagcugccauccacugcccauuauucaaauaucgcuuugcaggaaugcuauggaccguccauaauuaucagccugcauucaucuccccagugcauuuuuaugaauucacugccacaaccuaagauauauaacagagaagacacucucugcugcagaguacaaaauagcuauaagcuggcacaucuggacagccaggaacuaauaagcucucacagggcagaaugcuauccgucucgcccaacugaguugacaaggacuccaccaagcuauaaugugauacucuuaaauucaugaagacugaaagacucaagaaucuuaccuuuuccagaucaaaucaaagaguaacaagcaucagaacaaugacuauauuauauuuacaaugacuauauuauauuuacaaugaccuggaagaucuacaaucaaaugcaaaacagaugugucuggaaucucucugacauccuaacuaaucuaaugacaguuguacccuacgguaucaugaacauaaauaagcuauuuggccucugucagagguaguauugauguugugauaucaucauuagauugccagaaaauuaaauguagcucaagauaaacaauccaaaaggagaucauuaccuuguguaauaugauuuagagcuaaaagaggcccuugggaucacguuucaaccauuucauuguaaaaccauaaaaacuuucaguacaaaaugguuaagcaacugauuuaagaggcauaacucaaacccauuuccccucauuccuaauuuuguguucuuuccaccaaaccagagcaccuuaguagaaagguucaaaaucaagugugaacauaccucuuguuugguuuuugugguauaaccuuggacagauucucuugccaccaagcucuccagugcauccuggacugugcguaucuugucugacuggauauccaacugcaacgugaaaaauggcugcaaaguggcagauucuuuugaacucugcugguaaaccacagaccuaagaauugaaagcaaaaacaaaaaaauuaagagaccacuccuugccacuuucccuuaagauuaaccaagggaauaaacacugaaaauaagauuauucaauaucacuuucaaaagaccacagagaaaagccaaaaauauacugaauuuaaaaauaauucugcugaagaugugcuuuguuaaacagaugcuugaaggcagcaugcucguuaagagucaucaccaaucccugaucucaaguaaucagggacacaaacacugcggaaggccgcaggguccucugccuaggaaaaccagagaccuuuguucacuuguuugucugcugaccuucccuccacuauugucccaugacccugccaaaucccccucugugagaaacacccaagaauuaucaauaaaaaaauaaauuaaaaaaaauaauaauaauucugcugaauagcaccuccuuaguauuucuaacaacuaaaucuaccaguugauaaauguucccaacgccagugcucuggaagaaaacauauuucauuuuccaaauucuuucacuuccucuccacacuguuauuuacugcaccgguucauaaaggcagccacccugccauggccucaaaacgcugcugcuuuccauuuucuccaaguaucauagccuguucuaauaaaauagaggaaaucccaagguaaauagaggauuuuuaauggcauuuuccuccuauaaagaugucuuacaaaaagaagaaggggaguaggguguguagaauaaaaaacaaguuaacauuccaggaaaaaaggcugccacccuuccaagaagggcgccaauuugaccuuguuuucuuagcugguuuuucauuucauuuuuuuuuuccuuuuucuaaguuuuucugaguaaaaauuguguguucggcccaucucucauuuagccucagcaaggaaacauuccagggguucaacaagggcuucuauuucugcagucucggugaccuaguuucucaacggaauaaaauggguguggacagguacucaggcuuuccagaacagaugcggugaagagcucgcuaaaagcuuuucuguccaggguuuaauuacgcaucuccaugcuccuuuacaguuugaagacuucagugacaacaguuccccugguucuggagagggauacaguaguggggaaaccgcucaugagagcugguggagaaucaagaagcccucuugauucagugguccuguguuuuagcaaagguggcaccggggaagaaaggcggggaagucuuccuggggaaacugaaaaacaucugaagaggcugaguuuuagaaguaaaucuuucaauuggugugaauaaagaaucaugcuuaacaauggcugaaaagaaguuccuacguuguaagaauucccuaucuuugcuuuaccguuuuucaaaaagaaacaucaacaaccaauuucaacacagagaccccucagaggauguggcuagcagcugugacagagcuguucaaucugagccagcaaguccuccaaauggacgcugguauuuuccacugguuacucuuagacaaauuugggaucuuugaguaugcugacccucuguggccuugaaauucugauacccggccucugcacaaaaaccauguucccgaugccuccauuugagcuguccauucaucuuucucucccaucccgaggggguguccucacaauccuaaaccaggcugcugggcugaaggagcaaagggcacagccuucccucgcugcugcgcgccaaccuggaccucagcgucucccucccaacacgacgugucccaaggaaccacagacaguggucagggcuggguguuucccaggugacaacugaccacccagcugccguggacacuccacagagcaccagaauagaaaggggccaguggaauagagcucacagugcagaacacagaagugacuuguucaaggucacauggcugcucaacuggcuucuaaauccacuuccacagaggacgggaaaccagcuucugagggcgucagcgcagguuucugagguucuuauuauucaccuguugaaaguuguugauucagucucagaacugagacugaaucaagucuugaugccucaaaaggggugcucuuucuuucagguacgcagcauuugggacaacaacagacuaagagugucacugaaauaccagccuggggguuaugccgcaaggccucagaaaggaaauuaggcuccaaugaggccucuucaguacuuucgauggguaaaccuucuuggagaugguacaaguuuugcugaauuccacaucacagugguacugaaaagcucucagguaaauaaagaaaaaccuuuccgaaggacuuugugaaugagcaaaaagcugcuuaagggaacuggcacacagccaggugcccagggacuccagcccagucacgggucugucuguguaaaaaagaccucccuucacacucucuucacuuucuaccucaccugcuuccaaucaguucacaacagccaagacagggaaacaacugucuguggaugggccaauggauaaagaaacugugguguguauauauagacaagggaacacuauucagcuguaauaaagacccugccauuugccacaacaggaaugaaccuggggaacauuauacuaaguuaaagaagucagacacagaaagaaaaauauugcauggucucacuuauacauggaaucuuuauuaaaaaaaaaaaaaagacgaaacuacagagauagggaaaagagugguuccuagggguggcgagugggaauggaagaugucggucgaaggacaccaagggcagccacacaggcgaacaggucuagagaucugauguggaacaucggacaagagcuacucauagugcacuguauuugggacuuuugugaaaugaguaaaacugcagcugcucuugccaugugcacacacacacacacaaggguaacugugauggggaauauguuuaucugcuucacuguagcaacuauuuuacuaucucuauuucauaacaucuguguauacuuuaaauauacacaauuuauuaacauaaauaaaauuccuccagauacacugucuucucuuaccaaaacacaugguuugguuagcugguuuuuuuuuuugaagacagucuugcucugucacccaggcuggagugcagugguguaaucuuggcucacugcaaccucugccucccggaggugguuuuauguugcaaguuuuaaaugcagaugaagucuaauauauauauauauauuuuuuuuucucucucucucgugguuauuguuuaugaccuaucuuaugaaaccuuugccuaccccuaagucaugaugacauucuccuguaucuuuuucuuuuuuuuuucuugagacagagucucacucugucacccaugcuggagugcaauggcgcuaucugggccacugcaaccucugccuccuggguucaagcgauucuccugccucagccucccuaauagcugggauuacaggugccugucaccacaccugguugauuuuuguauuuuuaguagagacgggguuucaccauguugaucagguugaucucgaacuucuaaccucaggugauccacccgccuuggccucccaaaguccugggauuacaggcaugaaccaccgcguauggccaauuagcuggcuuuucucuuacucccuagcagugagcagcugaacuugacagaguagaagggaggagcucccuguccccugcagacaugcgccagcagggagagaauaagccacgggggcugacaagggaagcaucaggaagugcaagagaagagcaggcaggggagcaagaugcaaaccauuacguccaagaagucucaaaacaagccucacaccuucccccuucaccaacauggcaaaacccuagaaaaggcaaauauuaaguuauuccagaaaagcacaaaccugauguguccaccaaaaaugccggugauuggagucugaacaaaauccgccuggcgggugacggaagucuuguuccgggggcccacuuguucccauucauccucgcuuccuucaccuuguucuuccugcucuucuucauugaccgagugguuuuuggggccguuggaaaucguaaguucugaaaaggagagcaucugcuuacacuacuauuuacgacaagaacagcaaaaaaaaaaaaggcacagaucugucgauugcaguuuuaaaaaugaaaucaggguguggucuacauuaggagccacggcaaccaaucgcaacaggagcaacgucacuggauccacggccaaucgcaacaggcacaaugucacuggauccacggcaaccaaucgcaacaggugcaacgucacuggauccauggcaaccaaucccaacaggcacaacgucacuggauccacggcaaccaaucgcaacaggugcaacgucacuggauccacggcaaccaaucacaacaggcgcaaugccacuggauccacugcaacccauugcaaugccacuugauccacggcaaccaaucgcaacaggugcaccaccacuggauccuuguuuacauaaacuccuagaaaugacaucccugggacaacuggcgaaauuugaagaugcucugcaaagucgguauuaccgugucauuacaguuguuuuucucaguuagauaagggacugugguuacgcaggagaugcuuuagcaccugagaugaacuaaacuguuagcugcaacuuaacuuugaaucauucagggaaaauguaugcguauguauguauauauggauggacagauaagacauauauauauauacacaguguguguauagcaucagaaaauauguuuaaaacuguacacucggcaauuauaaagguauucaucaaacgauucuuucagcuuuuuuauaggcuugaucauuuuccuaauuaaaaguuaaaggaaaauggcagagguucgggauaaacuguaauuuaccuaaauauaaccuucucgaugguguaaguuaucguagggaauaaaugcuauuugaaaggaaaacgacugaggggcagggaagcaacauaacauaugaguaugcaacaccuguuuacagcgaacucuugcacaacucugcggcaaguggaccauaaccuacuuucauuacuuggugagagaagcuucuuuagguucaacauuuccucaugaaguccauuuagaaugaagccuaaguauuccucagcaucuucuugucgacccugaaaaggucaaauauaaucacguuacugugaacugaucacugucaaaggccugcaggacaugcaguacuugcaaaguccaaccaugccuccucugaaauggaagauguaaaguauuuccaaacaaugacaugaugacauggguuucccuugcauagcugaaaucccaagaguaggaggaaaaggagaaacugacuaaacacauaucucuaaauggguggacuaauggggauuuuuauuauuuauacuuucuguauuuuugaaauuuucuucaauaaauauacuuuuuuuuuuuuuugagacaaagucucauuccgucacccaggcuggagugcaguggugcaaucucagcucagugcaaccuccagcucccggguucaagcgauucuccugccucagccucccgaguagcugggacuccaggugugugccaccaugccuggcuaaucuuuguauuuuuaguagagacgggguuucaccaugucggccaggcuggucucaaacuccugaccucaggugaccugccugccuuggcuucccaaagugcugggauuacaggcaugagccaccacaccuggccacauuaccuuuaucacaaaaaaguuauuuaaaaaaaaguuucugucuuggguaaacaaaauagaagacgaagaacuagaugucuagggccaguucacuguucaacugcaagggucaccacucgagcaaugagcuaagcagcccuaugucugcuucugucugucuuugaugauggacaacuacaugggaaagaacucaaacuacauguggaaaaacuccacugauuuagagcguuagcuguguuacacauacaucagcaaaaucauucacagacgagucacccaagaguuuaauaaucccacaucacgaguguuugauucuguuacuuaucaucaguucauauuucauucuucacagcacaacugccuauuccaaggcccugcaaauuguucuguuugaagcaucuagguaaacugcaaaguuuacuugcccucuccagauaguagacguggacagcagcuguucacgugagugcaugcucugcacgugugcagaaaagggcaaaaacuggcacagccaaagugugcugaagacuuuucauagcaggccuggguggcucuccuuggaaaggccugcuugcaagguugccccuuggcuggugucugggaauuuggauuucagaaagguucccaucgguccaauaacugauacgggauucugccuaaaccguuugcgcaagcaaugugcuuucugcugaacacuuugcuuuuguuuugggaguuuggacuuuugguucaagccaggcagaugguaccuaugggaccagcccucaguaaaaacucuggacacggagucuguaaugaccuucccugguuggcagcauuucacguguggucacagucuggugcuggaguaguuacgcguagccuuguggccccacugggagaggagucuggaaguuuccuuuaggcccugccucaccuguccuuucccuuccugacucugcuccgcaugcuuuugcugucagcaaccauagccacggguauaccagcuucugcauuuucugaguucuuccagugaaucacccaaccucaggguggucuuggggagcccaacacauccccuauuaauguaaccuuuagaagaugcuuuuguucauagcauuaucucugugcacgauccaagagggguuccugagcacccacuuuauuuugccuccaccugugcuaggugggccccucuggguucuaaggcaucucuguaucuuugugcuucucuuguugacuauucauuaacucauucccucacugagggcagagggcgcacuucauuccauuucugcaucccuaacaccauguucccauuacuugggaagugcaaauuccaagccaauaccaaaagcugcauuauaagcauuuaaaaagcuuaagacccuaugcuaccccuggugguauccugcaacgaugcccucgacauucacucuucuucaaagcaaugaagcuucaaguaaacuugacuuaaauggcauuuucucaacuauuuuucucucugaauacauuucccuaagcaucauuucaacugcuuguacugauucaucacaaacucaaucugggaggaaagaaaugcuccaguuaacggugcuaagggcggcccaagucacucucaacagccccagggccuuuuauaagggcucccuggccccuuggucucaugccuuuaguaacaaaguaugugauuaaaaaaaaauuagguaaaggaaucaaguacaucaaauagcuacuaaagccuguaaguaugaugaagacauaagcucuucugaauacugccaucauuccaggcccagugcacuccauucuaccccaguggcauauagugcagugguuaagagaacugacuugaaagcuggguucugccauguacauuagcuaccugaccucagacaguggcuucacuucucuuaaccguaacaaggagaccauaaucauacuuuauucagagucaacuaaguuaauauauguaaaguacugagagcagugcuuggugcaccauaucauccaagcaauggacucuuauaaaccuacaucuacuuauagcgcuggagacagagggcaaauaucaauaagcaacaguuaccacacaaacacuggaacaaaaggcaacacuugauacuagugacaacagagaagucucaaaccuuuucagacaggcuugacuuguuaacugucaggagucuguaaauauaugugggcucaaaggcagcuccagggcgaauaucccucacgauuuuaucuccaagagcugcaauggaaagaggacacagguuuuccuaacuacaaugaacucauaaaugaugaaaaaagcaacaucaucaaaacucccccaccucccaccuggcugaauguugagaauggcauagguguaaagacacuaucuucccaacaagacugaauuuaccaaauuuaagucaucugucuccauaacucccaauauguaauagcaucaacaaaacucauuuuuacuaaccuugucgggguuuuggagguacuggcauauuagugaacucauucauuagccgaacacuaaacauggggaaaaaauguuaaauagugcaguuuuaaacaauauauacuuuuacuaaagagcuuugauggcuaaguagaauaucagcuauacgaguauaguagauuuuagguaaccaaugcuguaacagcuagugaacucaagucucuucuauaugcauuuuuggucuauuucaagugauauaugcugguaaacgcuaaaauauuuucuacugaaucuaaagaacacagaucaucaaugcuccaauuccauuucugguuaacuuccauauaaaaucgccaacagucuauuuuuaaaaaaagacagaauuauaggacucauuugcaggaaaucaagagcuuuacuaaacuauuucaauucuaauuaucagacgggaaaaaccccaccacuuaacacaucuuucaccaccuuacuuacaagcugucuaucauggguguugacguacaaggccuuugcacuuuggaauacagaggaaugaacuucaucaggugguacaucggcgggcaagcaaccaaugccugcagugucuauguaguggcaguaaggaagcguaaaggaaaugaacagacacaccacauuuccugaaggcacaugaagcacaagaauguuuauaaaaacacaaggaagcuaaggacguugaacuacuuagauaugucaccacgaaaaggaauaaaccaaauaguuacuaggguaaguguccugugauguccauauaaggaucuacgaagcagucagucguuuguauucaagaacuugaccuaaccaagacaguucaaucaguuaaaaccaaauuuccaguuguaagugguugcucugcccuauuauuugugacuauucuaaugagagccagcuugucugcagcccucauucacgugccaacauauccucucuuuuagagggagauggacuggggucaggaauaauccuguuuauaagcaagguaggcagaccaaguaauaaaccagacuuagggauucaaauggagagcuagauggcccacggaagcugagcuaagucacaugcacccaaaggagggacagcugcaacaagcuggccuugcggacggcguccaggaaggauacagcauuaauguagcaccaguucccuuuauugaucagcccacgggguugcaacgacacugguuuauggauuaggguuacauucuccagcaacucugaaagagugaagaagcauauuucagaaauugaugacaucuagugaagaacauucaaaucauuucacaugcucuacucugggacagcauuuaaaaucccuucaguaaaacacacagccaaagaaaaugcauacuguuaaggcuucauucaguucaacaucaaguacauuauucaauuagaacauuuuugaaacuaaucuuuucccucaaauagcaacauuuaaucuuccuggggggaacagaauuagggaacacaagaacuaccuauuuuaaugagaaacaaaaaaauguuaacacaguaucauuauuagagaauagauuugagagauacagccuuucuuccuuaaacaccauuagccaggugugucucaucagcagcaaggcgccucagacacuagauagaaagauaucuugcagaacccacgucucauuccucucugcauccccagcaucuaaugcugacccuacacaucacuguguguguucaauggcuguucagugaguaaaaauacuccuuucagagacagcggucuccuacaaauuaaaccguccacuagaaauccaauuuagcaacuguuuuauaaacuguaauucccuuauuccauuuacaaacacgcugcucagccucagguucacccugaguggacaucacucuuucuguguauuaaaacagcugugaaugccaucuuuauagaauuaaccaucagaaaugcuugaaaacaagacaaggucucccccugucccacuaugaaucuucuaauggugauggcuacaauuuauaaacccuucuacacuuagcacguucuuuacaauugacaaauguuaauuggcuggacuuaauccuuaguaaucuaggaguaccaccacuuugacccuuucaccaauaaggaaaaugaggcucccaaagacugacuaacucaccugugaucacacaggagccagguagcauagccagggccucaacuccauaaucugcagccaauccacacugucuccuuuacuuuuaaauuguauacuaaucauauaacccacaaauagauacaccuacuauguaccaacaaaaaucaaaaauucauuuaaaaauaaaguauaauaaauaaacaaauuguauauaggaaagaaaaaccaaaauggcauacauacauuugauaguagcauccaucuaaggcaucgcucaaaaauaagcuuuucuuuucuaaacuacauuguacuggcagaucccagacuucggcacuaaucaaaugaaaaaauuaauuuacaaaauucaaaacacacacacacacacacacacacacacacacacacacacacacccccaccccucucauucccuccuuccuaugaauaaauguccucuuccuucuaacugaagaagcguagggaauaauuucugcuagcucuucuucuguagaaaguaaaauauuacagauucuguggaaucuguuuaauuagacuaaguuugcaaagcuccucucucucuuaauauggaauaccgaacugggccuugaaauaaaugaauaauggaucaguuacgaacugaaccccaagccugcaugugaugacacccagcagagauagcaccugucaugugagggacacugugcuagaagcuuuguguauauuauucauaauuaucauaacccuacugucagagauaguuaccaaccccauuuuacagaugagaaaacugaggucacauaacagcugaaaugaccugugaaccuggguccaccugacucaagagguugagcccuuuccucaauauauaaggggcuucacuuaaaaaucccuuuuauuccaagguuucagauacuuacuuuuccccacaggcuuaaagucuauugacaguggauuuuuacauuugucuuuaaaccauaucaucacaacagucuaucauuucuagugugugccacagaacagcaacuaaugucauugcaguguuaaaaaggugcauuuucaaauaaccaucaaugacguaaaggcauagugucucaaaugaaaacuccagcaugauuccaacaaggcuuugccauaguauuuuuauaucaaaugacuuuuuuuuuuaaaccuaaccuuaagacucaaagccugcuaucuuucuaacauagaaaccuuuguuuuuuugagacaagucuugcucugucacccaggcuggagugcaguggugcaaucuuggcucacugcaaccucuguguccuggguucaagugauuuuccugccucagccucccauguagcugggauuacagacgugcaccaccacgcccggcuaauuuuuguauuuuuaggagagacaggauuucaccauguuggccaggcuggucuugaacuccugaguucaagugauccaccugccuuggucucccaaagugcuuggauuacaggcaugagccaugguguguggcugaaaccuuuguuaaauaacaugcugccuuucgcugaaggcgaguaaaccccugcugagcccugccuaggcaccggguaaggaaggcacagagaugaaugcaaggugguccugcccuaggcaagcucgcagaccagugaagggacgaacugugaugucccuggcuccaaacacacacuguacaggcuaagcugaagggguguugggagauggggggcgggggguggggaaggaugcuuagcccaauccaagggcugcagaaacucugggaaggucagggguugaagccaccaaauggaagcugaggaagaacagauauacuagaagguucucacugacuggggcagcagugcuauccaacuagaggaggaauacaacagaugagcagguuauuuuuuguuuagugugguaaugagcucaguuuuagagauguuaguaaaagauacccagaugacaccaguaaaucguauauguauauuaaaagaccagcaagugacugauuuuuuuuuuuuuuuuugagacagucucacucugccgcccaggcuggaaugcaguggcaccauccuagcucacuccaaccuccgccucugggucucaagcaauucuugugccucagccucccgaguagcugggacuacagaugugugccaccauacccaaucauaauuauuauuuuaaagacaggaucuugcucuauuacccaggcuggagugcaguggcgugauuaugccucacugcagccucgaccuccuggguucaacagauugauaaucacacaaacauacgcacagguccccagagugcagggcuggaaggguagagaagugagaagcacgcaggggcagcguguaggagugggggcagcguguaggagugaagacagcaagugcaggcugcucagccagaagccgggcugaggaaggagacaggaucaugggugcaaggagcuagggauccaggaagaugcagcgaaguuucugggugggagaaggagugaaacagcaacuucaguuuucuugacgauacggaaggaaaggucuucuagggcagaguuagggcgaagaugccagaggugggugagacggggcuugaacauguucauuccuguuuagcacugauacuggaaggaaaugaaagcagccaccagggccaggcauacaagaucugccugaaacuucccuucguuguugacccguucgaacagacucaaaaacacgcuuuaugacgaggcuaacuccacucuuaaaaggaaagcauugcacagccaucaagaacuggcugcacuaagcucugucugaaaacacagcuccuuuuuuuuuuuuucugggacaaagucuagagacaggguuuugccacauuggccaggcuggucucgaacuccuggccucaagcaauccgccugccuuggauucccaaagugcugggauuacaggugugagccacugugccuggccuccuuucauguucuuaacugaguuaggggcccagaauaaucugcauggccuggaggcuugaccauucaaucucuaugcaaucaaaggauacauaaaucaacuauaaaccgacuuuuuucccagcauuuauuugugagacagcaugaacuagucagacagaaaccuuuaguuucuacaucagccauucccuuaaaucgauaccagcuuccaguuugcuuauuuugaggcgcaggcagguuaaaaagcaguuucaguuuuucuugcacaguauuaaaaucaagucuucuagcaccacccagugguuuguucaauaacugcaaggaaccuacaaaagcgaacgagcacaaccucugcaacagcagaacauacguacgggcccuugggacguguacuaggaaauguacuccaccaagcuuuccuucaagccuuugacagucuuugaaaggccauucugguacgacgucguuaaacgcagaauaaaccuuuucagacuuggaaaauacagaagagacacgaacaaccuagauuuuucuuaaugauuauucuguuacuguagaaaaauuuuaucuaguggcaagucuuucauaaacuaaaauaccguaucauucuguuauuaaucucuuauaaugauccuaaauccuaaucucagaguaagaccgacagaaggcacucaagauucuccacacugucuccacaguagcugaccucaucacugccuaccugauauuagugcugugugccuccuucucuggacaggaggcuccuuaaagacaagacucucacacuucaacugcucaacaaaguccgcaccaucuaagguaacaggacuugguggccuuuuguguccucagccuguuacugccaucccuacuagcugcaugaggccuccccuccuugcuuucuccccucaacaccccucugccaaugaucacuucucccuacaaacagcugccaucuguuccuuucugaucuuaugccuuagacuacccugaaggcaaggccaaucauuacuccaacuagacagugcauggcauacaguaaguucucauuagacaguaauacaggaucaauuaaacaucuggagauuaaaguuguugguuacggcaaaugacuccacucauauuuguuagaaaugacucaacagacuuuaaaggucauuuagcuccugguccagaaagucuaaaugacagcuccugagaagacgcacaguaaagggcaagggcccaggcacacaaaccaggaagacggggguucgcgcccuggcucugccacuucauucauugugcggcagaucacuccgcaccuggaacagguaaggagcugcaccacgcucagcuauagcaaagaugagcacgcauguaaauacauaagcagaccacucccggcaugacggccagcucaauacagacaucagaauccccccuagaaaauaaagagcuaauagagguggaaggagaagggaaaagcaaaugaauuuaugugagagucugagaaaaccaacaacuuucagcaucccaagaggaaauguuagcccaacuuccuuaaaaucuugacaaguuuuaaacaucuugacauauuaaagauauauuaauaaaguucuauuucaggcaacacuuugggaggcuauggcaggaagaucacuugaguccaggaguuccaagaucagccugggccacacagugagacucuguugcuaugaaaaauaaaaaauaaaaaauaaaaaaauuagcuguacaugguggugccugccuauagucccaacuacucaggaagcuggggcaggaagaccaccugcgccugagagaucaaggcugcagugagcuaugaucaugccacagcacuccagccugaaugaaugagcaagacccuguuucuuaagaaaaaaaaaauacguuuuuaaaaaauaaagcuccauuuuaagaggaaugauuguaagaaaugaagauuaaauacuuauugucaaagauuuucucuuaagauccaaacacucaagaaacauuuaagguccacuuuuguaacaucucacacguacacuaagccuuccauccugacucauuucgauaaccaucaacuggaggagacacuaacgcuuuaugaaguucgugagcuccucuucuuccucgcagugaaaaaaacaggggugcaaaagcaguucuaauuccuccuaagaccagaccgaauuauguucaagugaaugaauccuauuguuaucaugcaaaagucaggucuuacggacaagccagaacuaauaccacuuccaaauuucuaauaucacucuucgcucuauuuaaauuccucuuucaacaucaacauuuucauuuacaauguuauuccuagccuaaaguccaauacgcauuccaauuauggaggcuaaaagaauaaaaaugaggaaggcgggccaccaaggauagagggcaggcaacuucuagguugaaacuugaccugcauuccaaagucauugccauugguguaucuauuuuaccuucuuuaagggcauauaauagaaguuggcucuaauaacaaacuuuccccagaagccuucuuuucaauucaucaugguugguauaauuuacuacuuaacuguucagacagcaacuuuaggaagauggccucccccaguccaucuuugucacaggaguugguggggcugccuagaacaaugugugagaaaaggcacaaaaugccagaaugacucauaaaagacacaaaauugaaaccuguaguucacuuuuguaauaacucacaugaaaaggcugaacugaaauuucacucuuaugaaaucugcugacauacagaaaaauggaguugcuuaauagccuuuuuucaaauuuuaagacauacaugcuagaugguagcucacaagggcugccacaaaucagcccacugaaauuguuuaucaacucaaaggcaauaccagcaucguaaacuuuuaugucaucauaagcuaugauuauucuuacacauauuuuacacaucaaauucuguuuuccuaaaauuaggacuuaggggucauauuaacauugaaaaucccugaaaaugcaagguacagaacucugauucuuagggcucaauaacuggcccguaaucgacauucugguguuguugaccugcuuuucugucaucauucuaacuguccagaacauucuccaagugcuuuucuuuuccucauuaccaucaauuuggaagaacacacacuaucuugguuaucuaaccagguggaggacagcaaagugaccaaaauguaccacuacccauugacuacagaucaacuuauguuucugaaguggaaagauguauaauaaaugugaggcuacaaacaucgaaucagauguggacuaaacucucaguccacaaggguggaucccgguaaacaggugccacgccuuuuuaacuuagaucacgccgcaugaccacugccuguguacuucagaguuugaagaggaagugcaaaauaucugagaaaccauuucccccaaggagcggggggaaauauaugcaugauuuauaaacugccaaaauaaagaucaguuuuaggauacacagccaugcuuaaugauggggauauguucugagaaauguggcauuaggcaauuuugucauugugggaucacaugccuagaugguauagccaacuacacaccugggccauaugcuagagccuauugcuccuaagcuacaaacccguacagcauguuguguacugaauaccguaggcaacuguaacacaacucacuggucacuagaaauuguuuagcuccauuauaaucuuaugggaccacugucguacaugcggucuguuguugacugaaacaucauuaaagcagcacauaacuguauguucauuuacacuuaaauaaacacggacaggguaauucauuagagaagacccaaauuguaauaacuuuguuucuugauccaaugccuuuuagguauaaaaccacugugaaaaaucauauaaacagguuuugacuaacaauucauaauaaaugacauugcuagauaccucaacgcaauguuuucagagcuguucaagagcucaguuuuccuaguucucucucacuggaauuuuaacuuaucgggcaguuggccacucuucuuacccagcauuauuuauauucuguuaaaacaaaauauacuguugcauaauuuugaaagcaaaacaucaaauacaaaauggcucuauuugugaugugaaagcaucugauacaauuucgucuaguauaugaggaauguuccuuaguaaagacccaggaaaaguacaauguucaaugaaagcauacguucaauuucaaacgucacauguucgucaacuccaaaguaucugugcuaaugagggaagcagcagcaaaggcacuccccacgugucugccauacucacucuuaacaagggugucgcguuuugcaacuacuuucaaacacaagcuauuaaguuuuggguuuuuuuuuuuuuuuuugagacagucucacucuguggcccaggcuggagugcaguggcacgaucugggcucacugaaccuccaccuccccgguucaagcuauucuccugacacagccuccucaguagcuaggauuacagccaugagccaccacguccaucuaauuuuuuuauuuuuaguaaagaugggauuucccuauguuggccaggcuggucuugaacuccuggccucaagggauccacccaccucaaccuccgaaagugcugggauuacaggcgugagccacugugccgggcuguauuaaguuuccuuuuguugacuccuacugauaaauggcaaccaucuccucucagaccagucacugaaacacagaucccucuccaacccucggcaagacagggcuuuuguguuuagauacauccuucccuuggggcuaaaggaaaucacugaguauucaguucacacgcucuccccuggcguguccuucuccuuucaaauaacaguucacacuugaaaaacagccaauggaacaaaauguugacacauaaccuacaccgaggagauggccuugccaccaagaagguccaaguagaacccguuaaaguggauaguuuaagaguaaucaagaguuuaauguauuucacuucaaaaucccuuauacgugauucuuuuaguccaucugccuucuuaauuucacuucugauggcauaaaaacuagcuggcauuuauuaagcagacuuaacaauaggggaaauaguccagaaaugugaguauuugaaacaaacuugagauaaaaaauacacaaauuauuccaagcauuuuguguguguauaauuuuuuuuuuuuuuaaagauggggucucaguauguugcccaggcuggccucgaacucccgggcucaaguuaucgagccucaagccucaaucuccacacuaucaugccuggcagaaaggaauacauuuaaugucuaaaucauucccuacucccucuuucccaaaaguuaauaacacaaauaccacugucucaguagaaacaguuagauacuaaugcaagucaaacucuauuauaacccacaucaacagaucuuuuaaugaaacuagacuuucacucaguuaaacgcugcuuaaaauaagugggccuacacuuaaaagugugcccacuaaagggaauuugugguaguggaucugacuuguaacaaacugaguauguuuuaccacuuuuauaaaguaaaucccuaaguaggagaauaaaacaacaaaaaaaauuucaaacaaugccauucucccuaagcccuauaugaucccaaggguuauucaaugugacucuauugcucuacuaucucacgagacuccugaaacugucaacaacuacguucugucuaucgaagccucaacaaacaggcugaaaagaauuauauauuuuuaaagaaacuacacuuuugcucagaaaauuaaaacaucuucauaacugaccuaaccaaauaggauuaaaaaaauaaucuguuugguagggguuuacaauauguccacacaaaaauaauuacguggacuguguguggcaaggcuuuccucuacuaccagucauuaagaggcccuuacuuucaguguuugacaaagcuacuucaauuagacuuuaacauauacagaacauaacaaacuauuuaucaaacuauauuuaaagucauaugacuaaguagaauguucuaaaacauuuuaaaugaagcuuuucuugguuauuuuaaauaaagauagagaaaaucucccuaagaugggagguuuuccuuuguggagcaauuuuagaaacgaaacuauaauauucucagcugggcgcgguggcucacgccuguaaucucagcacuuugagaggcugaggcaggaggaucacuugaggucaggagcucaagaccagccuggccaacauggugaaacucggucucuacuaaaaauacaaaaauuagccuggcguggugccaggcaccuguagucccagcuacuagggaggcugaggcaggagaauugccugaacccaggaggagaagguugcagugagccgagauugcgccacugcauuccggccugggcgacagagugagacccccucucaaaaauaaagaaaagaaaauaaaauucucaugacuucgaacuuagaaugcacauuuuuaacaggaccccaccaugcauuucucauuauagguuaaaaauaaacuuuuaacuuaguaaucuauauaaaggcuuacacaaucuaucuuuuuuuuuuuuuuuuuuuuuuuugagauggagucuggcucugucgcccaggcuggagugcacuggcgccaucucggcucacugcaagcuccgccucccagguucacgccauucuccugucucagccuccugaguagcugggacuacaggcgcccgccaccacgccuggcugauuuuuagguuuuuuuuaguagagacgggguuucaccguguuagccaggauggucucgaucuccugaccuugucauccaccuacaguaucaguccuugcaauaaauacauucugaaagcuguauucaagaaaucgccuggccugagugcgguggcccacaccuggaaucccaacacuuugggaggcugaagcgagcagaucacuugaggucaggaguuugaggccagccugggcagcauggugaaaccccauuucuacuaaaaauacaaaaaaagauagccagacauuguggcaugugccuguaaucccagcuacuugggaggccgaggcaggagaaucacuugaacccaggaggcggagguuguagugagccaagaucgugccuccugcacuacagccugagcaacagagugagacugcaucucaaaaaaaaaaaaaaaaaaaaaaaaaaucaccuggcuuuaaaaaauauauaugaagcccaaaauaacgacgucuggccuaucauuugcucauuuaagagaacuucagaacaacaagaguaccugagauaauguauuuuguauaaggaauaaaauacucuuaaaaauauauauacauugcuugcuaucacccuauugccacccaaagaauguguuuuauuuuuuacacaauucugaccauccaucgaagggugugcauuuggcagcuugcugcuacauccugguaaugaagggugucagguguuccaaaaggucacaucagaaaguauuacagaaagccuaaaccaaacagcuuauuuuaacuuggcuacuagggugacaaucugaagaucuggucaccaggcuugguggaauccaaccugaugacacagcuucugcuucuuagguacguacagucacgcgcggcguaacauuucggucaacaaugagccgcacguaugauggucccacaagauucuaguggaacugaaacguccugccgccuaguggcgucuugaugcuccugacccugugcaggcccaggcuaauguuugugucuuacuuuuuaaguuuaaaaaguuaaaaacaauuuuuaauaugaaaaagcuuauaggaaaguaagaauaaaaaggaagaaaauauuuuuguauagcuguaguguguguuuuaagcuaaauguucucaugaaagagucaaaaaguuuagaauuuuuaauuuaaaaguaaaauaaaacguaaaaaaguuacaguagguuaagguuaauuucuuauugaggaaaaauuuguaaaucaacguaguacagccuaaguguugacuguuuauaaaacucggcuuugcucaguacuguccugggccuucacauucacucagcacucaucacugacccauccagagccacuccagucuugcaagcuccauucacggugagugcucuauacaggugaagcacuuuucauccuuuauaccauaucuguacuauauuuuuucuaugucuaaauguguucaggcacacaaauacuuagcacuguguuacaacugccuacaguauucaguaguaacacgcuggacagguuugcagcccgggaguaauaggcugcaccaccagccuaaggcucuaccaccuguauuuguguaguacucucugauguuaacacgcacaucucggaacacauauccaucuuaguuaagcaacacguggcuaugugaggacacauaccucuuucauacccugcugcauuucugacuuccuacuguaacuuuuuaaaaacaaucugugaauuaugcagcuuucuauuuuuauugugaauuguuucuacuuuggagccuuagcacucuaaaauaaaacauuaacuuugggcugaacccuuaacauuuuuuuucucuucaagagcugaccuugguguaucaaaauucugaauaaaauccauuuacucaauccaaaaaaaaaaaaccauguuauuucacaaaaugauuucuuguaucuuaagaaauauaaaaaaggagcacacagugaguacaaaucaggauuaucauaccaaagguauaucacagaaaaaguccauuauacauucauaccguggagcagaauuacuugaacaaaaggcaagaaauggaaauguaacuugucaacagaaaagaacugcuaacagacauggaucuuucacuuaacauaaaguuacgacaacccucuccucccauuuguuucuauauuaucuuacuuuuagagaacauuuaagacauaggcauccuucagacguugcuauuaacacacagguaaucugccauuguuauggguaacaccacagucuauaagcccaguugaugaggucugcucccaucuucacucuagauuuguaucuuuucaacuauaccugcaaucuuuauggcuacaggauccucugaaaccggaacaagcccuucuuugacuucaaccugcuuuucagaaaccaggggagauauggcgggaggggaauacuuaguuuccacauaggccaccggcgaggaggaagagggcuuagaaucaugaaagaggcuggcccaggacuugggcuggcugacaggaagggugccugaugcagagcccgugccgucagcaggaggugaugcacucucggguuugguuggguccaagucuaugcuuuccguggugugcaacuccaccccguugguagcugugcccucacccgaggauucaaguauuuguccauuagcaacuccaagguuuucaguaguaucgguaccaacgcagggcugagccccagcuguccuugacagggugucucugccagccucugcagggaagcaggacugaccaaaaucagccccggggccccccucuggcugcccugcaguccuggugucacugccgagugcuccggggaaaggacugucaggcacaaugucacugacagagucuguggaguucugggggcuguuacaaguccugggcguaacugacgggggcaugucacccauaaauucugcauccucugcacugacacuguucgggacugcugaauuggcauggccauugaccagggcuucuguggagauacuaucaucgccaccaucuuucaaauagcuguaauauccagguggccgcuuuuucuucuuuuuacgcucccuuuguccaagaccaccugagacaccaucauuuuccaaaacuuccgccuccacauuagaacuuccauccaaagcgagggcagagccuggguacuggcagucgauggagccauagcuugcuucuuuagugauaccaucagggguuauuuuggaagcuguacaaccgagaauaaauucaggggccugaggguucagugugcuugaaauacuguagcuggggguucucggcaaagugucacuggguucaaugacuucaucgacaccaaacucaauucucugauauucuuguccuguuuagaaagaaaacuauuaguuaagaacccaguucuacaaacucuaaguaccaguaauuacucacuuucucuuugaaaauaaaaaccuuaaguucucuuccuaaucaacaaaucuauuacguccuuuacuuacgcugaacaauuugcggaaaaugaaacaacuauaaaauuauuauuuaauuuggggauaugaaaagcagaagccuguacuuaucuuucuagcuaaggaaggcuuucagaagguagaaauuaaaauaaauuuguaauaaaaagcaaguaauauuuugccaauuuuaaaaauaccccccaguggaaucugacuuucuuauagcugccuuaugccugagauaaaggaauauguauuuuggacaacuuaaauuuuaaaagaucaugacaacuaacuuagggacuuaaaacaugguuaaaucagcuucuguaguuaacgugauuugauuaauuccaaaaacaugaacuacgcaaagaauccuauacauacuggauaggagaaauuagaaaguauaaauuuaaaaacaaaaaaaaaagaugucaaaaaaagauucaacaacaacaacaacaacaacaaagaauccuauauauaaaagcgcacuucagagcacucuucugaauucucuaucucuuggucuccuccgcugguaaccuucaauuaagucugaaaaauggcccugacaugaacacaugcaaacguccucuaaauaaauucacacuggauuaaccccaugggugguaaagccuuccaaaaauaccaaaagaaaaaguuagaauugugaacuuuuaaauaucucuugggaagccuucaauacuuccuucccaguuaaccacaauccacauaauucauuccugcuaagacagacguauuuuuauaguuuacaccucugaaaucagguuaaguuuuagaaucaauugugucuuucaacagaaaucaagcaucaaugucaccuuauauuugauaaaaaguuacacauuuugaaguuaagggaaggacacaugccuuauauuucaucuuuaaugcaugaagauuucuuccaggcuagcauuaaggggccaauuuuuuuuucaaggcaucuaucuuaagaaaagaaacuaauacccaaagaacgguguucuacugcggagaacugaauauauuuuaccuugaaaggaccccuagaaaucuuuuuguagaagaaaaaauacagacgcugagaggggccaguuacgugcaagugagugugcaggaggcuggagcuacacagccucccgaggccuccugaaucuucguaugcuuuagaaucacagcccccgacuguggggggugaagggugguggcagcacaauccugccccaacaagagaaaguuccuggaaaagaacacugaugacgauuacaccuaacagcaaguuuaugcaugaagucacgaccaucuaauuccuuuggcuacuauuuauuuuuuguuuccuuacuuugaaaagaauaucaaggggaaaugaauuuauuaucauauguaggggcuggcuguucauuuugguuccauacauccccuauucccugauguucuggggccgucaaggcuccccagauugaaacgggugugccuggggcggaaggcuccauguggagccugcccuuugaaggcugugaaaucacauuagaaacuagaacguguugugucauucagcuuaugcaagacugauuauuucuaagacacagaugugcuguacacaucucaauucucaaucuuaucagaacauaaaacauucuagaaugugauguaacgugaacagaaccauuucaguauguuauaauuaguaucaaacauuuacucaauaccauguuugaucaucucacuagaaggcagauuccuagccagcacaguuccucuucuuauggaggaacacucacaauggacgccaugugccuugcaccgcauggcagagagcucagagcccaaugugccaggcagacgaagugcaggacggccugcacgcuuggcuucaacaacccaaucaauacauuaggaagauggaaacucaauacucagguaaugcaggcagaggcucuuaaaaccacgaauccuaacacagcauuucuccaaggcugcucacugcaguacaugcaguagagaggacuggacuacaaggcagggggcgagggagggaaauauacagagauuagugacacaagggcccugcucagagaguucacauuuauuagggagacaaauacaaacaacugagaaugaaaacauggagggaggggagagaaagcugugaauagcuuuagaaaaaggauucuucuggaugcaggaaacagugaucaacuucuaucagaaacuagagaggucaguggaacuugauggaucacugaauugcuaagggcagggugaaggagugguaucucaagcuuuaggaacaucuaaaacaggcagugcuugaggugaaggacaaccauucaccuugaugugauuauuacuuguuguaugccuguaugaaaauaucucauguaccccauacauauauacaccuauuauguaccuacaaaaauuaaaauauaaaaaaauuaaaaaacacaaaaauagaaaaggccgagaucuaaaagggaagccacgaugaggugccucugcaaagggcuugcugcagcuggagguagugggagggagcagaauaaagcauccuaaaccauucauccaacaaauguacugagggcuuacaacauuccagauacuacaggcgcagugacagacacagagaaauggauccugccaucagcagcugagcaggcuggaaagagaggcagguccaugacagugcccacaggcucuguacagucgaacaggcacuggaagagaaacuaaugucauggaaacacaagauacccagaaaggcugcagagaaaagcaggccugucacuaacugugcaaacugguggcaagauuccagucguguuuuuggcagaaaaaaggcaggacuuagagggaacagaguaaagaauggagaaaaagggccaagaagcagucacugaaaagggcaggcaggcuggaaggagggagggggaagcagaacuccagaggcugggggagcugguggugcccacugcacagggaggagggugaacucaaagaagugaugugcaugggaacaucauggggcauuuguaagcacugguucaacaugagcagcaugcucaccacgugcaaagcacacagugacagaggaagucccacugacucagaugucugagagguugacaucagccaauuaaaagguggcucaggaggcugagcagcccggcuucccggucccucaagcuucauucauuuuauuacuuguccuaagcuauuguuagaucugcucuuucccuuauggucucccacauuucuuauaaaucuaaaauuuuagauauaaucacucccugauguuacuggagauaaaacguuugguuagucuuuucaaggcuucuauugaagccuaaauuguaauuaaaaccccuuucauaagucugaccaugcuaacugaacagggaauccaaaccucuaacucucaaagaaaaaguuuggcaucaguuuccuggaggccaguaagggccuuuaaagugauucagauugaaaaaugaucucgacaaguuugaauugugcaagggcagccugcaaucaauaauuaaacaaccuuguugguauuccaacgcuggguacuuaagcaauacaaaaucauugcaucuccauaagcaccaucucuggcaaucagcuuagugccugugauggagacccaaaaaaguaacagaccaggaggugaagaguugaccugaguucccaagagucagcgacagaccaggacaugaaugugaacugcaagaacaacagaugccagcugccccuuaguuuacaaagaacacaggcucagaagcuagcuggcgcuggagccagcaggcugcuuagcaacaagacccaaaguucgcuucaacuccagcaugugcugaugaagaguaacauaccuguugcacucagaacuguuaggaaaaaaagaacucaacaaccauuuccuaaacuaaaucuuacauggcuggcacuccgaagcacaggauacgcuuuaaaaccaauucacuagucaaagugauucagcaauuaaauacauuacaguuuacagcaaaaacuucaagcuacaaagaaauguuuauucaaaugggaaacaauguuuacagguagccugcccacccagcacguauggccaaauucccuucagggaaauaaggagagaacuagcuuaccaucagguaguuuauccacagccugugugccacacagaacuguuccacuguauggaggaagcugcacaaggaaucagaaaacaaauuuuaauucaacaaaauguuaaaaccaacgcuuaccauuuaauuaaggcaacaauucauuaaaacucuuaauccauacaacuuugcaugccguuacuucuagcagaauaacauacaugaagagucagugcaaucuaaaucaucuucauuuaacgaaaaaaacacaauagaaaugcuuucaaauauuuaucacuauuaaacagauccgaaaaugaagccaaaaggaauaaaaaugaacuccaauggacauguaaaucagcuacaaugaaaugcuuaugauacauccuucuuuccacaggaugucagugacugaccauccagaccacagacacuuuuguuugugcacuagcgaagaugacucuuccugacugcaccucuuauucacgaucacuacauugcaacacagccaguagaggcugggaccagguccauggucggagagcagaggaaagcgcacuauaaacaaaaagccuggugacugcagcucccuuuuuaacacagugccuuaauuaacuacauuaacagcuagaagucacauuccuuguuuggcagacagaaagcagaaugggaacugucugacuucuuuguaaaaagcugaaagguuaucucaaaaauaacuuaaauuuuucuucuuccuagcuauuccauaacauuuauuuaagaguuggaaaugcuuccaauggacacauuggguguaagaaaguuuaggaaggggcagggcaugguggcucaugccuguaaucccagcaaugagggaggcugaggugggugaaucacuugaggucaggaguucuagaccagucuggccaacauggugaaaccccaucucuacuaaaaauacaaaaaaucagcugggcgugguggcaggcaccuguaaucccagcuacuugggaggcuaaggcaggagaaucguuugaaccugggggauggagguugcagugagccgagaucgcgccacugcacuccagccugggcaauagagcaagacuuugucucaaaaaccaaaacaaaacaaaacaaaaaaaaaacaaacccugucucuacuaaaaaauacaaaaaauuagccgggcaugguggugggugccuguagucccagcuacucaggaggcugaggcaggagaauggcgugaacccgggaggcggagcuugcagugagccgagauagugccacugcacuccagccugggcaacagcacaagacucugucucaaaaaaaaaaaaaagguuuaggaagaaaagggguaagguaagcagagagauaaacugcuaccugagggcagaacaaaagaacaaaaagacauucuggugcagcacuucccaaagucuguucacugcaguacaaaggccagugcaggaacggcccuagggccgcaaaguucagaggcuccuagguaagucucaugcccaauacuguaugagagcugcugcuugauuggcuuccucagcugaguucuccaaugagaucucagcacaccaauucaauaaucacagcaauaaaagcuucucucugcuaguaacgcaguaaguucucuucccagagaauuaugacaaacaggaaaacacagggcaauucaaaagaagccaacaccuucaggaguugacagcugcacuuaucuccaccaccagggggcaaccuaguacgcaucacguugacacccagaagaaagcauucuguaugcugagaugggcuacacuagccuuggcacccgcaaggcaaagaccauuccacacaccagcauugaugcuggcaggcaccuggagcagagaggugggucuauaagggcaguggacacagcggccaugugugucucaggaagccuccaucucguucaaaacccucuguggucaaagaagacaguuuagaaacugauacauagaaugcccucuuuuucuguuaaugacacuaggaugcccccuggugacagaaagcuguguuauuuugaggcaugaaaaguguuuugaaucacucuauuuuuacacaaaauuuauuguaacaucaagaaaucaucuuuuucugagucaaaacaguuucaucacuauuauaucaauguucucuucacacuucccaguauucuguucugcucggggaagagagaaugcugaaggaaaccuccagacccgagagacugcagcaggcugggaagacgcacaauucagagaagggaccucuucacccauccacuucacaaggcagagagcuguuagaacccugcucaccaucuuccggcuguccccuuccucaacauucaaccacggggugugaacacucacucaacucccagccacucccacaacaugcagaagaaaaccccagcaaucgggaaaaauacacagaugacgcugaggacaagccaaguggagaggcggggccgguaaugccagguggcgcugacugaggguggagaggcuggaaaggcuggaccagugacaccagguggcacugacugggcacucagggugugccaggcacacauccugcuccucaacaacucuggggaggagguccuguuacuguggcccucugacagaugaggaagccaggcgacacugccagcuucagaugaggaagccaggugacagugccagcaggugacacugccaguaagaggcacagcagggaucuggugagacgaccaccagcaaacucccagaugacacugccaccuucaguaagcaugcucaacacacuuacuuugauuugcuaagcugauaaaagagcgcaccugcaggaaugccagauggguuguggcacuguggaaauguguguguuuuauuccacaggcacacagcaccuuucauucagcaaaccucccucacacaucagaugcacuuagucugugguaacuggguaucuaaauacacaacagaauaaaagugccaggaugguucgaaguucacucauuaacuauauaacuauuuguaagaauacaaaguucaaaaaucaaagcaaagacauaaaauucccuagacaaaugcaaagugagcaagggaaaaaacugucaucuauuaauaguuaugcuaaacgcacagugugaaaacagugcugcggccuugugaaaaggauaccugggcccguggcuauaggaaggucauguucugaagucucccucugggcuaccuguguguucugcuuuccgucucaaagacucuccugaaccacaaagcccuccuuuaaaaucccauuaagauaccaaauuaggccgggcgugguggcucacgccuguaaucccagcacuuugggaagccgaggcgggcagaccacgaggucaggagaucaagaccauccuggcuaacccggugaaaccccgccucuacuaaaaccacaaaaaauuagccgggcgagguggcggacgccuguagucccagcuacucgggaggcugaggcaggagaauggugugaacccgggaggcggagcuugcagugagccgagaucacgccccugcaguccagccugggcgagagagcgagacucccucucaaaaaagaaaacacaccaaauuaagaacugucucuacucucuacucuccaugaguacccacacacacccacaccacacacacugcccacugccaacacuaugucaucgggggcuuauugacucagucaugguugggaugugugcuacuuccaaagcugagauucuggaaacuaaagaauggugagcauuuucucuuucuuucugaacauaaauaacaggauuacgacugagguuuaaacaugcuuauuaaauaaggugacugcauuuuuuccacuggagaaaauaauuuuuaaaucacuggagcacaacucuagaaaagaugccagcuaccuuucaccugaauucguuucuccugaugccacuaaauuacuagccaccuuaucuugccaguggcaagcugccaagcaagcaaacuaaaagacaaagcagcccuccgcuggcaggaggcgcuucugcaggaaggcagaaugcucuuucaucuuaacaucccacauuucuuaauuuugguuuuucaauucauggccccaaguagagaaaacaauauuuuaucaagcuccuaacaacggagaaaaagcauaugaaaaauucgacuagauuguaacucaugccacagccacaugguagaaacacugcauguuugagcggcaauuauguuaccugagagauaaaaggccaaacugugcuguagaagugacacgcccuccccucgccacucacacacccacagguccaagugacacgcccucgccacucacacacccacagguccaagugacacgcccucgccacucacacacccacagguccaagugacacgcccucgccacucacacacccacaggcccaaccacaugccgccccaugaaagugaguuccuguguaaucaugugcuauuauaauucagauuccugaagauuggggaaaacaacuccauccgauuauguuaauuagccugcauuucccuuuugcagguuacugugauuuugauaaacucuuuuuauaccccuccaaacuucaccguauguuaaaaaauaagaaaaacagaaaagcccaaauaagcccacacacacuacgaguucugaagcuugagcucauuuucaugagacacagucacgucuucugugaauaaaagguuuggcauaacuuaccaucuguacccuuuucauccauuucuacuaacaucuguuacucacuaguuaucggaccauacauuagcugauuucccaacauuucugugacgugaauaagcauucugcauuuuuucaauuuaaaaaacaaaagaaagagaaaagaaaugggaggcccaaaaggaaagaacgugcccaaacccuccgagccuguggaaguggcagaacugaagcgaccccaggccuucagacuugaaauacggugcacuuuucacuuuccuaucacaugaaaacucaaguuuuugucuacucacuugcaaacagguacccacccauccacauguguacacacuugagaaaaccuguagcaacuaaaacguaugguuacaucagugugaugugggaaaaaauacaaaauccccuuacuuaaaaacacacacaccacacacacacacacacacacacacacacacacacacacaccacccgggccuggcagcacacaccuguaaucccagcuauucaggggcugaagcaugagaaccccccugaggcggggcggggggucaaaguugcagugaauugugauugcacucugcacuccagccugggcagagugagacccugucucgaaaaaaagaaaagaaaagaaaaaauagaaauaaaaaaauaaaauaaaacgugugguguuuauacagagauaagcaauaggcccacagaauagcacacucggaaccaggggagaugcacugcccaacggggcugacaggacagcuaagggccgaguucccaaugaauggugaggaggcaccugccagggccacaggggcagggaguucgaugccaccucacacauauacaaaauucagugccucaauuucagcuuauuacacacugaagcgugaaaacaaaaucugaaaacuuuuagaagaaaacagacaaauaucuucguuaucuaaaggaugggaagaauuuccuaaagauauuuuuaaaacuaaaaauccacaaacuauaaggaaaaaaaaaucaauucaguugacauuaaaguugaaaguguacuccucuuauccaacaacaacaacaaaaaaacccaaccccaaaaaggguucaccuaacaugugaagcuuaaagcccucaugcuaggaacagaugccuguaaaaccaaagauuaauccuaaaaucaguaagaaaaagacaagcuacuugauuuaaaaauauggacaagggauauaaaccaaguaauucacagcagaggacauccguauugccagcagacgugaagagaaugaaauaguacccagcuguuuguaaucugggagauguaaauuaaaacaaugagaguccauuuacuacacacaucagauucacaaaauuuuaaauaugccaacaccaagaguuagcaagauuuuuuuuuuaauacgagcaagaaaacucccaugcacugcugaugggaaugaagacuguuaaaauccuagauagcaaacgagcagucucuagugaaacuaaagaggcucgguccacagaacccaguaauuccauucccaggucugugucccggaggagcccacagaggggcaccaggagacaugauaaaauacauugagugcaauauuuuuaacggcugaacuagagaccuaaauggcccucgacaggaaaauauguaaguaaauugcaguguguucaaucagugguacugagcacuggaaaucaaagaacaaggacaaauuucuuagcauaaagaauacaacguuagcuuaaaauaaacgacaaacugaauauaguauaccauuuacgugacacuuuaaagcacauaaaacacuacgauugacuauggugauauacacguauaugauaaaaggugaaaaccagucaggaccaauauuucccaauuucagcagaguaguuacuucuggggagagaugggagagagguccaaaggaggcuucaguugcaucuguaauguuuuauuugcuuuucaaagccuaauaaaguaaauacagcaaaaugucaaaucaaaugucagucaaaucuaguugguggguugaggcauuucucauauuagucuccauacuuuucucuacauuggaauucuuuauuuaaaaaaacaaauuaaaauagaaacauaacuauuaauuguaucuacccacggacucacuaaaacaaaguuuugucuuaccucaacugaagaucgaggagucacaaagaauugauugaauucaucagggcuaaaaucuccaaaaauauacugaaaaaaaauaagagagucacugaucacauaaaauauacaaauuauauacuuucagaaaaaaugcuacauauuuuaacaauccuaugcaacauuugggccauaacccccaagauccuuucucaauuaaacagaggaucugcaacucagaguucuagguuguuuauauaaaagaaauacuacugaaccuuuccuacaaauugucaaagaacacuaugaaacugauaaagcuuauuuugaaacaaaucaauuuuguaugccaaacuugucgaguccugcuugcaggagauuuuuauugguucacaaauacugccaguuguuccauuuaccuuucugcugacucaugccacuaccuccauuuccgcuuucucugccaaacauacuaaagaaaagcagaaaacgugguucaaaugggaagacaaggaaauccaaaaaaggaaaauguuaaugauccugauuaaugaucuuuaaaaauaucuauauaacuucuuaguuuaaaaaugcauuuccauaggauacacagauacacauauuaucagacagacacagcccuuguugcaagccugauuucacggaauucagaaugugauuuucuggaaaacgaagugguuaaacugcacggaugugagucuggcaagugccuaccaguucauauucuccauggagcuucaagaaacaagucauugaggccuggcgcaguagcucacgccuauaaucccagcacucugggaggcugacaugggcgaaucacuuaaggucaggaauucgagaccagccuggccaacauggugaaacccccaucuuuacuaaaaauacaaaaauuagccaggcgugguggcguguaccuguagucccggcugcucgggaggcugagccaggagaauugcuugaaccagggaggccgagguugcagugagcugagaucgcgccaccgcaccccagccggggcgacagagccagacuccaucucaaaaagaaaaaaaaaaaaaagaagaagaagaagucauugagaagaauuagcaauuuccacaacggagaagcaaugauucauucauuuaaucaauaauuauuuagaaccuacaaaugcccacguaugaucaguacuggguauaaaaaugguaagcagagugugguuccucuguucuaauggaacuaaacagucuaguagcuuccagggaaauuuacaagccaagugauucaaaaauaaccaguaacuaaauauuacauaaaugaauaauacucauuauuauuguaaaugugaauaaauggccacuaaauguaauacccuccugguaagaaugcacagggaaaacguuucuggagagcucuuugacaacaucuaccaaaacuauaaauauacauuaagaacaaaaaaguuuucauauaauauuuacauauacuugcaaaagucaacaaagaaauuauguauugacaguaacagugaaaauaaacagagccucaaaaugguucagaaaugaucuucugaaauacugucacuuuucagugaagaauauagaagguuacaccuucuucucaucaccaacacugggaaaagaugauaugaauuucacuaagaaacccucaaagcaauggaagggaaaauucuauaggcuaaaaggaagcagaaaaaauuagcacagacuaucacaaaaaaaaaagagcuaucagagaucaugaaaguguucgcggaaauuaauuacuaauuuuaaaucacuaaauuaaaaaacucaacagaacgucuuaauagcaaaaucaacaaggcuauggaaggcaauggggcaacauuuugaaaguuucgagaaaaaaggauuuuguuccuagaaugccagaguauuuuuucauagaauucuauaaacuacuuuucaagugcaaaagagaaagaacacuuucugucacauacaccuuuuucuuggggggaggaaaggaaacugcuuaagaauuccagaaaaugaauucgagaaauacaagaaugauaaagaaguaaaauacaagaaacacacggcagcugugaaguuuaaugcaaauauuaagaauaaauaaacuaaaaucaugcuguuuuguuuaauaucaauaguagaaacguggcuacucugugcacauugccuauggcguagcccugcucugcaacgagcaguuaaaaaaaaaaaaaaaguagaggccgggagcgguggcucacaccuguaaucccagcacucugggaggccgaggugggcggaucaugaggucagaagaucgagaccauccuggcuaacacggugaaaccccgucucuacuaaaaauacaaaaaauuagccgggcaugguggcaugcaccuguagucccagcuacucaggaggcugaugcaggagaaucgcuugaacccgggagguggagguugcagcaagccgagaaugagccacugcacuccagccugcugacagagagagauuccgugucaaaaaaaaaaaaaaaaaaaaaagguagaaaugcuauauauuaaaaguuauccauuuuaucuuaugacuaacaagaaaggccuuuuacuucagaauguggggaagauaccuaaggauaagaaaucagaauguucugcaggauuaucagguauuuucuuuaggaagguuuucuuccuagacaauggaaaauaaaaauguuuauuuaaaucauacuucuaagcacacuuucuuauuucaguucauauacagccuaaaguuuuuagagcuggucaauccaguaagaacacuacaaauccaaaugauuugauaaaaaucuuggcagcagaggaggagaggaggagaaaacaagauuccaagccacuaacacacacuuccuguuucaaacgcagacaccaaguggcuucagcaugagucagcggcaaacacccucaagucaugagcuggaacgcucagaaacgguucacugaguuuuuuuucuccuauuauuuucaaauuuauuaguuuuacuuaauuauuuuuaaaguaucugagaaaauguuauagauuuuaagcguguuuuuauuauaacuucaugucaauaauuucuccacagauauguaccuucaaucaaauuacagaauuaacuaggggaaaaugaggaagaacuuuagguacagacagcgagagaucuucaaaauacuauuaaaagaagaaagcacucucgguguaaaaaagguaggaaaauagaguaucuguguugcuauauaauaacauauuuguguuuguuaauaauauagauauuugugucugcauaaagagacacuggaaagaucaacaagaaaaaauguggcccuucaccuuugggacaguagcacugaguggacgcugaguggacgcagacaggaguggaggggauuuccuagcacguuuuuuggaggguuuucuugggaggggacuacauacuuuauucaaaacauuaaucauaaaaaguaaacacaacagaaaucaccuuacaacucuucaaauacacccauuuugcacagacauaauuucauaagcauguuaguuucaagagcucauugacaacagcuuaggacuugaugaaaacaugucacgcaaaaaaauacaccauaaguaacugcugauuaccagcuaugcaacacugaacuaucauuuaacacuugacaaaucacuagccacggcuguuuugaacuccaacuuaauuuccuuaacacuggcucacauagcucaaaaaacaacuccaucaaaauacacgugaaucacauuuuaauccuuaaaugcaugagcuuuuaaaagugagcaguuacacuucagcaauauuuaaaaccgguccuuucgauuuuauaacugaaauaaaggaacgggcuaagaagucagugccaaggguuuaagagcaucucugcaaggcgcucagccucccggggaacuugauuagaauuuccaucucccauacaaugaguauuccccauaugcucauggcagauaaacuacauguaucuuuuuccuaugugucaauacaaauauaacuuauacucaagcaggaauucugauacaacccaauaaccacauauaaaggaauccucuauuuggggaguuaacuaucaaaugucaguaaaagacaagucaucgauaucacaagcuaggggaauccuaagaauaaaacggaauuucuuagaauugcaaugcacauuuugaaaaacgauaaauauuucuuucuuggcaaaguaagcuggcaugguaaccauucaaacauggauuaugaaugaugugauaaaauaauccauacaaaugugaagguuaagacaucauuuuuguauuuaacaaaaucauaugcaucauucaaagcacuacaaugaagaagcauuuauuaucaacacuauuccaaaagacaaaguguugcuuggccagacacgguggcucacgcuuguaaucucgucacuuccagaagccgaggcgagcagaucacuugacuucaggaguucaagaccagcccagccaaaauggugaaauccaccuccacuaaaaauacaaaaauuagccaggcaugguggugggugccuguaaucccagcuacuugggaggcugaugcagaagaauuacgugaaccuggaaggcggaggcugcagugagccaagauggugccacuacacuccagccugaaugacagaggaagacuccgucucaaaaaaaagaaaaaagaagaggugcugcuuauaaaacagaauaugacaacuuuauugggaggaaaaaagguaauuuuugcauaugcugauaaaacuacaaaaagggaaaauggccaaauacuuauucaguagcaaauaccagugaguggacggacauaaauuauaauuuugauaaaacuacaaaaggaggccggacacgguggcucacgccuguaaucccagcacuuugggaggccgaggcaggcggaucacgaggucaggagauugagaccauccuggcuaaaccccgucucuauuaaaaauacaaaaauuagccgggcgugguggcacaugcuuguagucccagcuacccgggaggcugaggcaggggaaucgcuugaaccggggaggcagagguugcagugagccgagaucgcaccacugaacuccagccugggcaacagcgagaaaaaaaaaaaguaaaaaaggccaaauauuuauucaauauauuucaauuauuuauucaauuuauucaauauauuuauagcaaauaccagugagugacaauuauuuaacuaaaaugauaucugacuaaauguugaagcaaggcauguuugugacaccaaaaaguuuaucacagaaauucaggacagccaacugcuauuaaaauguucugguuucaccaucuccuucuccaaaagccuuccuaacuuccaaucaaauguuauuuuagguguuugguaaaaugaggaauguuaucaaaagaggggaggagaaacugcuguucaaaaaagucaauauccugaaaggcugugggaaacuuccagacuacaaaaagcuagagacaugauaacuaaauacauuuccugacccuagacuggauccugugcuggaagggaaaauucuagaaaggacauuauauggucaacucccaaaauuagaauauggacagguuagaaaaaaguacugcaucaauguaaauuugugaaagugguaacguauuacugugguuauuuaagagaauaugccuauucuuaggaaauacacauucaagaauuuaggauuaaguggcuacaguguauguaaucuucccugaaaucucaaaggguuuggaaaaauauuguaugucuguauauuugcauuuguuagcccaugucugugugucuguauguguauccguaugaguguguauuugcagacagagaauuccagcacacacaaaugauuaagcaaauggauuuaaucuuaacaacagguggaucuggguaaaggaccaucuggggauucuuuguacuauuuuucuuuccgcaacuuuucaaguuucaaacuauuugcaaauaaagaguuuuuguuuguuuguuuguuuguuuguuuguuuuuuuaaagcuaacacugaaaauugugagguuaugaggaaaaccuuuacccucuccuuauguuugacuguuuaguguuuucucuccucuggaagauuaacuuauuucaaaggcugucacaugaggggggaaaauuguagguguuuggguaaaauaaagaugaaaauaacgcugugucugacuucacaggauuuacaaccuagugaagagggaaaugccacugaugacaugaauuaguuuugcccauaacagagcaagauaaaauacagaacaauucaguucacacgggagacuaaaaagcacgaguaaguucaucguuucuuguaauuucaaagaaagugcagagcuuaggacauauugguggcugucauuaaaauaaaagcagguaccuggaggcccugucagccaugccacaccacagaaacugugacacugcugcggcuaacucugcccuucccacagcuacaccaaauaccaucaggaaagacugggaagcccccuaagguuucagcaacucugccagagucagaacacuggggucaaaaggagguaucagaaagcaguaacaaacgcuccuuucccgcguccugugguugcauaggaaaugcccaggggcgggacggcacagaaaugccugcgauucgggggagcaaaguacaagggcuucaggcauuucuuccccuuuuuaggggaaguaagacugugaacuagagaagcuauuuauuccccuccaccacuuccccucauaucccauccggccuccaucccgggcuuucaaaacucucacuguucacaucuuuacuuucugauccuuucucaagaggauguggaaaaaaauauacaagaaacacuucgagaaaaggggggcaagcccacaccacagcagggaugggaacaaaagacaccuuccucccugaagcauagccuguuggcuaagcuggcucaguuuaccuucuggagguguguggaggccacuacggcccucagggggccugaguugagaaacccugggcaaagguuuagacgaagugggaaaaccaguguuccugcuaaaggaaaaacaaagaccuugcccucagcaauaaagacacauuccuccaucucagcccaaggaaggcgagaaggagaaaagaugucuaauguucacuugcacaaccugcuggcuacagcucucccgccggaacugcgggaaacgccacuuucggcuucaggagacgcuggggacuaucaguacagcacggcacuagggggcgcugcagcacagcauucugaaaguuucaucucucuggaaauuugaauaaauaugcagguuguuccaaauuaacauucucugccuucaaaaggacugauagaaauaggagaucagcccugaaguaagaauguaaauacuuugcugcugcauuuguaccugcaguuuccgaggcagguggacaacuaugaccaaucucuaagaacaaucucccauucacagaugcacagcuaagccucacaguggcaaaugguauaaccaggucacagucaaauacacaagaagcugagaaguauaaaguauucucccucuucuccugauccaaauaagcucaauuuggggaaacaugaaaagagcaauagacuguuuggcaugauuaaagccuuaaucucaucuacaaaaugaagguauguuggaccagacaacuucuaaaauucuucccaucuccaaaaggaucucuuggaucuaaaaaggauuaagaaacacggguuugaaaaugucgucagacaggccgggcacgguggcucacaccuguaaucccagcacucuggggggccgaggcggguggaucaccugaggucaggagucagagaacagacugccaacauggugaaacccugucucuacuaaaaacacaaaaaaaaauuagccgggcaugguggcaggcgccucuaaucucagcuacucaggaggcugaggcaggagaauugcuugaacccagcaggcagagguugcagugagcggaaaucgugccauuugcacuccagcccggguaacaagagcaaaacuccgucucaaaaaagaaaaaagaaaagaaagagaaaaagaaaaagaaaaugucaucagacuaaugcaugcuacaacaggaugacuuugaaaacauuauacuaaguuaaagccacacacaaagagccauaaauuguuucuuccauucauaugaaaugccaagaauaggcaaauuaccagacacagaaagaucaugguugccaagggcugggaggagaggagaaugggggagcgggaggcggugacugcuaaugaacaugagcuuucuuuuggggaugaugaaauguucuaaaauggacuacgguguuagcugcaaaacuuugugaauacacuaaaaaccacugaaaugcauauuuauucaaauacacaaacuccacagcaugugaauuauaucucaauaaaguuuuaaaaaaggucaguacuuauaucaaaauaaaaauuuuaauuucuuuacuaggcuuuaugaaucaaagcccaguaaguuaugggugcuagcugauaucuacugaacaaucauugugugcuuucaacuucagaagguggugugggugguucugaggacaucuggagaugacacuaucaucaacuagugaaugcacaccaggaaguucgccaauuuaacaauaugcacugagcaucaacaauccacacucaacuaugcgagacuacgagaguaaaacuuugaacacaacacacacaggggucagggcauggugacauuuacaguuuuauuacagugcaagccaacugcaagcugaacuaaguguuacaaauggcagaagcagacaaaggaagaaggaggaagagaaguuuuguucccucacuaauagggcuauagcaaaauuuugcuuuacuuucuuggggcaaagagguccugagaagcgaacaaaguagacaaacuaucacaaagucacucucacaggcagccucucuccuugaaacucaaaugucaaaguacugcaauugagugucuacuucccuguuuguauauucuauuucuacuauuaaagugcuaucaaaaaguaaucauuuuaccucucaaaguaugguuuuuaacagguuggcuguauauuaagugcuuucauggagauuccgagcuaaaauuuccuucagaaauuuuagauugaauucagauugaaucuccaaauuagaaaacaugauucacuuaacagaaacccacuuuuaccaacuuuccaguccugugucuauauuagaacuguauuacaaaauggccauuaaauuuuaacucgcuuugcucuuaacuaguacuaaauagcaagguaauauagauagcccucauuauugaauaacuuccuguguaaaauugcuauuguaugaaacacagcagauaaauuagggaguaaauucagucaacuuuaucugggauagcccuaguagaaguucaagauuccaccaacuuucauauucauuacaaucaccuuggugcugaccuuaagaaaaaaagaaauggaagaugaaaccaauaaaaaagaaacuguaacagaagcaguucuaucuuugcuggggccaaggacgaacaaaagaagaggcugcaagggggcucaaugucauucuggggaaugacagaacuggugucuugauuguggaggugauuacacaaaugaauacaucuguuaaaauucauggaaauauacacuuuaaaugggugaaauucaccgcacauacguuauaccuccauaaagcugauuucuuuaaaguacaagaaucgaguuagauccaucuuuguuuagccagaaguuaaugcaguagacuuggcauagaguaggugcucaaaauagcuuuguugaacaaaugaauucaggaagaggaagaugaaaaaacccacacaaauaaaaagcuuaucuaaggauaaggaauaauuucuccaaacuacauagcaaucauugugacuucccaggcgucagugggcugacagucuuaacuugaucacucugaaugguuuuuauucucauguuuuuauuaucaccagagauguuccagcuaggaguacaucuuucauucucaaauauaaucuucaaauaaauacaaucaagaaauaacacuuauuuuuaaaguauaacacuuaaacuuauauuuuaaaauauaagacuuauucaacguaagugaauuaagcuucacagaacacuuuaaaggaacaccuauuuugaccuaaagaaaaaucauuaacaauuaccaugugauccauuucccaagcuaaagagaaaccacuuuucaaaaucuuaaguguauaagggggaaaaaaggccaaaaaaaaaaaaacccuggaugugaucagaagguaucggagccggucaauccuuuuaaaaucgacuuuauuccccaccccccaucuuugacccucaaauaagaccaccgguuuccagugugaagcaggcaugcauccuguauuucuuggucccuccuuucugcucaaacugucuuucugggcacauuucacuaagaaccaccuauuuguacucaguuucacuuugcugucaaugacaggaacucauguuccuagggacaaaaaauuaucauuuaaauugauguacuauaaaauuaagacgacugagccggacgcaguggcucacaccuguaaucccagcacuuugggaggccgaggcggacaaaucacuugagguuagggaguucgagacuggccaacauggugaaacuccaucucuacuaaaaauacaaaaauuagcugggcgugggggagucugccuguaaucccagcuacucgggaggcuagcaggagaacugcuuaaaccugggaggugaagguuucagugagccaagaucacaccacugcacuccagccugggagacagagugagacucugucucaaaaaaagaagacugacaauaucaaauguuggugaggacagagaagaagcauucucauacacugcuggugcagauagaaaacggcauggccgcuuugaaaaagccuugcaguuucuuacagaauagaauauacgcuuaccacauuuuacccacaagaaaugaaaaccuauguccacacagacacuuguacaugaaugugaacagcagauucaaacagugggaacaacaaaaaugucuaucaagaggaaagagacaagcaaacugugggacauccacaaaggaauacuacccaguacugaaaaggcuggaacucaacacucaacauggcuaaaucuaaauaguugggucaggugaagguaaccaaacaaaagaguacaguuuguguaauucugggccaauguaauucuagaaaaggcaaacuuucuuagccuauagugacagaagcagaccacuagcugccuggacaagguggggauucauggcaaaggggcaugaagaaacucucugagcaauggaaauguucuauauauggagugugguaguaguuacuacuuugguguauacaucugucaaaacucaaacugggcugggcgugauggcucccagccuguaauuccagcacuuugggaggccaaggugagaggaucacuugagaggaguucaagaucagccuaggcaacacggugaaacccugucucuaugaaaacacaaaaaauuagccagguguggcggcgugugccuguagucccagcuacucgagaggcugaggcaggagaauugcuugaacccgggaggcggagguugcagugagcugugaucgcgccacugcacuccagccuggcaacagagcaagacucaaucucuaaaacaaaacaaaacaaaacaaagccagacuugguggcacaugccuguagucccaguuacuugggagggcugaggcaggaggauggcuugaacccaggaggucaaggcugcagugagcuaugaucacaccacugcacuccagccugggagacagagcaagaccucgucugaaaaacaaagacaaaaaaccucgaacugcaaacuuaaaauggguacauuuauuguauuaaauuauacuucaauaagguugacuuuuuaaaaauuguuaugcacaaucuauguaaagcagaugaagcaguaccauaaucaaagcucuugaagaccaauggccacaguuguaaucuuucauuuacagaagaauaauuccucaguacgcucuauuuguuaaucucucaucuacggaagaagaauucuucaguacacccuauuuguaggcauccacacucugggauuuuuaguuucacauuccuugguccaaagaccucccagugcuacacaacaucaucuuaaaaauucugcaucauugccgggcaugguggcucacaccuguaaucccagcacuuugggaggcccaggcagguggaucaccugaggucaggaguucaagaccagccuggccaguggugaaaccccgucuuuacuaaaaauacaaaaauuagucaggcaugguggcgggcaccuguacucccggcuacucgagaggcugaggcaggaaaauagcuugaauacggcaggcggagguugccgugagcugagaucgcgccacugcacuccagccugggcaaaagagcgagacuccuucccaaaaaaaaaaaaaaaaaauugugcaucauuggccgggcgcgguggcccaggacuguaaucccagcacuuugcgacgucgaggugggcagaucaugaggucaggagaucgagaccauccccgcuaauacggugaaaccccgucucuauuaaaaaauacaaaaaauuagcugggugugguggcgggcaccuguaguccuaacuacucaggaggcugaggcaggagaauggcgugaacccaggagguggagcuugcaguaaggcaagaucgcaccacugcacuccagccugggcaacacagcgaggcuccaucucaaaaaaaaaaaaaaaaaaaaaaauugggcaucaucuuuuuauucugcaucuguuuucaauuuaacugugcaccacucugaagccucugucccaucauuacucagucacuucagauuauucuugccuggcucaaccuuuauuacugccgagcuucucggaccauguacucaaacuccacacaaagacaauuacugccaaaaacaaugaagcaaaacuauaguauuucauuaaacagagugcuacaugggcagaaacuuguaagugccaucuguucuacaggauuuuucacuuaauaaaauacgcuggaaccggaccaacagaaggccagcuacuggaggccacccgccaggaaggaacgcacaucgccacggcagagcuuccucuuaaaggacauccaugaaaaaagaaccuagcuacagaaaugauuuuccucugauuugcuggccacugucagcagacucuucaaaucuccuagaaaaucuaggacugucuaauaagaaguacuuacauuagcugguaaauagacuccucuccuuccgguguuaagaucaagcacagaacuuccaccuuaaugagcggcuuuguuguuaauggaaagcaaaguuacuuagaagguuugguugaagaaguaaaaagcugcaaaauuacuaucuguugaaaauaaaagaaugcaaaaagugguauacuagcuaaggaaggaauccacuguuugcugucucaguuuaaccuucaccuaaugaucugucgaaacaugcccuccaaagauuuaaauuaugcaaguauagcuugcuuuaccagcaaaaauccuaauaauuugcauuccacucuuuaauuauguauuuaaguuccuggauauggucugaaaucuuuuauuagaaaacuguuaacuccagacuucaaagucccccuuaugggaccuacauacacuagaagagauguuuuccacccaaucggcuuccuauauucuauuuuccacauaaaagcagguaaccaauccgcggugguacucaccuagcaggggagcagcauaaaccauauuggacaaaggccuaagacaacaguccucgaaccuggccacaccuuagaaucagagcauccucaggccacaccugcaacaauucuggcuucaguggucuaggguggaguccaggccucauuuagcauuuuaaacacuuccugugugauucugacuuacaguuggaguuuagaaucacuguguaggggcauucccgugauccaaguaaaagcuccaucacuacaggcaacugaggaggugggagaaacuaagcagaaaacaggaggaugaggggagcuacuucuccauucaguuaugccucccaguuaaaaaagaaauuauaaaauaauuugagauaauuacucacuauauaaaguugaugaacaacauccagaugucuuuaaaaugggaacucuuuuagugcuuuuaaggguuuacugaucauuaacaaguuaauaaaggcaaaaacaacaacaacaacaacaacuaaacuggccgggcgcgguggcucaugccuguaaucccagcacuuugggaggccgagacggguggaucauuugaggucaggaguucgagaccagcuugaccuacauagugaaacccugucucuacuaaaauacgaaaauuagcugggugcgguggcgggcgccuguaaucucagcuacucgggaggcuaaggcaggagaaucgcuugaacccaggagguggagguugcagugagcugagacugcaccacugcacuccagccugggugacagagaaagacuccuucucaaaaacaacaacaacaacaaaacuaaaagaagaaaaacuuuuuuuuuguuuuuuugucagacagucuugcucuguugcccaaccuggagugcaguggcgcaaucucaguucacugcaaccuccgacuccuggguucaagcaauucuccugccucagccuccgaguagcugguauuacaggcaugugccacgaugucugggcuaauuuuuguauuuucaguagggacaggguuuuaccauguuggccaggauggucuugaacuccugacaggugauccacccgccuuggccucccaaagugcugggauuacaggcgugagccaccgcacccggccagaagaaaaacuauaaugcaacuaaauuagaaguaauaugacagaaaaauuaaacuccugccaaacacaguggcccacacuugcagucccagcuccucaggaggcugaggugggaggaucccuugagccaauaacuuugaggcugcagugagccaugauugcaccacugcacucuaucuugggucacagaguacaauccugucucaauaaaauaaaugaacucacaagcaacucuucagaaaugucuucugaacaaaagacauuucuuuuguaauuaaacucaucucucauuugcuuuuaauucacugaaaucuaacuuucacuaccaacacuccacuuucucaaaaauaaccuuccaauccaagauuuucccuucgcaauguagucaaguucucugaagcaucuacaacucuauaagacaaguaaucucccaaucucucucucaucauuguucuuccaaucucuuagguaaggaacuuugaaaauaccauaaauuauauacccuuuccaucacaaauacccuaacgugaucacgaaucccaaauuucugggaccaucucaacaaaauaucaaaauguucagaaaaacugcauuuggcaagaauagcaacugaaugaauuaaauuaagcauuacaguaaauuaauccguacugaaaucacauacaccugaggaccagagacuaggaccucaaugaaucaaaggcaguagaagcacuuuccugaacacacauaacucaggaagauuacuaagaagugaugcaucuccucuucaacucuacaguuacuauccagcacaggcccugaugacuccaccuaugccuggguaucugcaauaaccuagguaguggccuccuccuaccuaccuaguaaaaugcuuggcaccuaagagacuagcaaaugcugacagaauggcucacagucaccaaacagcuugucaccaagcuaaaucgacacuuauugagcaccaaugacauaaaaaggacauuaaaaagcaguuuaaaauguuuaagcaauguguccugccuucaaagaacuggggucagggaaggaggacauacagcuaguguguacugaauguccauuaugcucuagacaauguuaaaggcauuuaaucaacauauuucauuuaaucugcacaaaauuucuaaaagggaggauuccuaaucuuuuuuggguggcagcagaccucccgagaaacugauguaagggaauuaggcccacccccuaaagaaugcauguacacacauuucugcguaugauuucagaacuucacagacccucugaagcucccgaagcccaauacgaccugcuacucaaagugaggucaccaggccagcagccuaggaauuaccuaggagcucagacagcgcacagggcccaccccagguguacugaaucuaaaugugcacauucacaagacccgcagcugauucucaacggacuuuuaaguuugagaagcacugcuaugcucuaucucauguaaucccgaagcucuacuaugaagcaagcacacugcuaucacagugacugucccuauggcucuggacuucuauuuuaaguugcguaaccauuuaucauccaaauuagaggcauaucucagagugaaaggaucauuaugaugaauuaugcugggauaaguuuagaccaggacaugcggucacuccccauguaauuguaagguguauauaaagguagaaucuucacucuucaacuugguguaaugggcgucucugccuaccaaccuugccgaaggucgugcaccuaagaucccaguaacucugcauuuauucauuauucugcugaucagccuucgugcaggcagcucccucuucccccaugcucugaagaaguccuacuuguccuucaaagcucaacgcaggcaucaccuccucaggaaguguuucuaaacccuauuucugccaaagcacuguucauauuucauaguaauucucauuuaccuaugucucugugaaugaacuguuaucuccuugugucagucuguauuucguccacugaagcacaauacugagaaucuaauaaagauuugcugaaugaagaugaaaaaacuuuaaaaguucagagaaaccaaccuugccugagauuccacaaacaaaauggaacaggauuggaaccugaggcugaccucaaggcacagacacauuaacaguuaaggaacaauaauauuuaaagaagacuguaagaugcaaucagauaguacagaugauuugccaaggagaaaggacaaucuuccagucugaggaguccaggaggaacuggcauaucuggaaaaggagaggggggagagacauuacgcucaugugggacaguagcgaacuggccagcuccccuuccuacccugugggauaguagucacccaguucagaagucaacacacccccacccccaggccagaugggagcccugcuuggcauaccacccuccucgccacagugcucugguugagggacgacccaaagggcaagaagcucaggacacugccuaaaauucugggaugcacacucacucucuuggucaggcuggugugacggaggcugugcccaaaugugaagccugaaacugcuguggccauuccgccaucgugggggaaacuagcccugggauaauacugacaggcagaaugaaaagaugaagaaaugaaaagugaaaaaaugaaaagaagccacguccucaaaacuguaacuaaacggcugaauuaaaccaacuuugaagccugaucuaccucuggaauuucuaguuacaugagccacuaaaucucuaguuuaugguguaagccaguuagaaagcugagcucuacuuguuuguuuuuuuaaaaaaaaaagggagggcacccuaacacauaaaugggguaagcaaaaagggagauaaaaggauaguugggcagcagugaccagaggauucauauaaaguaguaaggucacccagguggacucacuggcucaugccuguaaucccagcacuuugggaggcggagauccuauuccuucucaagacuagcucauuacccaucuucauucucugaauuacuacaaaagaaccugccacaugcaccacauaauucagcacuuaauuacacaucuuguaacgugcccaguuguuucuuaugccuuagcuauccauuauacacaaagguaaggaugcuuugguuaucuuccuggauaucuacagcaauagcugaaauaguuggccuucaccaaacauaagucagcuuauugauauuuuauaaaugggccgggaguggugccucacgccuguaauccaagcacuuugggaggccuaggcgggcagaucacuugaggucaggaggucgagaccagaccggccaauauggugaaaccccaucucuacuaaaaaauauaaaaaguagcuaggcaugguggugcaugccuguagucccagcuacucaggaggcugaggcaggagaaucgcuuuagcacaagaggcagagguugcagugagccgagacugcgaacugcacuccagccugggcgacagagcaagacuccaucucaaaaaaaaaaaauaauaauaauaauaauaauaaucagaacuuuuuaaauauuuuucaaacauuucauauguagaacuuguuuuugauauuacuuuuaaaauuuaaaaaaauucauguuuuaaauauccacuaaguaucuucuuaauaucccuuagcaaaauaucucucucccuucaccccaaaaauaaucaaugaauuaaggacguucaucuuccaguuuacaauaaugugcuuaauuugcucuaggaaauaagauaaauucacaaguaacaacuaaaaauuggaccaaaaaaaccugccaaacauuaccauuuuuaguaugcauaaacuauaacuugugaauacgcugcaguccuuaaaaaacaaugcugaagauuaaguuaaggcucuugagaucuaaaaaaaaaaacaaucgcaaaggaaaauauuuaauggaaaaacauucaacaauauaagaaaugcaaagccgugcacgguggcgcacgucuguagccccagcauuuugggaggcuaaagagggaggauggccuaagccuaggaguuagauggugcagggagugagcuacgauugugccacucacuccagccuggaugccagagccagaccccaucucuaaaaaagaggaagaagugggaaaaacauuuuacuaaacaagugucauuccacauuuuaaggaagaaacuacuauaccaugaacaaaccacaacgagcuggcucccgccagccacccaccucccgccacccuaaggccugccccuccucuaggcacuguucaagcccuccacgcuucucaacugggucucugcaacaaucuaccuccgccucugugcucaccccucacccuccaaacugcauguggccaccacagagcugucucucaacugaaccuuacuauucuggugcccaggaaaagccuuucuagucucccagaacuuuucaggcuaaaaggcucuagcagagccuacaagacgcacccauccaccuucccagccaacccccagugcugcagccccgacaacucuccacgucccaaaugcacuucagcgacacggcacacgccaggucuuucugcuuugggcgcccuucucuugggacccugcuggccuggcugacucugcaaacuauagaacucaguuccaaaggcucaucuuugugaacuauuuuccucacaaacaugagccaagguguccccggggacucuccugugauggucucucuaauucuggauccuaacaguugauucucuagcuucuuucccacaccugacugugggcuucugaauauguccacugugguaugucuuucaugaagguguuuguuaauaaauauuuacugagcacucaccacauucuaggacuaggggccccagcagugaacaaagcaaacaaaaaccccugcccucacggagcuuacauuggggccucaaggagcuuacauugggggaggacgagagagugaaccagacacacacgucaggauagcggguauguaggguauuaggugugaagugcucuggagagggagcaagcagacagggugacaagugugaaggagggcgcaauuuuaaagguggguaaaguggguguaagaagauggcccaggcacagagacucacugaaaguaggggagcaaaccacagggacaaagggggcgagccugucuacagacagagggucucggggacagacaauguguuccccuccauuucuguaccaacaaugccuggcacauagcugaguucaauaaauaacuagugggugaaugguggcauuggcugagauaucuaaggucacaaaggugggggaaagauaaacuaacuguggcaaaccaaccgaaaagcucuuuccauguucacuggugacacauaauugggcccuguacuggaaaggcuggcugcuccaugguucuugcauuugggggacagcugcauuugcuguaagcaggccugcgaagauagaucacuggcaugcccacuaacaauccuggaagagcuuuaguacacggagcccccacagccaagcacuugcugguaacucuggugaaggcauucucucugcauugcuaaguguccuaucaucuccagacuacacuugcugagaaagagaccaaggaauaaaaccaaauaacuuauaugugacgugcgggucagucaccuggauucaagaaacuacacaacagagguaaagagagcacugaagaaccugaagagcagcuuaggggucacucaugcauucuaaaugcagaaaugacaaucaaggugauacugugggaagcagccaccucuucuucaucagcucucauuacuauuucuauagacggcaaaucugccccucggggucuugcaugcugugguccugaacuucaugccuagaacuauuauagaaacaccaaaaacaaccauaagcaguccugaaaacagugaaugacaaccagcuguucucuguuugcuucaacuggucccugccaauuaaccgauccaacagacaaacaccugagugcccacugugcuaggcaguggggacacuggggcagccagaccauaccagacucaagaaagccuuccugacccgaaagagcagccaggccagcggcugcuuccggcucauccaugugguguuggccucugcauaaggcacagucuccccaggcagagccaugucuuccuuccgcuacucucaggacaggaccacaagggccucuguacacagcugacugccuccugaggaaggacagggcaucuacagaaucaaaguauaagggcccucaaagccugccauacacacaaaauacugcgauuucuuucccuucucacagaaaagagaucaacugaugaauaugcuaacuuaagucuauguuuccacccaaaagcagcaagggcaacgaagcacagcugcaagguguuucuguccaccuuaaaaagcaaaagccaccgggcgcgguggcucaugccuguaaccccaguacauugggaggcugaggcaggcggaucacuucaggucaagaguucaagaccagccuggccaacauggugaaaccccgucucugcuaaaaauacaaaaauuagccagccaugguggcacgcaccuguaaucccagcuacucaggaggcugaggccagagaaucacuugagccccggaggcagagguugcagugagcugagaucuugccacugccugggugacagaacaagacuccaucucagacaaaaaaaaaaaaaaaaaaaaaagcuagcccuuccucacgccuaaaacucuaguuauagguggaagaaaaguuucugcugcuggcaccuaacuuagaauacauuguuguggcacagaagagcaaagagguaagaagcaacagagaaccaagcguaauuauuucagcaccaguuugggaaaaacuagagacuagaauuuccucaccugacgaauccaugagcaacaacagcaaaagagagcaggaauucccgaugguaaauuggcuuaaugcuaugcacacauccucagagauguugacaaccaggcuucaggaugaauuauaaaguuccaguucucugggacaucagaugcucacaguuacacugagcugugggggagugugcugaucccaugcuguccacaaagguccuauuucaagauguggggugcagagcaacagccagagcagcucuuaagguucuggggaacacauguguacuuacauuuuuaaaaacauguuuuuuugcaacuuauaaaucccaacacgggcccuggcacagagcaaguacuggguaaaugcuugcuuaaaaggcauaaucauggacuuaaugaaugccaagccaaacugaaaucucguucugaagacacgacaugacagcucuucaaaguggcaaaaugucagguuucucaucugcucacaacuguuccaccauuccacucggcgcuaaaauaagugaguaucacacucagagggaggggcacaauucauauuuuuguuguuguucacgccuaaccuagacuggagauguaacacuuuguccaaaauacgauuucguuauugcuauucaugcgaaagggcucaacaaguuaaaacaaaaaaagcuguacacaaacccaugcggacgaccugcaaccugagccuggcucagacggccuggggaccugcucacagggauccuuacucagugucucuugguggcacccagggugccaggugauucugguauuagaagagggcacucgaggaucacaaaccuaaaaacgcuguuaaauccaaugauuccaaauuucuaaaguuuacuaccaaaaguacuacaggaaacauuuaaaauaagguaacaagucaccuaaguuuuccuuaauauuuucuacgaauauaaucaagggacagaugcuuguuuuuaaaggugccucccccucaaaauaaagggaauaugucccuaaaugaccuucccuaacuacucuauccaauuaccacugaggacacugaagggcuaccugccucacauuaaucugucucaaaaguccccaaaagaaaugcccuacuucuuuccccucaaaguuaugaggcuuaagaugccaaaaugagcagagaguagagucccagcuauggaggagagccuaaagaaucaaaucccugacaacuuucgaagcaucuaaguaagaccccugcacaaucaacucaacccagcaaucuuuuuuuuuuuuuuuuuuccgagauggagucugcucuguugcccaggcuagagugcaguggcacagucuggcucacugcaaccucugccucccggguucaagcgauucucuugccuaagccucucaaguagcugggauuacagacaugcgccaccacgcccggcuaauuuuuguauuuuuaguagagaugggguuucagcauguuggccagacuggucucaaacuccuuaccucaagugauccgucuacuucggucucccaaagugcugggauuacaggcgugagccucgcacccggccucaaccagcuaucuuaacacagaguugcuaccaacuucacucaguccugagcuuggauuaccaaauucuuucucucuccucuccagacucccggcuaaccacuucacccuacacaccauuucagccacaaauuuaucuguuucccaaacaggcugcaggcuuugagacaguuccucugcacagucuccuccacaugcccuuguccgugugcuucucugccugaaaaacuccagcucaaaugucaccguucuacaagagacgucuucccagcuuugcccaacauucagucccacucuccuccuuuuuugaaacaccuuauaccuaacuccugagucacgcaacuucucuccaccuccacggcacccuccgagucaaaaguccaaggacccugcccuaaaugaucuccuuauggccacugcgaccccgugagucuauucuucacugggcagaguaugaucccaaaaggcaaugugauuaugagguuccauggucaaauguuguaccacccccucuuccacacuuuucucagaauaaagacaguaacaucuaacaaaggcugcaagguuggauggugcgucugucccuccccuccagcucugugcccaagacacacaacuccuugcugaguucuccaaagugcuccaaauucccuccagccaaagguccaccacacaugcuguccccacugucucaugcuguaaacacgucacuuccacgggaacgguucucugacuucagauuguguucccuuccuuugggaaacaucucucaguuuggagugacguguacguaacugugauuaucugauuagcaagcugucuuccucaauggacccauaaacuccuccgcgagagaaacaaugccuguuuucgcucaucacucccuccucagugccugguacacagcagccacucgguaacuauuugcugaaugaaugaacaaacgaaugaaugaauguucuugacuauguuguucacacuuguguuacaggaauuaccacccuaaaacuggaugcacccagccauuagccugcuucucucccucacuacccagcgaaccucuaaagcacaggaauucucucuucagcucuauacuccuaacguccggccaccaaaaucugugaacaaucacaaaagauauaaaguccuucauaugugguucugaaaaaagugucuaguauucuacaaauuaauucuaaacaaaauaguaaaccacacuuggaagccccgauuuugcauucuauuacaagucagaaguacuuaaaugugguuaucucucaggagugggaccugaguugggaaguguuuuguuuuuugccauugcaguacucugaugaaacaaagugacagaagacaaaaacaugauuuugaagaagauggagaaaaauucaggugaauuacccaguuucucauuauucccuagggcaggugacuuaccaaucuccaacuaauaaaaaguuuguccucucauaaaucuagugcaaaggcaauggauggacaagaaucugaaugugaaucagaccuccuuuuuuguuuuuugagauggaguuucacucuuucguccaggcuggagugaaguggcgugaucuugucucacagcaaccucugcccccacggguucaagcuauucuccugccucagccuucggagcagcugggauuaaaggugcccgccaccacacucggcuaauuuuuguauuuuuagcagagaugagguuuuaccauguuggccaggauggucucaaacuccugaccucaggugauccacccaccucgaccucccaaagugcugggauuacacgcgugagccaccacgcccagccagaccucuuuuuacacuaugaacaccggacagcaugacuacuacuaaggggguggaagucuucaaaauauuucuuaucuuuucuuuuuugacguaagagucucgcucugucacccaagcugaagugcaguggcacaaucucgacucacuacaauguccaccucccagguucaagcgauccucccaccucaaccucccaaguaggugggacuacaggagagcaccaccaugcccagugaauuuuuguauuuuuguagagaaagaguuuugcuacguugcccaggcuggucccaaacuccugagcuugagugauucgccugccucagccucccaaagugcugggauuacaggcgugagucacucacugcaccuggcccaaaauauuucuuaagaaaaaaaaaaauuguuuggacaacauguuauaaguuguggcagcacuuccacaauccccugcacacuggauccugauaagucacuucaaucuccagaauaucugcuucauucccuggcaaaauuagguaaaccuaagaaaacugacuucaguggauguuuucaauaauuuugaaaacaagguuugcucaauaaaguucagugacuagauacaacagaccauauuaugaaacaacggaacaacaacaacaaaauacuccaguggaaaaaagcauagaagacacacaccaaacugacgauuaaggaucagagaggaagggaaugacuucuacuuuucacuuuaaauacgucugugcuguuuucgugucuuaaaaauagcaugucuuuauacuagaaaauaaaauaaacgacuuuauuaaaauguaccccacacaaacuuuagugaauaguaacauauuauaguaacaaauuuuguaauuaguaacauuaaaguuucuaaaugcacauuucauucauucauucuguaaauguuuauggaggaacuacuaaggggaagucacagugugaaagauuaugccuucaucagucucuuccagaaaaccagucuggcaaaguagaaaaagcaaaggauuuagaagucaaaacaccugcuuuuaaaagguccugauggccagcagccauuugaccucaagccacaaccucucugggucuuaucuuacucaucuguaaaaugguuauaauaauacaggacagaguugcuguaaaggcucaaacaagcuaaggcacuuucuaaacuaugcaguuuauagaguuuauaggcuucaaaugaugacuacuacaaugcuuaguaucucguaauaaauauguuucuccuucuccaaugaucagaucuacccagaaagccuacuucaggucuugaauaaauauauauauagucuuggcccggcgcgguggcucacgccuguaaucccagcacucugggaggccgaggugggcagaucccgaggucaggagauggagaccauccuggcuaacaccgugaaaccccgucucuacuaaaaauacaaaaaauuagcugggcgugguggcgcacaccuguauucccagcuacuccggaggcugaggcaggagaauggcgugaacccgggaggcggagcuugcagugagccgagauugcgccacugcacuccagccugggugacagaggaagacuucgucucaaaaaauauauauauauaaaaauauauauaaauauaaaaauauaaauaaauauaaauacauauacaaauaaauacauauaaauauauauauagucuuugcagccacguaagggaaauuauuacuuaaaauaccaagagaagggguauauaggaacucuuuguacuuuucucucaauuuugcugugaaccuaaaacugcucuaaaaaaugaaguauaaaaaaauuguuuuaauguaucagaaguuuuuuauauugggcaggaaucucgaaaaccucuagaauugaacuucauuuucaaauccucuucuauuuuuaaccaaaacuucaacauguccuaucaaaaguaaaaagacugauacuugcagaaugaauagggaggcuaggcgcgguggcucacaccuguaaucccaguacuuuaggaagcugaagcagaagggaucccuugaggccaggaguucaagaccagccugggaaacacagcaaaucccugucucuacaaaacaacaacaaauuguuuuuuucaaagaaugaguagggaugcugggggcaguggcucaugccuguaaucccagcacuuugggaggccaagguagguggaucaccugaggugaggaguuccacaccagccugacuaacauggugaaaccccguuucuacuaaaaauacaaaaaaauuagcugggcgugguagcaggcaccuguaaucccagcuacuugagagacugaggcaggagaaucgcuugaaucugggagguagaggcugcagugaacccagaucgcaccacugcauuccagccugggcaacagagcaagacugucucaaaaaaaaaaaaaaaaaaaaaaaagcaagcaagggcaugauuaugucuguacucaacauacacaaauggaaaggagcacaucuucauaaaacaaagacaaaugggaaaacaaaaaucuagcaccaucagaucaggaagaaagaaagagggaaagggacggagggaggagucagcuagauguaaaaaucagguucaaaaggcacaggaguggcugggugugguggcucacgccuauaaucccagcacuuugggaggccgaggugggcggaucgugaggucaggagauggagaccauccuggcuaacauggugaaacccagucucuacuaaaaauacaaacaauuagcugggcaugguggcgggugccuguagucccagcuacucaggaggcugaggcaggagaaucacuugaacccgggaggcagaaguugcagugagacaagauaccgccaaugcacuccagccugggcgacagagcgagacuccgucucaaaaaaaaaaacaaacaaaaaaaacaaggcacaggaguggggacacucaccuuuuuauuagggauacucucacuucaaaauggacugguuuugagacuccugagccauagaguacaggcuuaaggagaugucccuccagcuaauaccagaaaaauaaacugagaauggauccgaagaaugacaaccgauaaggcuguacacacaagcccaacggggaggagacugaggacucuuaggagcagccaccauuacagcgcagacgguagcaggugcugggcccgcacuccacaugcacauucuccuaacaauucucaugugagcccaaaagggaaagucgaggaauucaggcuguaacagccccaaaccacauuucuaucucaacaccuuaccugcccuauuccaggagagggcaaccagggcaugauguuucaagacgggacagaauggcagugcugguagagcuucuggguucucaagucaucugaugaaaaugggaucauggcccaggagcuuucaaauagccagaaaauagccaguucagaaaaaaucuaggaucugaagauucuacaucgagguuuaugauaaauucuacauuuucugauccuugaaacaaauacuauacacauaccccaagggcuaccuuuauuuuccuacacuaauucuucauccagccuguauugacagaaauggucaaagaaagaccuuuugggagaacacuucaauaaacaggaaaacugcaguccaagcacauacaagucucuggaaaugaacaucuacacugcugaaguggcacuaaagugacaaaugacaguaauccaauggcccaaggccagcaaauuccauugcaaacagauuuaucuguuuugugcgauggugauucuugcauguguggcaguaaauagaaaaguaacagccuaauuacaaauucaaaagcaagcucuucccacuacguuucauauuuugguauaguaccaguaauaaguguccucagcaaccacguuuaaugugccaccugaauaccaggaaccauuaacaggaaguaccuacaugucugaaauuauaucuuuaaaaacaaacaaacaaacaaaaaaccgaaacaaaaacccugauguaacuaauucaauuggagaugauaccacuuuucucaauuacuugaauguuauauucugagcacagcacagugcaacgugccgcuuaggcuuggcauuaaacagcaaucauuaagcuucguaauccuuuucuccuuuaaguuuuccuaugugaaucacugcuuaaauccuaucaguuccacguaacagaacacuggaauacauguccuaacuuuugcuuuagugaggaauuuagaaugugguaggcccgcuuaguauucacuggaauuucagugcgcugugcucucaaugagaugggcucaagagcaugauggugagguccugguacggcgcggcugcucaggccaucuguacaaaccacuaaggcgaccacuggcucacaaacuucucaggccaucuguacaaaccacuaaggugaccacuggcucacaaacuuaaaacaucuacucuuaggacauguuuaaauagcuugcugucacuaugcaaaggaaaacuguuaucuccaaaugcccugucaacauuucaaacaauuguauuuacuucagcugcucauuacuugagauucuaauaaaaauguaucucuuuuaagaauuaacacuaauccagcuguuggcuagaaacagauauucagcaauacaguaacauucagccauaugcuagagggggaauccaagacuuuccaucauguaaaauguggaggaucugcuauuacaagcuaaaaaagagacuggggugagucuaugcagagacaaggacagaagccaacugcaugacauucaaauuggguguaggaagcauuauuguggagauuucacuauaaaugacaucaauaaucacaaauauuuuuucgguguaaggcaaaacuaauagcuucaaauuaauuaccccaaauaauuuaaccgguccccucagugacaaggauauucacuuggaccuacacuucaacuguuaaaguucauuuauuugucuuugcuaaaaugcugaguuaccggucucaaaauguuuccaaauucuucacuauuacacuucaauacagguaacagggaucaaccaacacuuucuaauauuuggaaauaagguuauuaaccuauaaacuuuuuuauuuauuuugagauggaguuucgcucuuuuuuuuuuuuuuuuuuuugagacgggagucuugcucugucgcccaggcuggagugcaguggcaugaucucggcucacugcaaccuccgccucccggguucaagcgauucuccugccucagccucccaaguaccugggacuacaggcgagcuucaccacacucggcuaauuuuuguauuuuuaguagagacagggucucacuauauuggucaggcugaucucgaaccccugaccucaagugauccacccaccugcgccucccaaagugcugggauuacaggcacgagccaccgcgcuggccuguaaacauuuuuaaacuguaacuuuuuccaccucccauuauucucagugacaaauuuaacuuuaacaagucaauuuuaaaauaagaccuucaauuugcaguuguuauucccaacauaaacaaguaauauacauaccaugacgcuuaauaucugauaaacaaucaguauuugcugaaugaaugaauggccauuaaggcugcaagacucuuaggacaguaggcaaccaaguaaaacaaauuuauuaaaacgcucagaaugacuggagcaggaaccaguaacuaaauccugucauacaugauuccauuacuuguuugcauuacuauucuuuuaaaaugaaaauuaugagaaaucggccaggcgcaguaguggcucacgccuauaaucccagcacuuugagaggccgaggcggguggaucaccugagcucaggaguuugagaccagccugaucaacauggugaaacccgucuuuaauaaaaauacaaaaaauuagccaggcaugguggugggcgccuguaaucccagcuacuugggaggcugaggcaggagaaucgcuugaacccgggaggcagagguugcagugggccgagaucaugccacugcacuccagccugggcgacagagcaagacucccgucucaaaaaaaaaaaaaaaaaaaaaaaaaaaagagcgaaacuccaucucaaaauaaauaaaaaaguuuauagguuaauaaccacagcacuccagccugggcaacaagagccaaauuccaacucaaaaaaaaaaaaaaaaagaagaagaaaauuaugagaaaucaaacuauuuccuuugcuacuuucuccaugcuaaaacuuaaaagcauuuaaaucauacuuuaaaagaauaaacccaaaguguugcuaacauuuacguuccgccaacuuuugcuacuccaauuuucuaaagauguguauaacgcuuuagacuguuguauaaaacguaaauacugggacaaugaaugcaaacgaaauuacaauuaaguuuacauauuauccauccccauuaauuaacauuucaaucaaccuugaauugugauugaugcuuauuaaauaaaggaagugagcuaugccuaaagaugcuuucuucaugucaaaaucacaaggaauauuacacauuaauucauaaugagccuuuuacuuguucauaccaauucuaauaagcuaguuaauuaggauuuaaguugagaaaaaagcaaauaucaaaucuuuuuuuuuaacagaaaggucuaaacaaagcuaaauacaccaaaucucuuaaaaucuuugggcuauacauuuguaaaaauuauucaacuacugaucccuuuuuuggcgcaaagaccuacacuacuuacaaaaguaaaugaauaagggaacaaaacguuaaagggggaaauucugaugcaaacuaaacuacagcuaauuuaacaaaauugaagcuugucguaagaucuaauuuuuuaaaaaguuuucgcauuuuagauuccacaacacgcauucauuacaauaguuccgaaaaucauguuucaaaagagguguagucagauugacuucaucugcagaagggcaacaaaacccaauugcucaugaaggguuaugauuuuacucgcaaucaguuucccgaauggcuacuuuguuucauuuccccauauuuaauacaaauacacaaugagaugguuuaaaagugugcaacaauuuauagggaccagaugucaacaaauuagcagucuaaagcaaggcugacaaauaauacaucaugccgauuuuuguccagaauaauuauaauggcggaggggggagaagaugugagagaaggggugggagaggggaauaagagcuuaacucuacacgcacaucucccaaaaagagcucuuucuuuccaccacgggauuauuguaaagggcccccaagcuuuagcuacuguucaggcagggugcguuaguugucagccuggcugggauggauucgugcaagggaugucacucaaacgcaagugaaaguacgguccuugcgacuuauuucgaguuuucuuugcaacagcagcccaaggccgcuacucugcuacuucuaucuaaaaaacagaaaaucggcaacccccgcaucaucaaucaagcugagaaaggaagcucuuggggcaaaggggcaacagggcacccccaaaucucugaggcucgcuccaggcagaggcagcaaccugagcugcucuggggccccugcgcuccaggggacucccggagcccccgggccgccucccccggccggcgcggcggggagggccccacuccacaccccgggcucgccccgcgguccagccccagggagguuaaccccuucggcgcccuccacgcccuccccaagcggggcccggagcccccgcccuucgaccuccccgggacuaggggguccggguggcucaggggacgaaggcgcggcgggcgcggaggcggcggguggcuccggccuaggcccgggcagcgugucccagcgcccucccccacucccacacgcucgcuccgggcagggcgcggacgcccgcccgccgcggcguccgcccgcccggggcucgggccccuuccggccgaaggcgcagaccggcggcuaccugcgggcuguggagggccauggcugcccguuucauugggacuccgcgauccuccggcugcucacgcugcuucccccgccgccgccaucuucucgcccgcacauacacacucgcaucggccgccgcgccugcgcacuggccgcgcgccgcggggcgcggggag

SEQ ID NO: 191980 - RNA, 89530 nt, Homo sapiens
acccacucgcaucccagggcgucuccggcugcuccuauugagcugucugcucgcugugcccgcugugccugcugugcccgcgcugucgccgcugcuaccgcgucugcuggacgcgggagacgccagcgagcuggugauuggagcccugcggagguaagugugauuuccaugcuucucccuuuugcaaacuguuacccccccgagaagcuggaauaacuaggacagaugccaccucgcagggcugacugugugcuggcaccacaccgagugcucugcuugcauagcggaacacagcuuugcgacaugcccuuuugcagauggagaaacugaggcucagcgaggacaacucauuuguccaggaccucgcagccaggacuccaaggacccaggauucaacgccgaucugagcgcagaauccugcuccuuagaggcuguuuacucucuugccuuccucgugcaguucacuagcauuuguugcauuccuguguucguagugggugucaauaacuggaaagcugauggcauggauauggcaggcauuagaauguguccuacucaugucuggaggaccagggugaucuaguggcaugugcauucagcugcaguuuagagggccacgccccucugugauuucauuugcaagguagccuucuucccacauuucagaugaagaugcugagggucagagaggugaaguaaguuguccgggcagagccagggcuggaacccagcucugucugucuccagagcuucaaauggauguguagagacuuggggccaugucaggguucugcagucugggggaacacguuucuggguuucuuuagccagagcgggcaccugcauaacuccugcguggggagaguuacccuggaagcggagggcucacucuggagugugggggagaucggucgucccacguggacagagccagggcuagucccucaugugcugcagacccagagccucccuugcuaaggcugggcugguggacaagccagggaggacuucgcugaugccugcucaucgcaguccaacuugaauugggcgucucucagccaaaaugugaguugcugcccuggcugagagaagcaucccgugcaaaugccuagcuugccuugcaaccgagagugggguugugaguuuccccuuugggccuuuggaccucuugcccugguagaauggggugagccugcuuuccccauccagggucugaugucugacagugaggagagccugcagaacaggaccggggcgugguccuuuccaguagacugaggccaugaguugugacugucggcugucccagggcuccuuggguuguaugcaccugauuuucugcuucugccccugaucuggcuguucccacucaggagaaggggugggugugugacuguguugccugugcggcaggcacgcggucugugccacgcaguuuaccuguauugucaucgcugcaacaccccggggaguaggccucuugaugcccacuucacagcugaggaaacugaggcucagcaaggugaagugcuugccuaagaucccccagcugguauggaaugcugucacccccagguggguccuaucugcacucuugacccugcuuucuuuaagacacuucccugcccacugccaacuccacccaugaaccugaccuucacacaggugauguuuugucuuacaggggcuccaguuaaaaccacuggacaauguacccagggaggagaaaccaagagggugauuuugauuuuuucagaguuucuuaagaugugagaguaggaauaguaauaaugccauuuguaauaauacaagcagcugacauuuacaugaugcuuaguacagaccagacaugcccaggguuuccacggaugagcucacugccugcucuauuagcugggcacuuuuuacaaggaguuaguugaggcucagaauuauuaaggugugugcccaacaugacacagccagggcgggguagagcugccguccaggcugggcccugccccagauucugggggaaggugcccaucuaaugaccagccacaugacugucccagcagagcuugcugcuaguugaggcuuucugugccaugugggaguuuuuuuaacguuggcagggaucugggucccuggucccuguuggggugaggcugggaggggaucaacugacccugggcuugggcucaacauugcugacagguacugagagccccgucccaggacccaaaucagugcugguucugaguccugccucuguccuggagaggagaguugguuugacugggaaggccugagcuagggaagaagacugcgaggucucuuaaaaccucugcacuucaucccucaaaagaccacaaauuaaguauguggcccuuuguaaguugcauuugaaaguuuuuggaggcaggacccucugacgucuuuggaggucagaaaguuuuuggaggcagggcacugaccucuuuggccugugggaacuggaacuuuucuuuccucugucaccagcgucauuugcugugugugggaggugucugcaugucugccugcgccagacucaggaggcuuuuucuuucuuuuucuuuuuucuucuuuugcaaacgcacugguuuuugaucagucccagaugugcaaacccaggaucacucaaacgggcugacggcuugucaggaaaggaaaauucaaucugggcauauuucacuucgucuucaguucauugaguggaacagaugcucagaccuuccagggacagggaccuaaagcacguuguaaagucuuaaauagagcacgcugaguucugggacaggcaagggacagguagaucuggguggugguuaauaggaugggccauguucuguuuuucuuuuuccugaaaagauguauugugguaaaaauacacauaaacauaaaauuuaccauuuaacccauuuugaaguguacaauucaguggcguuuaguacauuggaaguauugugcagccaccaccacuaauuccagagcguuucaucaucucguaaggaaaccccaggcccauuaggcaucauucgccauucuccucccuucagccgcucaucuccuuucugucucuacgaacuugcuuauucuggacauuucauguaaauggaaccacacaauguguggccuuuugugucuggcuccucucacucagcaucauguuuucaagguucauccauguuguaauguguaugagaccuucguuccuuuuuuauggcugaguaauauuccauugcauuaauagaccacguuuuguuuauucauucuuccacugaaggaaaucugggcuguuuccaccuuuggcuuuuacagaggcuucugcugugaacauuuguguacaagguuuuuugagggcggauguuuucauaucucuugaguguuuaccugggagggaauugcugggucauaugguaacuuuauguuuaacuuauugaggagacuguggccucuuuuuugaguuccuucuugaagcaucaacucaggucaugucauuccagaauguguugcuggccuucuccaugggugcagggaagcccuggcauuuggcauuugugggcaguguuggcgugccaccugggucacagcagcagcaggcagggaauccugagacaucgcccugggggagcccugccuucuaccccaggcuguacaaugacgaguacucuuggacaaagaccccucuugcaaggcugcgaggacaucaugguccagcccgagggagauuuaucuuugauugucuugagugcugcaucagcuaagacaaaaaccacagagucagagggaaaaaaaacguccugaugaggauugugcaauuuccggaccaucauuuuuuaaaaauuauaaauuaugaaaucccacauuuucaaucccaauuucuggaacguguuuuauuuugagcacagaauggcaacaucccaggaaaaaaagucaugcucccauuuugcuuguaaucaagugagcuggaacugacccuaccccaaauauuuuuugaauagggaaaagacucaacuggaccccucuaaggacugggagcuggcauggagcuggcaucuucugagacugacuugagaagagccugauaacgccuagaggaaacaggcaggguuuugcgagcaggggaagaugauaguggguggguggggagcuggcgagggugccccaggcagaggcaccgugugugugcaaaggccugcagguggagaagggccugggacucuuggagaauggcaggaaguuuggugugccuguagucuacgagccaggcucagggcagcaaaggucuguccugcagguguugugaugagcuguaccacuuagugggcaccaucaagaugaacagagaguaacacgguggcacugagaacuugagaacagcucacucuagaaugaacuguguccuccaaagugugcagagccaauaccuagggguccccaaggugacugagcacgggcacagauccagcagcaaauccccccaguccaagagcuguucuuuccauucucuguucuuuccauucucuguucuuccgguccuucugcuuauggcaaggugaaagucacagguggaauugucccuaucaccucucccacacccugaucuccuuuuacaacaaagagcaagcauccucuacaacaaagccuuugguuggugucagugccuggcugggaggaaguaacuguuguuuuuacuguguuuaauuucacuccugccgucuguucacggcaccagugaucagguucucugccagugggagugauagaaaguuaccuuuuuaaaguaaauuucuuggaacgcaaaaaacaagccaaguuaaauaaaaauacaaaauauggggccaggcgcgguggcucaugccugucaucccagcacuuugggaggcugagacgguggaucaccugaggucaggaguuugagaccagccugaccaacaaggugaaaccccaucucuacuaaaaauacaaaaauuagccgggcgugguggcaggcaccuguagucccagcuacucgggaggcugagacagaagaauugcuugaacccgggaggcggagguugcagugagccgagaucacgccaccacugcacuccagccugggugacggagcgagaugccauuucaaaacaaaaacaaaauauguacugguaccaguacacaguaggaaggugggcaaaacuugggaagggggauauucaaaggacaggguuugggaaaugcuggaucaaggucggggaagaaggagaacugagaggcuguuauaauuuagagaagugcuucucagagugggggccagcagccaggcgccguggcucaugccuguaaccuuaacacuuugggaggucuaggcgggaggauugccugagcccaggaguucgaguccagcuugugcaacauagugagaugcugucucuacaaaaaauuuaaaaauuagcugguguccucucagugugucuuguccucuccauguuucuaaaauaaaggaagaaaggcccagcgcaguggcguacaccuauagucucagcacuuugggaggccaaggugggcagaucacuugaggucaggaguucgagaccagccuggcuaacauggcaaaaccuuguuucuacuggaaauacaaaaauuagcuaggcgugguggugcacgccuguaaucccagcuacuugggaggcugagggaggagaaccgcuugagccugggaggcagaggcugcagugagccaagaucacacacugcacuccagccugggugacagagcgagacuccaucucaaauaaauaaauaaauaaauaaaaauaaauacauaaauacauaaaauaaaagaagaaaaaaaauuagccagccgugguagggcacaccuguaauuccagcuucuugggagguagaagacuugagcccaggaggcugaggcugcagugagcaguguucacgccacggcacuccaaccugaacaacagagugagacccugucucaaaaaaaaaaaaguggguuccuggccuggaagcaccugaggacucauagaaaugcagguuuucaggcuucccuggagaccuggaucagaagcugugggguggggcuggcagucuguuguaacaaagcauccuguuauccuagaaagcuaaagaaggcuugcccuggggcccuggcacaaagguggggcauggagggcuggcuacuggggucagcguggagcuguguggacgguucugguuauagggccuggugugaccagaaagaagucacgagugaccugggagcugaaagaccaccucccuccaaaaucaggaaggccccuuaagaacaaguuguuggcauauuuggaaggcuuucuuccagaagaacacucagcccuuuggcacuuugugcugaagcugugacgcccugaugcuccagggccugagucaguguccugaggaugcuggcacccuccuucagagcacguuucaugccccuaugugccugggaagagccagcuacgcacauuuacuuauaaccccugaaggggugagcuguuuccucaagggcauugaagacaccucuaugauguguguccaucuucccugccaucucucccuccugccccaggccugcugcccacacagccaguccguucgccccgggagggaagacacgguuuauuccccgggaccugcgaggcuggggcugcccugggacugagaagguauuuucagcugggccuuggcaucgcaggacaaagugcucucucagacuugggaugaacugggcccugucuaggagagucgugugcggguccaagggggaggccccaccgccagcuggacuuuaucuggggccugacacaucgcaguucacuuugaaggcugcugagccggggccccaggccuguuucagcucugagacuccugagggaaaggccccgggauuuucucuugcauaauggugugcucucuccuuggaccacuccugcccucuuaauccagucuucaaacagaggucagagcaacaucaaauuuuuuuuuuuuauaauuucuuguugaugcuuaacauaccagggaagagggcacagccgucucuguaccggcagagagauuuucacaaagcgccguagccccggucacagcagagccuggccggcccccagaagccccccaggccccucucacugcccccgcaccccccaagguagucauuuccggacuucuaagggcacaggcuggguuugccugguuuggacuugacuuaaaugaaaccaugcguguugaauccccggagucuggccccuucuguugguugagcaccgugucugcgggguuugucugugcuguuguguguugcaaggcuuuugcgacacaaaccagacccugucaccgcccgacuucccucccucgagggcccucuuugcauuuagagcaaaaccaagaguccucaccguggccuucaaggcugcucaccaccuggcccuggcugccuccugaccccauuccuccccagcuucaugggcuuuucgccuguccucggucacggucacgccucgacugugaccccuucugagccuuuguccuugcccuuccugcugccugcagugcccuuucuuuuuuuuuuuuuuuuucuuuuuucugagaaggagucucacucuguugcucaggcuggacugcaguggugcgaucucagcucuuugcaaccuucaccucccggauucaagcgauucucuugccucagccucccaaguagcugggacuacaggcaugugccaccacgcccagcuaauucuuguauuuuuaguagagacaggguuucaccauguuggccaggcuggucucgaacuccugaccucaggugaucugcccuucucagccucccaaagugcugggauuacaggugcgagccgccgcaccgggccuacagugcccuuucuuuaagagcucagcaggaccuugccgucuaccccaaccagagugguucugccccccuccucuguucaucuucgccauccguguguccgggauguccugcucacaccuucgguauuuaccuguccgcugcccguuuguuuacucucugucuccucccagucccgagggcagauucggucuuuuucacuugcagaucccaaggacuccugggauuuucaccugcagagugcuauggagguuccgcagccagcucucgacucaucuucgcggaugccaccugucagugaaucacgcuucucaggcagggagacuggcccgggcugccagcccuggagcccagcacagagaugaccuggggcccugaauuuacucaggaggagaagggaaagaaacaucauuaaacaccauuaaguuccugggauucugucacugggcccuuuauaaacaugauccuggguagucauagcacccuuccuccccuagccauggaagaaacucagggccucaugcaugagugaggaauuagaggcuugaggaaguugaggcaugcccagcuccaugcaguggcggcagaauucgaacccagagcugcccauucuucucuaugccuuuccucauugccuucugggaguccguaauuccuuucccuucggagagggagggcuccugcuguuuaucuuuuaaagcuuugcugggaacauuguuuccagggaaacaaccacacgucuucaagaagggagaaaggugccccaggaguuauguccugggguuuuaaagaauguauuaauuuauuaccuggucccuuaaaagugacuuuucuuauauaucaccuuggcuugcaucgaaugcaccugcuuuucaguucuuuuuuuuucacauagugcauuaaauaagaguuuguugaaugacuauuuucuuuuuguccagaauuuuguauaugcuuagcauaguauguaaacaaugaaaagcauuguauagauuuuuugcucaauuaagcauccagacauauugacucagaaaucccauaagaauauaucuuuuguuaauuagcuggacgugguggugcgugccuguagucccagcuacucgggaggcuaaggcagaagaaucgcuuaaacccaggaggcagagguuccagugagcugagaucuuaccacugcacuccauccuggggacagaacaagacuccgucucaaaaaggaaaaaaaaaaagaauauuaucuuuuguugaggugacaggaggagagaaggugccuuguggggcuggugucgccuuuaagcugaguggacuguuggcuguccuggggagauggggaauucagcacagugcaggcagcagcuagggaaggagcuggagcuggacuguggccucccuugggucuggcuucaauccugccaagaaggguuuaaggaaaacugccaggcugcagugaguaggggagaaagggcccccacucacugcguggugcuuacccaggcgcucuaacgggauguucugcucagucaagggaucugccagagacacaaacggggggaguggaguaccccuccuuccagccacugcuucauuccuggaauuucugggugguuuguggguaugacucugaucugcccuuggccucuugcucagaucugaguucuccuuugauacuugugaggaaggguagagccuagagaacaccccgacccccaggcuucuggggucagcugcucuccuguggaccaugggucucagcugaguggugcagggccacaggucagaacugcccugauguuuaagagagucgcugcguggacgacccaggacugguaagugaccagggcguagugaaugaaucgacauuguccucaggccuuaugugugaccacaggcaaguugcuuaucuuuuuuaagccucaguuucaucgucuguaaaauagggcuauugucacaguggccucaucaguuuguggaccacaugaaauguucagugcaggaguagagggcccaggccacgccugcggcagccccuuccucaucccacguuggcguggguuuggugaugaacauuugcugggggcauaaaguugauugaacaaggcucagugcuggccaauggugaacugcagccagcuuggacuggcucauaccagcucuugagagcugauaguuacauuuucagggccagcguaguggcucacaccuguaaucccaacacuuugggaggcugaggugggaggaucacuuaagcucgggaguucgaggguggccugggcaacauagugaaaccccuuuucuacuauaaauacaaaauuagcugugccugguguugcacaccuguagucccagcaacuugggaggcugaggugggaggaucauuugagccugggagguugaggcugcagugagacaugauugcaccacugcacucuagccuggguaauagugagacccugccucaaaacaaauaaauaaauaaaauucaguaaaaaauggauugcgaaccaguucaacacaaccagcauuaaacguuagauuauaaaaacuuacaguuaaguuauauuccgggcaugguggcucacgccuguaaucuuggcacuuugggaggccgaggcggguggauugccugaggucaggaguucaagaccagccugaccaauaugggaaacccugucucuacuaaaaauacaaaaauuagccaggcgugguggcaugcaccucuagucccagcuacuccggagguugagacaggagaauugcuugaacccaggcgguggagguugcagugagcugagaucaugcuauugcacucuagccucagccugggcuacagagugagacucugucuuaaaaaaaaaaaaaagucauauuuaaaaagaagguaauaaauacuuaaaaccuaucacuuuugacuuuuuuccugcauuuuacuguggccucugcucuugagauuaucagugucuaugggaucugcgugauggaaaggcugcgugaccgugugcuucuggggaucucuuuccagaaacuccaugcucggugacuucacacugguugcuugaaguuggccauggugggaguauuuacaccaagggaauuggcaaacaccgcaaggcaggcugguuuuugcuugguuuuuguuuuggaagcugguggugaacgauuuaccaucccaccacuguuccggcccuugagaagcucgggguccagggagggaggcugagagucagagcggcugcaauccuggguggggagcccagggccgggggugcccaugggccugucaacucagcugagacgcagccauggaagaggacagagcuccaugacagaaaaugacaucugacaggauaaccucggugugaaucaccaaauacauuugcauggguggcaccuggccagguggugacaugaaucccccagaccuggcacaugacaucuuggacaucuggggaaaaauggccaaugcucaagguauauacagagcuaauauacguuucaaauucaguagagggucccccugccaucccccaagcauuggacauuuaacagauuuuuuuuccuuuuuucuuuugagauagagucgcccaggcuggaaagcaguagcacgaucuacagucugcaucucccaggcucaagcgauccucccgucucagccccuccacgaguagcugggacuacaggcauguggcaccgugcuuggcuaauuuuuuuauuauuauuauuuuuaguagagacaggagcucaccauguuucccaggcuggucucaaacuccugagcucaagcgauccucccagcucaacaucccaaagugcugggauuauagaugugagucaccgcaccuggccuaauaggauuuuuauuuuuuuuaauuuuuaaauuuucaaauuuuuuauuuuuugagucuugccgugucacccaggcgggagugcagaggcacgaucucggcucacugcaaccuccaccucccagauucaagugauuuuccugccucagccuccugaguagcuggaacuacagacacgcaccaccacaccuggcuaagguuuguacuuuuaguaaagaugggguuucaccacauuggccaggcugcucuugaucuccugaccucaggugauccacccaccuuggccucccaacguucugggauugcaggcgugagccgccauguccagccggauuuuuaaacauuggauuuuguuaagguaaacgugggcuuugaaauaauaugaagagagaauugucuguucauagcauuccacauuauucacuccagccuucuaaaaucccuucaaacgaugcauuuuuggaggcucuggcacagccuccuuauuauaacaggcagugcacugacuggggacugaaguucaggaccuuuuuccuuccucacagccguagggccugucacuccccuccacccacagacgugaacucaagaagcucggugcuguguccaagaugacacaggcuugggcaaggccaagggccagugaggggcaaggucaagaauugaacccaggucucucuuccccgacagcccaugcugcagucaguaaagaagcagcccaaaucagacguaguccuuauauggcuuuucugaucuagcugggagcaggagggggccacagagucaucccguaaauauuuaucaaacacugacuuagacaucgacgcuucggcggugaacgagacccgcaggucugcggugugauuacacuggagguuucuaggaagccgugcuccucgggcugagucuuagcaaugagcaggaauucaucucccuggccugggccagugaagcggggcaugucggggucaugggaugagcugugggaacagcaugugcaaaagcagggagcuuggcacaggcugggagcugacggcugacaggcuaagucccgagauucaucuuucuggcagauucuccuaaacacaaggcacuugcagcccaggccaaugacgcaaugagcuucagcccagcuccuucucccucacucacuucugaguguugaguacgauggcgcccaagagauaaccaucagggagaccccucgcuaaacuuggacacaugguuuggugauccccuaaauguccacaaagccucggccaggguagaggggugcgguuggagagcucauagugcaaacaagcuguguugaaaguccuccaaacuuuuggcaaguuugaguucaagucuugguuucacuuuaaacuagccacacagucuccuaaaugccagucuccuggacucaguugcacuuucuguaaaauggggcugaaaacagcugccucccugcuagaguccaaaugcaucucaaagcucugggcagcgcgggagaaguguggcucccgucgcuuugauucgccagcugugggucucaccauugacccugggaccugaaagcucuguccguuccccucccagccucugcugugugcugaaaucugguguguuuucaugaggucucggagccguuaucuuacuuguggucuuaugggcucaguuuugcaacucuggcaaaagagaacaaaaucuucuagagagcauuucugcuguguugucccgcggucccuagugauauuucauuaucaaugaguggcugaguggacaggaugcaggggcaucucucuaggaguggcgcaugcacccggcccugccugggagcaucagggguagaagagcagaguuagagugggagccucacacccuggguaccgaagugcacucggggcagccaccaaagcgugagcucuuccaggacgcuaggagggcacucugcagggggcauccaucugccagaggucagaggucagagaucagcucaucauaucugggucaaaggcgagugggcagcaccgaugguggugggggggcguguuuguguugguggaacgucaccaugaugcgagggucuccgucgucucccaugggggugacacguuggugccuucucaucaacagaggcaccacgugacccgggaggcccgugcccugacucccccagcccagcagccuucccaggaggcagaagaggguggaagagaacuuuagggcaagauucgguuguuugguuugggagcccccuucccccugcauggguuggugggggugcuugggauuuucacauccagagggaagcccacuccgugggaggcagcagggcacuaagccaagggcauaccugggccucgagguuagaagagcugcguuccggcuccagacuugcugcucgcccugggcagguuccuuaaauuccauggacuucagccuccucaucuguagagugggagugauggagcccagacucuggaaagucaggagggugagaggagaucacggaggucaggcgcucacaccacgacgggcgcagggcaggucuuccccggcggcccccuucgcccugaggguugcuggcgugagccccuucuugauguuggcaagcccgggaccacuuggagguccaucccauuuggaaagaguuuguguguuuucauugucaauggaaaagggguggaagugcuucggucccgguuccgacugagcugucucagaagugaggguagaaugggcagugugggccagggcugccgggcacugccccugugaacugggccucggccaauugguuuguggcuuuggcagauggcaccaaccagguuccagccaggacccuggccuggccuccuaacgugccugucugccuccuucgugucuccucuuuacaauagccaggggcauauuuggaaacaguccuguccagccauguguuaucugauguguguuggucuguuaagccggcuacagcaaaguaccacaagcuucaacaauaggaauuuagauucccacaguucuggaggccagaagucuaagaucaaggugcuggcggggcugguuucuucuggggucucucucuguggcuggcagacggcgucuucucccuguguccucauguggucguccucugcgugucucgguccuaaacucuucuaguaaggacaccagucagcuugguuagggcccaaccucauggccucacauuaccuuaaucaccuccgcaaaggccccgucuccaaauacauugcauuuggagguccuggacauuagggcuccagugugugaguuuggggaaaaccagcucaaacccauagcugugugcuuguuccugugcacccagcacugggcucuggggguacaaacuggaaugaggugcuggcccuuuuaugguuacuuuucuuuuuuuaauuuuuuugaggugaaguuuugcucuugucucccaggcuagagugcaauggcaugaucucggcucacugcaaccuccaccucccagguucaagcaauucuccugccucggccugccaaguagcugggauuacaggcaggcgccaccacgcccaacugauuuuguauuuuuaguagagacgggguuucuccguguuggccaggcuggugucgaacuucucaggugauccaccugccucggccucccaaagugcugggauuacaggugugggccaccaugcccggccuaugguuacuuuucugcucaaaaucugcuguguucuccugcggcccaaauguaguaggagccauccagaucuggaggagccucauccccucccaagcagggacccuccgacccacccccaggcccucugggcugaagucaaacccaaccacuuucagacccaacaguacuggcacaccacccagcauggcaggccugugucucccaggcugguggcuuuuguggugcacaugagggcacuuggagaaacccucccauuccucuccccuuuuccuucuguugucuuccaauguggagguuucacuaaaccccgugguucucccaacucuaaagcuccaccugagacuucauaacuucucuuuggaauccuuagagaaggaccagccucuaagcuguggaagucccuuuaacauucagaacaaaggcggccagucagaucuccugggauagcucacgcuggcucaggaggacgugccagaggacucauuuaaaaacagcauuugacuccuccuguuuucucacuuuggcauuuuguuuuauuuuguuaagcacagguuggcccucccugaucugacaauccaaaauccgaaaugcuucaaaauccaaaacuuuuugagcacugcccugaagccacguguggaaaauuccacaccugaccucaugugauggguugcagucaaaacauagugaaaacuuuguuccaugcacaaaauuauuuuaacauguuggaugaaauuaccuucaggcuacauguauaagguguaucucaaacaucaacaaauuuuguguuuagauugggucuuauccccaagauaucucauuauguacaugcaaaucagcggagcaucgucaugacaccaggaggacaccccgugacgccgauuaccgcacucucaaccucaacccagcgucagaguuuucuggcaucucuucuuugagccuggccgccugcagcuggaaaugcucauauaugguggugugacuaaccugagagagagagaucagggauccugagaaguucugcauucuuggucugcuucccagugggacgaguaagcacgcagagguccuccccacgcagccccgggcucggcuuuggaggagggcagcccgucugcccugcuacaaagcaagccaagccucuccucuccgcaugggguuauuuuugucugaggcgcaggcucagucaggacccuggagaguuuccaggggucgggaaugggaaccacagcauucccauagcucuuuggcucagccucugucgccuguugccaacguuucugcuuccugggaugcccgucuuggccucuauccccuccaggccuugaucuacaucuccccaccccggccccacccgaggaugcccaccuugcacugccacugucccagccaacuugacugguaaacaccugguuggugcuaugggggugaagaccagggaggacucaugugaagaacugagccccguggaguuccgacgggucagccugaggcacggccaccacccaacccuccagacagagcugcuucuuccggcccucgagggccuggcacugucuuuagagucagccuuguccugcuauguggggacugcggguuuccuccuccaucuccccgaccuaacugagcuccuugaggccagggacagaguccucuucaucuucgcauccccagucuccaucucggaguccagcacaaaauaaggcgcuugauggaggugacuggguggccccgacucuccccugcgaggaaagcagagaggaggggugugcguggacgcacucguucaagcccuuccuugucuucuugggccaaugacauacauuuuucagauggcaagccaggaggaggaggucugugguucgugacccuauaauggaggggagguaguuggcccccagggacagaggagucaagguagcuugcuggaaaacucugggucuuuguaaucaucauuucgaauuucagcaucucugcuuaccaggaggccggcccugggcuugucuugucaccacacuaagccauagcuugcuuuuuuuuuuuuuuuuucugagacggagucucgcucugucgcccaggcuagugugcaguggcgcaaucucggcucacugcaagcuccgccucccggguucacgccauucucccgccucagccucccaaguagcugggacuacaggcgcgugacaccacgcccggguaauuuuuuguauuuuuuaguagagacaggguuucaucguguuagccaggauggucucgaucuccugaccuugugauccgcccgccucggccucccaaagugcugggauuacaggcgugagccaccgcccccggccagccacagguuucuuaucuguaaaauggggaugagaacagccugaccuccuggguugccauggugauugagaauaacauaaacgaccggccuguguaggugcugaugaaggguuuucugagggaacaaaaggcugaggccuuggcuggacgugguucugggcagcugugucuuagugugcaacagaugugcggguggggcccggggcgagggccgugauaagaggagccauaugucaaccacuauugguaaacugagucugacuucacagggacuagaaguuugcucucaacguugguccacggagcauccuuuggugaugggaaaugacuuuagcaauccccuuggggcaggugauagaagcuaauuugugccugagauucaccugaguccugaaugaauaagagaugcugacucauaauuagaaaaugcagggacucgcucaaggaaaacuugaguccaggaagaacuguucuagguuauccucuuuggaauccugacagcuugccucgcuggaaacccuuggcguaaaucccagcuccaccacuuccugucugugggaccuugcuuguuuagcuucugugggccucaguuuccgcaucuguaaaauggagagagucgugugugcugcguucgcugcuccagccagcgcugugaccggcuccuacuaaugcgacuucucccaccacccucugcuuccuuucagagcucaagcgcccagcucugcccgaggagcccaggcugccccgugagucccauaguugcugcaggaguggagccaugagcugcguccuggguggugucauccccuuggggcugcuguuccuggucugcggaucccaaggcuaccuccugcccaacgucacucucuuagaggagcugcucagcaaauaccagcacaacgagucucacucccggguccgcagagccauccccagggaggacaaggaggagauccucaugcugcacaacaagcuucggggccaggugcagccucaggccuccaacauggaguacauggugagcgccggcuccggccgcagaggcuggcaccggggguggggccugggccaccagccugcucuguuccccagccagcucuguuccccagccagugcgugugauggcuggcucagggucuccucuggcaggggaggaucccggcucuguucuguuuuguuuguuuguuuugagacagggucucacucugccacugacgcuggagugcaauggcacaaucgucaugcccugaaaccuuagacucccgggguuaagcgauccugcuucagccucccaaguagcuggaacuacaggcaugcaccauggugcccagcuagauuuuaaauauuuuguggagaugggggucuugcuacguugcccaggcuggucuugaacuccuaggcucaagcaauccuccugccucagccucucaaagugcuaggauuauaggcaugagucacccugucuggcucuggcucuguucuuaacauucugccaaaacaacacacguggguucccugugcagagccugccucguugccuucaugucacucuugguagcuccacugggaacacagcucucagccuuucccaccuggaggcagaguggggaggggcccagggcugggcuuugcugaugcugaucucagcugugccacacgcuagcugcaccacccugacuucuccuuagcccgugugagccucacuuuccacuuggagaguccuuccucgcgugguugccaugacugugagauaagucgaggcugugaagggcccggcacagacugacccugccuccccaaccccuaggcuuugcuaaccgggaaaggagcuaacggugacagaagacagccaaggucaacccucccgggugauugugauggguguuccaggugugguugggcgaugcugcuacuugaccccaagcuccaguguggaaacuuccuuccuggcugguuuuccagaacuacagaggaauggaccacagucuuccagggucccuccucguccaccaaccgggagccuccaccuuggccauccgucagcuaugaauggcuuuuuaaacaaacccacgucccagccuggguaacaugguaaagccccgucucuacaaaaaaauccaaguuagccgggcaugguggugcgcaccuguagucccagcugcagugggacugagguggagguggagguggggggugggagcugaggaaggaggaucgcuugagccugggaagucaaggcugcagugagcugagauugcaccacugcacuccagccugggugacagagcaagacccugucucaaaaaaaaaaaaaaaauccacaucucccccagagucugagucuuugccacuuuguggguacaggcaucaucaugucuuuggaaugcacccauggcccccugcugugauugcucugagagacacgcugccgucucaucugugucuuuaaagcuguggucacguuccuuugccacaggcugagcuggccugggugaugacccgugucucccccacaaagcugccauggagggucguggcaugaggguugaguggcuauuacgugccacgugaauuguguccucuuuaauccugacaguaauccuggaaaauagaaaguauuagcaccaauuugcagaagagaaaacugaggcucagagagguucaucuuuaaaggacuuguacaaaccacacagcuacaaauguacaaauggugaagcugggauucaaagccacccugucuguccccaaaaccugcacauagaaggugcuaauacguauuuauuguuucuguuuguuuguuuguuuuugagacagaguguugcccugucguccaggcuggggugcaauggugccaucucggcucacugcaaccucuggcuccuggguucaagcaauucuccugacucugccuccugaguagcugggauuacaggcuugcaccaccacgccaggcuaauuuuuuguauuuuuauuagagacgggguuucaccauguuuguauuuuuauuagagacgggauuucaccauguuggccaggcuggucacaaacuccugaccucaagugauccacccaccucagccuccgacagugcugggauuacaggcaugaaccaccgugcccggccuauacauauuuauugaauguguggguaggaggcucugcuucucugccuuccacauaccugauauuuaaucaacuggugaauucuauguauuuuugagugccucccgugugcccagcaccccgugagauucuugcuauaaagagguggacaaagcagaugagguccccguccacacggcaccuccggacuaguguagccaggaaguauuuguggagcaccuucgaugugccaggcacuguccuggauucccggaagaggcaugauuaugaguugugcagaguuagaugaagaaauacggggagcugcaagaaagaacguuagggguggaagaauccugacugagagggaggaguaaggguggcccacucugcggaggagccaucucaguuaagaccugaagagugagcaugguugagcaagcaagcgugcagggaaggguguucugggcagagggaacagaaggugugaaagccaccaccgccucgugagucucuuuccuuaacgggagaaaagcuucgggucucagaggagcucucaaaaagccagcagggccauggcucauuucugagggagugaggccauuggaagaggucagagaggcaggcaggggcaaaucacacagggcuuugaggcuaggugaggagccugccuuuuuuucuaugaggaauagaguuuugguauugcugaaauggggguaaaaaagaaaaaaaaagaaacaggguuuuuuugcgggagaggaugcauuuaugacugugaagcacuuuuuuuuuuugagacagagucucgcucugucccccaggcuggagugcaguggcgugaucucggcucacugcaacccccgaccccuggguucaagcgauucuccugucucggccucccaaguaguugggauuauaggugcccaccaccauggccagcuaauuuuuguauuuuuaguagagacgguguuugccauguuggccaggcuggucucaaauuccuggccucaggugauccacccacuucagccucccaaagugcugggauuacaggagugagccacugcgccuggcugugaaacacuuuugcugcugugcgguguuggggauuggagggcgcagcaggaagcagggaggcggcucaggugacgggcaggugaggagugacggggcgguauuugggcgggaggcggggagugaagaacaaagagccguuccggagaccugggaggcauugcccaugggucagggcuacacugguuuucuggcugggcuuucugucuuucuccaagcucuggacacaccgcaccgugagaaaggcuccuggaagcagagcaacccugcccgggggcuguuucugaaggggcagagcagaggcuggaaaaccugcaagccuucccucagagucacugcguucccucgugccacgcuccccuccucuuccaagucaguuagccucccucccucccucccuccccgccugccugccugcccgcccuccgucccucccucccucccuccuucuuuccuuccuucuuuccuuccuuucuuucuuucuuauuguuuuuuuuuugagacagauucuagcacugucgccuaggcuggagugcaguggugcuaucucggcucacugcaaccuccacuucccgguucaagcgacucuccugccucagccuccugaguagcuggaacgacaggugcgcaccagcacacccggcuaauuuuuguauuucugguagaggcgggguuucaccacguuggccaggcuggucuugaauuccugaccucaggugauccgcccaccucagccucccaaagugcugggauuacaggcaugaaccacugugcccaaccuacguuuuucuuuuucgccgccaauuucugagagcagagggggcuuguuggaacaugcuguugggagaguugcuuuaugagaaaugaaaggaaaggggccaugggaacguugagacccauugaauccgcgcaucccugguggcuuggccuugguccucauggggcagggaggccccacgucucucuggagagguugucagcaucugggacuggagcuugacugagcugcgacccccaggaucccagaugcuucccgccucccggucuggagcaggcuggguucaugcuggucuucuugucccugcacugugugguccucccgguuucaugcaagacuuagugccagugaaaggagcuucuuugcagcagggaaagucaggccgcccgggcagcccagagcaggccuuucauguuuuccuguuuguuuacuuggugauguuucaggauuggagcugggaucuggguccuuuggucuaaaaggccggccugcuggggaggcugagccuucauggaugcuacugaggcuaccucggagcaaggaggcugaaaggaugggguggcaggggcccugccacucagcccggcacccucagcacugcgcugcauugccccucugcucugguucacacccaaacaagcaaugcagauuugagaaagcggcuuggaaacguggcuuccugcucaacccugccugcuguggcuucaagccacaguccuuugaaacagccuuagcacugaaagguggauucuaaaaccccaaagaguugagcagcccguucugagguuuuaugaguggacaggcucuggagccagccugccuccguccagccagcucugucacuggccagcuuugugacuucgggcagauugcuuagccuuucuguuuauauuuccucaccugcaugaugggaacaagaaacccuuucucauaggguuguuuggaggaggcaaugagauaaugcauaaaucaguuccaaguaaaugugaaugaugcuguuaucauuuaguauauugcacagucagcauguugcauuagcauauuuuaguaacuuaugauuuucgugggaugggucuggcacuugguuacaguaugcaaggcaggaagagcccccuuaguagccagacaagaggggguugugaaagacuuccugguugugugaccucaggcaugcuacuuaaccucuccaagacucaagguuuguugccccuuggcuguugaggagucuugcugggacacggggagagagggaagugaggcaugcgguuguguugggcagguacucccugcuggggggucccagggcuaagacaggacugucuucccugagcaucugcugugugcccggggcugggugugcagagggcaggaggccagccucugccugcuuaaagcuggagcaucugucgggaggacuccagggaggaagugcagcgucagcugccagcugugccagggcugccuggcaucuguuccuccacagaggagaaaggacacgcuugcucuguucauggaauucucuccccaggagucauguguguuccuggggccagccugucuucagagucucugcccagaccccugcucaggccccacugauucaggaugggccgugcugggaggugagcagggcugggcaagcugaagacgucucuugucaauuucuucucauugugguaaaguauacggacuauaaaauugaccauuguaaccauuuuuaagugugcaguucuguggcauuagguacauucacacuguugugcaaccauccccgccauccaucucuggcacuuucuuuucuuuucuuuucuuucuuuuuuuuuugagacagagucuuacuuuguccaggcccggcuaauuuuuguaucuuuaguagagacgggguuucacuauguugggcaggcgggucuccaacuccugaccucaagugaucugcccgccucagccucgcaaaguucugggauuacaggcgugagccacugcuccgggcccaucuccggcacuuucuaucuuccaacugaaaugcggcauccauucaucucggggcccuucuugcuguguugcccugcggguggccagugagagucuaaaauccccugcaggggcccucgucugcuuuucuuugcaggccugugugucgcugacguggauaaagccucccugacugcagccaggcccugggcugggcaucuuguaggcuuccccuccccauuacugcucacagugagggccauggacauacccacauuacagaugaggacagugaggcucagagaggguaacugcgugccuagguucacacugccauuccaggaccagcauucagagcgccaauccaacgccacccggauaauugauuucuagccccuggccuaggaauagcaucugauuauuaccugcugugguccacacauaacugcguacauggagacagcucaggguccaagguccugaagaccuggguucagauccugguucugugacuggcugugggacccagggaaaauggcauugcuucuucaagccuugguuugcuugccugugaaauggagauaagggcccgcuucggagcccccuguuagaaugcaaugaaaagguugggguaaagcccgaggccuggugugccuggaacaugcguaguaaggagaggaagccuggugugccuggaucaugcguaguaaggagaggaagccuggugugccuggaacaugcauaaggagaggagacuggggucaucgggacaggcuuccaggccaagaccgucccuagagauggcugcugaccuucccuugucuuccacacagcgugccguguuacccucagaggucacucagcauggccacuccuguuucacagacacugaggcccagagagaaggcaccugcccaggaccucuggcaaguuagaggcccagcaggaggccugaggauaggcuuggagccggcacgucuggccugccacgccccccuggcugauuuaggaacccagcaauacagcagcagagcauuggcuguaggcuccacaggagcccaggcuggggcguugcuguauuuaugguucuuaugccccucccucacccucaccuccuggugcccguuucuccuucuccugcagaccugggaugacgaacuggagaagucugcugcagcgugggccagucagugcaucugggagcacgggcccaccagucugcugguguccaucgggcagaaccugggcgcucacuggggcagguaagagccacaaguuccucuccggcugccgcaggaccccacugccgugugccgggcucagcacuugugccccuuaucaaguuuagccugcaaagagagugagagagaccacccgucccaucgauauucugggaaacugaggcuuggcauccaggaacacuccugagugacugacaaaauguauucaagcuugguuggcugaccccagacacugaugauugauuaaaguuuguaguuuggguuuuccuucuuccuuuccuucuuccuuuccuucuuccuuuccuuccuuccuuccucccucccuuccucccuccuucccuucccucccuuccccuccccuccccuccccuucccuuccuucuuuucuugacagggucuuauucugucauccaggauggagugcaguggcgcaaucucggcucacugcaaccucugucuccuggguucaagugauucucgagccucagccucccaaguagcugggacuauaggcaugugccaccacgccuggcuaauuuuuguauuuuuugguagagacaggguuucaccauauuggccaggguggucucgaacuccuggccucaagugauccacccacguuggccuccucaagugcggggauuacaggcaugagccaccgcgccuggccuguaguuugggguuuccauuccaucuccugugcaggguucuugaguccccguuccuguggggugaacugcucuguucauggugggucauuucugucugguucugcucacuguuuaaggcugagccagguuccacccuguugggaagaugcccauugccuuccccgcgucauccagccgucgggaagcucacuaacuucuccagacccccgaggcuucccugucuggcaguguucuguccccucuccuucccugucugggagcgauuuguccccucucccauaggaggcauugacgguugucuguuaaaugcagccgacgggccuuccccagaguaagcuggaccauguauccgugcucccaaagaacccagaaguccccuccugggggcugacggcugguuucauuggagaaaguggaaaaaugucuuuugaccacgcccaggauaacaacuaagaccacauaagacuuaacgaccaaccugugaccgugccaugcccaaggccagaauucacguccucagacccauccaggaccuggauugacauccauuuugcccuaauuauugaaaaguuggaaugggcuuuagacagccucuuaaaauguaggugagcguuugcuuucacuucccacagagggauuuccuagcuuggguuucacugggccacgggcagccgcaccuuccucugcauccguggguuuucaggacaaaccugggcaggugucaugguggaucgaccgcggugacuucacagaggcaaauccacaccaugguuuuuucuuuggugaaguuagcuuuuuauaaaaacuaucuuacaggcugggcaagguggcucaugccuguaaucccagcacuuugggaggccaaggugggcagaauacaaggucaggaguucaagacuauccuggccaacauagugaaaccccgucucuacuaaaaauacaaaaaauuagccaggcgugguggcaggcgccugucaucccagcuacuugggaggcugaggcaggagaaucgcuugaacccuggaggcggaggcugcagugagccaggauugcaccauuguacuccagccugggugacagugcaagaauucgucucaaaaaaaaaaaaaaaucuuacaauaacaugaaagugaagugucuaaagcagggagaucuggaauuccacuagccugguucggcucuuuucauuuuucugagcuccuuugcagcaccuggcugggcgccgacguaguuuuacagcauugagacuguagccuggaucacuuugaaaucuuuuucuuuuuccuuuucauacaauaucaggaaauuuucagugauacaguugucaugaaugucgcccugcaaaugcccuaaugaucccucuguggacagaccaaaguugacccguuggcucuugcagauucauuuuuguuuuuuguuuuugucuuugucucacuugaaugauuucauuaggauuacuccugagaaguaggauugcugggccaaagggcacacagacuucccccuuucuuaaggaauuuugcuaacuugcuuugcaaaagagccccugacucugcauggccccccggggcagccgcggguuccuuuccccacagccaugccagugccagccuugagucugcgugaccuugagccgcagggaagcggaugaguggccagcagcccucugcuccugccuccucacugugugcacgccuuucugcaaaugccgcugcccgcugccgugcgcuccgcuuccagacaguaauuguuacaagaccucuaacugccucgacgaccacauggcccuuaaaaauggucauuucccccgugagcauuuucucuucaucgaaaccacuuuguuuauacuugcuggugacagugugacuguggacuugccuccaguuugguuuucucccuaguuauuaaaaaaaaaaaaaauggugccaaccuuggcagccaaggcugaagcaaggggguggugggcaugaagcgaugaccccacggaggauguccagggacaggugcagcugguggcugcagauuacaggcaugcaccaccucgcccggcuaauuuuuguauuuuuaguagagacgggguuucgccaugucggccaggcuggucuccaacuccugaccucaggugauccuaccgccucagccucccaaagugcugggaugacaggcaugagccaccauguucggccuuaagugcacucacgucuucaucagguuuugucuuagacaacaauaucugugaaauacgggcuucaugggcuggauaguuuuucuccaacguaccugaaaauaaacaccuaauugacauaagaaaggacucauuacuugggaggcugaggcaggagaauggcgugaacccgggaggcggagcuugcagugagccgagaucccgccacugcacuccagccugggcgacagagcgagacuccgucucaaaaaaaaaaaaaaaaaagaaaggacucauuaagagccaggugaagagauuccugcacgugcaggugguguaugagccaccugaggagccuacuagagaccccaggugagcuccucaaggauaaugguauuaagcaccuguaccaggugcugcuggaauugaggguuauucccccaccucggccucccucccuccucgcugcccguggcugcuccuggaauugggggcuauuccgccuccucggccucccucccucccggcugcccguggcugcuccuggaauuggccgcuauucacccuccucggccucccucccuccuaccugcccguggcugcugcugucuccacuggugggugaggggaggggcugggacugagugagcgguuucugcccugcagguaucgcucuccgggguuccaugugcaguccugguaugacgaggugaaggacuacaccuaccccuacccgagcgagugcaaccccugguguccagagaggugcucggggcccaugugcacgcacuacacacagguaacucggggacuugccacgaccucagcccugccccccaaucccagucauucacccccugccccugggggauugucaaaucuguaaagccucugcgcuguuguugccuucauuuuuaaaaauucaguucuauacagaguacagcugggagaagaagcuguuuguuaccagcaaggucagaaacugagugagcacuacaaacucuuuuuuuucuuugaggcagugucucccugcuaccugggcuggagugcaguggcaugaucuuaguuagcuuagugcagccccaaacuccugggcucaagcaauccucccaccucagccuccugaguaccugggacuacaguugugcacuacgaggccuggcuaauuuuuguauuuuuuuuuuuuuuuuuagagaugggucuggcuauguuguccaggcuagucgcaaacuccugggcucaugcaauccuccccgcucagcuucccaaaguguugggauuacaguugugagcuacugcacucaaccgagaaaacuucuauggcaauuugacauuguggggcauuuucauugugugggagucuguuuguuugcuugcuuuuuuuuuuuuugaaacggagucucccucugucgcccaggcuggagugcaguggcacgaucuuggcucaccgcaaccucugccuccuggguucaagcgauucgccugccucagccuccugaguagcugggacuauaggugccugccaccacgcccggcuaauuuuuguuuuuuuaguagagaugggguuucaccauguuggucaggcuggucucaaacuccugaccucaugauccgcccaccucagccucccaaaaugcugagaugacaggcgugagccaccgcaccggcccacuugcuuugcuuuuuaagaaaauguauguaucuucaauggguuagggacuaauaucugcuuccccaacccuucaccucguaccucuuuagugccagcaccuuauacauccaggccaaaugauaucacccuuuugugccuuaucccucgagcugugacacacaaaugucaucuuuucagauaguuugggccaccaccaacaagaucgguugugcugugaacaccugccggaagaugacugucuggggagaaguuugggagaacgcggucuacuuugucugcaauuauucuccaaaguaagacaaguugaugccguuguaugggguggggguugggauguguuugcuugccagggagcacccagugaaaacuggcuugagcagcgaagucuuuaauaucucacauaacaaagaaucuagaguuuagugcaucuggguuagcguaauagcuaagcagugucaacaaggacucggguucuuuccgucuuccugccguaccauucucuccucauggucccaagauggcugcacagcaccaacaucacaucuccccaagcacaaggaaggauggucaaagggcucucuccuuaggucuuuugcacacuggcauacuuucuccuuauguucuuugccagaauuagaccaaucauagaugagggggaaaaagauugccccaacuggcuuugcaagacguccucugggaccaacugaacaaagucagaagugggaauagcugcuggcugggcaaccagcauggucugcccuggcaguaugauuauuuuucucugaaaacaugcaguagacagcacccuagaaaacacauguucacacaaagccuagcuucucuguuucccuccaaagaggguccacaugcggccuccugaucauggugccuccuccgccuauagcaugcucagcucaucagugugguguccagcccuugacucauuugcucaugggacaaauaugugcugauucuuggagagucacucccccaguucauggccugagguuugcaugcuggccgcuggccaccgccguucuugccccgugcccuguguagagugggccccggggcauguuugcucagugacugaaugaaaugggaaugaccucauuuauuuguuuugggucaggaguaguuaugaaaaggugggaugaagggggaaucgcugagguugggaggaaaaauagaagcccucucaaaaccaucuggugugccugcgguggcguggcgcggcucagcagcccacauggaugagcgcagcgggugugucauugccugggagggacgcaggcaccaugcaagagcagcagacugguccaaggugguggaauuccuggcccaguggcagguggugaaugaggaaucauuugacuugacucuauaaaaaauagacacuagaagguccuaucagaaaugaaauuauuuccuucuguagcugcccccugcuuccuuaaaagaaggaauaaccuccauaugguaaaauauacucaucugaaguauacagugcgacacagucucacaugcauuagucuguuggggcugcaacaacagaggccacagccugggcagcuuacacaucagacuuuuaugucucaccauucuggaggcuagaaguccccuggaccaagggguggcagaucaagguguggcagaucaagggguggcagcaucgggcuccagugggagcucucuuccuggcucaccaacggccacuaucuuacaugguggugagagaugaggacaucaauccuauugggucaggacuucaccuguugacgucguuuaaccuuaauuaguuucaucaaggcccugucuccaaguacagucacauugugggugaggguuucaacacugggauuuggggagacacauaaugaaaguccacggcaauagcccucuacccguguaacuaccauccagauggagauggacagugucucccaugccccagaggcucucucgugcccuacaaagugcccaccauucuagcaucuuucccaucggucuguggugucuggugugggaccucauaugaagggggccacacagcacacucccuguacccccaaaugguguuuugcucaacaucacauuggugaggucuccccgugguguugcgugaucaccgguucuuuccuuuugucugcugcauauuacugcgugcuguccauggccucugucuuagagagagggcuugagccccugggcuaugcaggacacugucccaggcaccagggugaggaggguggcugggagggugaguuuggguguggggggggucagaucccuugagggggauucccaacccgacaaggggugggguggguguguacacagagggccuugugugugagggaagguacuucacggugcuauucaaaaauuaaggagacuggccagugcgguggcucaugccuguaaucccagccuccuuuggccgaggcaggagaaucgcuugaguccaggaguucaagaccagccuuggcaacuggcaaaaccccaucuccacgaaaaauacaaaaaguuagcugggugugguggugcaugccuguauucccaguuacuugugaggcugaggugggaggauugcuugagcccaggagguugaggcugcagugagcuguggucacaccacugcacuccagccugggugacagagcaagacccugucucaaaaauuaaggagauuauuugucugcaggaccuggugcccagccagccuuccaccaaugccaacccugaguguuaggguugagcugggagcgucaguggugugguuugucugaggaaauauagaaccguagacacaaggggaaacuuggcaggggcagugggacguacccacgacagggccacgaucaucugagaaaccuacugggcuucacccagagacaggaugggcucugggaccucucggucccuuggugauguucuuuuugggggagucaucccgaagacccccggggaucugaacagacgauuucugagcagggaugucuuguggcauggcacggacgcgaucauucugccuccggaaugugagaggguggaagaggcugugugcacgucauaacagugcccagucagacaguggccagcccuguccuccccacacugcacggcccacugucccuccccugcccacaggccccucggugaggccagggugcuucuggggccgcgggaaguucuaggccacucuuguaaggacggaugccuaucagacccagagcguguuuccugccguuugucuuuggccagcacuggcagggccccuccccaucuucccuggaaagcaucagagcguuccccgcacaagccuguggauuuccccaacgcucagagcacagccuuccccgugagucaggugccgguccaagggcuuccccacggucacucccucagucucacagcagcccugcugccgugaucccauuuuacagaaagggagaccgaggcuggggcuggaggaggcuggccgagggcacaugcuggcagccuggggcccaagccggggagccugcucuucacagcccaggagccgcaggaagggccuggggauuccgcucaccaccucuaccuggccccuggagaaagccuauggugcggccuccaguuuuccugccccugggaacuccggagggaggcagagggcaacugugacccaagagggaccuuugauccagccccuagaguagagugugccuaaggcucugagccggacagccuguguucaaaucccagccccgccacuugcuuguccugugaccuggggcaagucacuuaaccucacugugccacaguuuccuccucugcaaaaauauugaauuccagcucuucccuccugggguguuggggagauggggugaggagugcagugaaggcacagaccagggauggugugugguaaaaacugggaaacgcaagccgucucugggacaggcuggcuuuacacauuugagaaauggcuuaaaaggggguccuggcagcuuuucagcgcuaagguguugugaucuaggggcccuaacaguguucagagcuguguugguggaaggggggccacggggcugacagccagccagggcaaagguacuguguggaagggcaucuuguagcucccuucugcagaaucgcugggauucuggagcucucuagacucucugugcacgggagaggccugggauagccaucuuucccgcuucccacagcacacaaccuuccccccugaccugucaguggcgguguucagggacucacgugggccuuggaagaggaucagucccgaggccucacgucgugguucccucugacgguuguuuuugggucuguccucagggggaacuggauuggagaagcccccuacaagaauggccggcccugcucugagugcccacccagcuauggaggcagcugcaggaacaacuuguguuaccgagguaggaaauuuacucccaacacuuuugcaaugaauuugcccucagucugagucaugcgacagcguuacaugaaacaggggaauuaaagaagucagucaccccuccuggcccuauuuaagacgcucucagcacauuccucccgccuccgugaugagcugagccucaucuccagggucuaggcucagcuuccaggccccuggagagccccacugccccgagacauggcuucccaugggcaucuccugugccgggcucugcagaugcuggacacagcauuaaaugcagacgcacugcucacccucguuagcauucacaguuucauauaaaauaggccacgggcuggacaucguggcucacaccuguaaucccagcacuuugggaggcugaggcaggaggaccauaugaggccauguauuaggguucucuagagggacagaacuaauaggauauauauaaauauguauauaugaguuuauuaaggaguauuaaacucacgugaucacaagaucccacaauaggccaucugcaaguugaggaacaagaaagccagucugagucuggagguggaacaacuucaagcccgauguuugagggcaggaagcauccagcacgggagaaagauggaggcugcucccagucuccaccuaagucagucuagucuuuucacauuuuucugccugcuuuauauccuagcugcacuggcagcugauuaguuggugcccacccagauuacgggugggucugccucucccagcccacugacucaaauguuaaucuccuuuggcaacacccucacagacacacccaggaucagugcuuugcauccuucacuccaaucaaguugacacucaguauuaacuaucacaaguccaccccuugucaacuugaacccauacacaucuccugagaucauacauaaucuucaaauaaagacaauaauaagaucauaauuacacuaacauaauacaaccauccuucguaaaacuggaaacucaccaauccccaacccaaauacuaugacauaaaguuaacaauacuuaaaugcugauaugaaguuaauaaaucuuaugucccaugaugaaggaaaaaggaaauaacaugaagauauuuucuuaguacaaguguauacaugcacaagcaaguuuuuaacaaaagaaggaggaaauacucauaacaauuacaguccucauaucugcaacuggucacgugguuauagcugguauugaugacuaccuucuucuacugcccauucuguauucccuuugccuucagcaagcaccucagcaggucaugguuuuuuuccugguggagugacccaaaccuucauuccuaaagggucuggaccauuuguaguccugccuggauuaggcuguuguaguuucccauugaccuuaaucacagggcaugguaauacuaagagaugcccuaagggagcuccuguauuccacgcauacucuuccuuaccuccacuguggagcgguagacugauuucaucuugaugauccaugucacucaccccagccaacacuguaacucccuucuuagccuguugacuuaaggggaggaggagcccaaaguguccagguggcaaccuuaacuuccaguuuaaugggauugcugcuaugucuccugguggcagcguuccucccucuggaacuaagaccucuaggccagcagaauguaaugucacaggaacaggaagcaaaaauuuugcuagugggucacuaggggugagggugagugaugccauuuccacuuccaccccuuaauuccugaacucgugaauauuggcuaugggagaaacaaucccacauauuggaugcugauugagggcauacauggccuucuggagaacuuugccccagcccugccaaguauugucaccuaguuggcauuguaauugugacuucaaaaggccauuccacuguucuaucaauccagcugcuucagaauguuggggaacaugguaaaaccagugaauuccaugagcaugagcccacugccacacuuuuuuagccauaaauugagugccuuggucagaagccaugcuguguggaauacuaugacgguggauauggcauucugugaguccacggaugguagucuuggcagaagcauugcacgcaaaauggguaaaccuguauccagaguaagcauguguuccagugaggacaaaccucugcacuuucugugauggaagagguccaauguaauuaaccugccaccagguagcuggcugaucaccccgaggaauggugccauaucgagggcucaguguuggucuuugcugcuggcaaauugggcacucagcaguggccauagccaggucagccuugguggguggagguccauguugcugagcccaugcauaaccuccacuccugccaacacggcuacuuuguucaugggcccauugggcgaugacagaggugacugaggaaagagauugagugguguccacagaaugagucguccuauguacuugacuaauaaauccuccucugcugaggucaccuuuuggugagcauugacaugggauacaaacaucuucacaguucgugaccacucagagagauccauccacaucccucuuucccaaauuucucugucgccaauuucccagucaugcuucuuccaagucccugaccauccagccaaaccacuggcuacagcccaugaaucaguauauaaucgcacaucuggccauuucuccuuccaugcaaaguguacagccaggugcacugcucgaaguccugcccacugggaagauuucccuucacugccaucccucaagcauguccuagaaaggggcuguacugccgcagcuguccacuaucagguagugccugcguaucaugcagaaucaucugugaaccaggcccuagucuuuuuucaucugucaacugaucauagggaacuccccaugaggccauugguacaggcugggggaaagaaggcaggguggcagcaguggagaccaugggcaguugagccacuuccuuauguaacuaacuugugcuuucaggacuugcuugagcucaaucacacauaugccacuuccauuugaugauggaaugcugcugugcacgacccgcuuuauggcucgaugggucagaaagcacccaguucaugaugggcaguucaggucacauggugacuugaugacccauagucaaacguucaguuuccaccaaagcccaguaacaggccaagagcugucucucaaaaggaaaguaguuaucugcagaagauggcagggccuuacuccaaaauccuagaggccucugcugugauucaccuaugggagccugccagaggcuccaaacagcaucccuaucugccacugacaccucaagcaccauuggaucugcugggucguauggcccaagugguagagcagcuugcacagcaaccuggaccuguugcagagccuucuccuguucuggaccccacucaaaacuggcagccuuuugggucgcuugauaaaugagccagaguaacgcacccagaugaggaauguguugccuccagaauccuaauuggcccacuaggcguugugccucuuucuugauuguaggaggggccaaaugcagcaacuucuccuucaccuuagaaggaauaccuuaacaggccuaacaccacuagaccccuguaaauuuuaccaagguagaaguuuccugaauuuuagucaaauuuauuucccauccucuggcacacaaaugucucaccaauaaguccaacguguuugcuacuucuugcucacuggauccaaucagcaaaaugucuucagugcaauggagcagugugauaucuugcagaagcgaaagcaaucaaguucucucugaaucagauuaugacacaaagcuggagaauugauauaccccugagcuuaggacaauaaagauacauugcuggccuuucagcugaaggcaaauuacuucuggugggucuuacggacgugaauggagaaaaaggcauuuuccaagucaguggcugcauaccagguaccaggagaugcguuaauuugcucaagcaaugaaaccacaucuggugcagcaggugcaauuggagucaccacuugguuaagcuugcgauaauccacugucauucuccaagauccaucuaucuucugcacaggccaaaugggagaguugaacggggaugugggaaucaccaccccugugucuuucaaguccuugaugguggcacuaaucucugcagucccuccagggaugcgauauuguuuuugauuuacuauuuuucuagguaggggcagcucuaauggcuucuguuuggccuuucccaccauaauagcccucccuuaccugucagggagccaaaguggggguucugccagcugcuaaguaugucuaugccaauuaugcauucugacacuggggaagugaccacaggaugaaucuagggacccacuguaagccagaccugagcuaaaacuccauuaauuaccugaccuccauaagccucuacuuuaacuggaggaccacagugauguuuuggguccccuggagucaacaccugcucagagccaguguccaguaguccccaaaaugucugaucauuucccuuuccccagugcacgguuucccugguacaaggccagaggucuccccggggaaguaugggagaaagaugaacagcauaaauugucaguagcguagugggguccuuccucaaggggaccuagccuccccuucauucaagggauucugggucuguaaacuggcucaaaucuggaaauugauggagggaccgugauucucuguuuuuauaauucaaauuagucuuuuguccacucaaucuggaaguuuucugcuuauguaaauuaagugggaauguaguaggcuuccugucaauuucaccucuaggagcagcacaauuaauuagccaaugacaggacucuacacgagccagacuauucugauugcugcuuugccucugcuguccauuacgguagcuaugcccaccuuacuuuugaugguugagugcugccacuuggccccugccaccuugggaucuaaucauucccauugcauuuaaauuuuguaguugagugacugugguucccacuguuagaucugacauacagaaaaaagcaauuacaaagaugcaggugcugccuuuacaaaucuauuucacaaagcauuagucaaggguauaucuucuggauucucccagcuggaaugaguagguccaaaaugacuaauccacucuaccaucccaaucucccuaagccuuuggauccacauuaaaccaagggagaugaggcauuuccaguucacucacagugggccaccuuuuaauccauauuucagcuaaccaagcaaauaaagcaaauaaaaacagugaagaaccuuuuuuaacucccugagcugcaacauuaaauuaaaugcagaaucccuauuuagugggcccaaaucaagaaauucagccugauucaacucuauguuccuuccaccauuauccuacacccuuaauauccauucccaugacuauucuccagauuucugcuuauauacauuugaaaauucaagcaguucuuuucgaguguagcaugugucacacuccgaaccucaccucuagcagcccgccaggacuuuagucuaguuauaggucuagaagcaaacagggauguugggguuggcuccugaggagaaucagcauuaucuugccuggcagcugccucaggcgccucaggcagugcaggguuuauccccucagacaaagguggaaaggcugaccgcagcgugggucggggaggagacguugccacuacuggggauggggaaccuguuucuucuggcaaaaaagguuuaucagcauuuacaagcucagugucccuagcuucagcaggguccucccacacuuccccauucuuuuccaaucaaugcccucacuuuaauaaguagacaccuagcgaggugucugugcaugcaccuucauugcaggucagccacuugcaugagaagagcuugugucuguuuuuccacaauuucagcucuuucucuacaggagauaagacucacucaugauaaucuuagcagauuugaggcucaguaucugcuucugaagccggaaguuagaaucccugaguucaucauuuucuuucaucacuuuguccggugaacuuagaagcaaccaaucagcuucauuauguuccuugguucuccacauauagucagagguauucagucuagagucacugaacuccccucucaggagcgcugaaucaggagugucaaaugcauuuauugugcauaacucuccaaauagcucaugccaaggacucccaguguucuccauacuauuagaaguagaguccuuagcauuuugggaucuaaucauauuaagcagccaacuccagaaacccuaaaaccaaugaaagaacuccauccuuaauauuguguuccucuagaaccacuccugguaccaaaaucuguauucgucgggguucucuagagcaacagaacuaauaggauauauauauauaggggaguuuauuaaggaguguuaaacucacacaaucacaaggucccacaguaggcugucugcaagccgaggagcaaggaagccaguccgagucccaaagcuaaagaacuugaagucugauguucgagggcaggaagcauccagcaugggacaaagauguagguugagaggcuaaggcagucucgccuucucacauuuuucuuccugcuuuauauccuagcugcuauggcagcugauuagauggugcccaccaagacccagcccacugacucaaauguuaaucuccuuuggcagcaccuucacagacacacccaggaucaauacuuugcauucuucaauccagucaagcugacacucaguauuaaccaucacaggccaggaguucuagaucagccuggacaacauagcgagaacccaucucuacaaaaaauaaauagaaaauuaaccagguguggucacgugcaccugugguccuggcuguggccugggaggcuuagaugggaagaucgcuugaguccaggaguuugaggcugcaguaagccaugauggcgccacugcacuccagccugggcaacacagcgagaccccaacucuaaaaacauaaaacagacauuugaacaagaaaguaaaagcaaacaacgugauauuccaaaugagcucacuagugggaaguaccugcaauguggacagcuggguaggaucaguccucccgggcuguuugacccuuuacuccuguguccuugcccccauuggccuccccuuuaugcaugugucuugcuggugcuccccugacugugcuagagguuucucgcccccacucccacagcucucagaacuggagcuguuggggcggugcgauuuucuaccuaguucaccuuuuuuuugagucauggccucccuuuguugcccaggcuggagugcaguggcguaaucuuggcucacugcagccucaaccucccggccucaagggauccucccaucucagccucccgaguagcugggacuauaggcacaugccaccaugguuaauuuuaaaaauuuuuuguagagacgggaucucacuauauugcccaggcuggucucaaacucccaagcaauccucccuccuuggccucccaaagagcugggauuacaggcgugcaccaucaugcccgcccaccauuucuucacugguucccauuuaggauguuuccacuucugcuacuauaaauaacacagguuucuggugccuaaagcguuucucaugucuugggauauuuccucaggcuuucagaaguuauguccccgauggggcauggcugguccauggugcugaccaugcucguguggcccaggcuuuuuuuuuuuuuuuuuuuuuuaacguggcuccacuggcagccuugccaugaccgaggggccuugcagagacuugggugggcuccgcuggcagggaagggugggguagaugugggaucaggcugguggguucuggagugaagaacaagugggcuagaucaguggucccagacccucugaggagccagguccucuguugucccagccagcuguucauggcugacugcccgcuggggagaggggacauccuaaguggggauggggauggaagaaggagcgaucuggacacuaagacagaccauguaucugggucugggucauguaucaccuguugcagucuuggugugacccccgccuccagggagccuuccuggacuucacagccagacagugcaccugccccauguucaucaacccccagacuccuugggaaccuugaucguccugucgucucagcugccagcucacuccagggccuccggaggcacauggcaggggugucuuauguguuguuugaauaaauaugccaauagccacagaggggcauuuucaaagaacaaaugugcacagaaaccuuagaugccaguuuaccuccaccaacauagcuucauguacuuauuuuuaaauuuuugguagaaaguauccaacuuuccuuggcagacacccaauuucucuagcuaagcacgcagcaagucuccucugaagcagcuuaucugcagaagcuauuuaccaagagcauauccagggugccugguaaggccuugaccucuaacggagauggagcagggauaaggauauaaaaaaagagguauucuccccucucacccccaccuguguggugauagaaggcgcaggcuuuggggaaaggugguuugacacccagcccagguacuucccagcugugcgagccugggcagggcccuuacccucucugagccuucuuccucaucugugaaauguggccaaucaugccucugaaggcaaaugggagguugacagaagaaaaugcuggggauggccgggcgcgguggcucaugccuguaaucccaacacuuugggaggcugaggcgggcagaucaccgaggucgggaguuugagaccagccugaccaacauggagaaacccagucacuacuaaaaauacacaauuagccgggcaugguggcgcaugccuguaaucccaggcugagguaggagaaucgcuugaacccgggcggcggagguugcagugagccgagaucacaccauugcacuccagccugggcaacaagagcaaaacuuccucucaaaaaaaaaaaaaaaaaagaaagaaagagagagagaaaaaaaaagaaaagaaaagaaagaaaaaugcaugccggggagggcccagccagcaucuggccagugcucagugaacauuagcuccgggcauggucaccagcuuuagagccagaagggaaucugcagagugacauaaacaaugcccugagacccuggcccggagcagaauggggcacagaauaaccuugccgugaccucugcacggaauuuccccaggcccgugcugggccauacaaggugucuucauuaggagguacucggauccagcccauccugcggguaaagccuucuacuuuucauuugugggugugagagccaggacugucugucugcccauuuucuuaaauagagaguccucaaaugcuuuagaccgcuuuaccaaacugucuucggcuaaauaaagcugcgauuaugaggucuaaacauccuaaaggccaguggaagaaaacccggcuuauucuccagccagcucccgcucucagugagggcaagccugaauagccucauugacgggaagaacagacacgcgccugggcagccucugcaaacccggugucuuccugaagcuuccacccauagcuuuugcuaccagaggugcuuucagaguucccucuuugaaugucuuuaagcucuguugcuggacauaugcucuuuucuuuaggugacaggauucucuggggguuuugguaguucaugcauuugugaauuuuguugagcagcugcugugugcugggugccaggugugaggcaggcuggccccuggccucuggagguucgcagcugguggaugaggcaggugguggggaaaugacaguugcgagcaagcugcuggggaacagugcagggugacccgugagcacauccaagauuagaauuggagcucagaauggcuucccaccuucugacuuaaacccgucccuuccccuugugggacaggaccagccugggguggugguuguaggguagugaaauuggccagugaagcagcuauggagaaccccagcccaggaaggcgucagggagucaggcauuugccccucguuuggcuguuugguauuguguggacacaaaauacuugcuguguccuuuagcaaagaaagcucauguauuuuaagaaguggagcuaagacuuagggauugaggaacaccugaugaaacuuggauuuuuuuuuuuuuuuuugagacagaguuucgcucugucgcccaggcuggagugcaguggcacgaucuccacucacugcaaccuccaccucccagguucaagcaauucuucugccucagccccccaaguagcugggacuacaggcacccgccaucaugcccagcuaauuuuuguauuuuuaguagagacaggguuucacccucuuggccaggcuggucucaaacuccugaccucaugcaauccacccgccucggcuucccaaagugcugggauuacagguaugagccaccacaccuggcccugaaacuuggauuuuaauccaaaaccacaaagagaccugcgagcgugcucuaguuauucuccuugaaauuguuuucacccaaauacaucuguugccuuuuuugcuuggggagcuuggaggccacagguuuccaacucugguccaaagacuucuguuggggcauaggaggagcaugccauaaguaaagguauuaaguguccccagcagauaugcucgugaauuugucuuugaucaggccgcucaggcaaaugaaaauagcagugucuuugcuuuagcuggaauuuacaaauugguauccugguggccugauugcagauucuggugagcaguuuguaguugucuuucaggaugaaaacuggaagauaagcuaacucagguuuauuaagugcaauguguuugguuaauuaaaauguuuuaaaacaugggucauggucauaguuggagaaauaauaauauaccauguccuugaauaaggaaaagauuguucuuucggauaguuggauaguucuacauguugagucugacauuauuggacaguaaaacuccaguacagaagcaacaauugagcugguuaagugacccugacuggcaggaggagagaagggauggaagugggcuggugugaggugcaguuggggucuaggagcacugaggcuggccuugugcaccgugaugugugcaugaugaggaagaccccuuccccagugaaaacccagggacaggggacuuccagcaaguccacuauggcuuugggccaguggccgaggcaguuuuguuuuuugguuuuuuuuuuugagauggaguuucgcucuugucacacaggcuggacugcaauggcacaaucucggcucacugcaaccuccaccuaccggcuucaagcgauucuccugccucagcaccccccaaguagcugggaugacaggcguccgccaccaugcccagcuaauuuuuguauuuuuaguagagacgggguuucgccauguuagccaggcuggugucaaacuccugaccucaggugauccgcccaccucagccucccaaagugcugggauuacaggcaugagccaccgcacccggccugaggcagcuucuugaaguugcuucgugggggcagagggucagguggaggaggagaugggacaagaaaccauuaugauaacccaggugugggcguggggccugcuaaccucugggcagccuggcugaucuuggguccaaagcaaacacagugagcggagagcguccccgucucaucugggcugguagaauuccaccuggccaggucuguucugaaauguaacuuucucuuugccgcugaaaugauucuuuguaaaaccaaaccucaaacacguuuaguuuucaaauugcuuuuuuuuccccaaagugcguuuuuguugaaucccaguguguuauuuuuuuuccucccucuccaauguuaagaagaaaccuacacuccaaaaccugaaacggacgagaugaaugagguggaaacggcucccauuccugaagaaaaccauguuuggcuccaaccgagggugaugagacccaccaagcccaagaaaaccucugcggucaacuacaugagugagucuaggccguccuccgccccuccugcccucccagccaccuccaaaggggacgggguggguggaggaggggagcuaguggauuuaggucugcaaauccacaggcaguggcaaacagggugcggcgaagcucauggaggcacaaccauaagacguuuuucaaaaacgauauuuuuaagucauuucaaaagcgagcauuauaggacuugugcuuggguggcauuuuccccacacccaggcagguauuuuaagguuagaccuucccuuguccuuucaaaagggaccugggcugaaguuggguuccucugggaagcgcuggcccugcagagggcaggcagcguccagccuggcucuggaagguuccacuccuuucucaccagguccugggucuggacucaguuggcgcauccaugaaguaggggauagagaugccacaucaagguugcccggaggaugagcugcagcaacacgggucacccagugccagcugaggucucccuguacauugagaucauugcagaguugccuacaacucuuuuuugagauggaguuucgcucuugucacccagguuggaguccaguggcaugaucucggcucacugcaaccuuugccuuccggguucaagcaauucuccugccucagcccccugaguagcugggacuacaggugcccaccacuaugcccagcuaauuuuuguauuuuuaguagagaaagggagauguuucccccugggacuuccaggaauccccaaaauauugacucuuccccugcucaccuuuggccuuuuggcucccugggcaccucagcuccccaagcuuuuguucugucugccuucaccgccccaggguggaguucagcuccccuucagcuccccccagccacugcugcgggaacucauuugcagccgccguuucugcaggccgggggcuguggaggggcguuuuugcucaggcggggcuggagggcugggcuggaugcccuuggcucuccccguuugccccgcaagccucaaaggcccuaaaacuggaccccucuuugaggaacagccucacacccgccuucucagagccccucucuucuuuucauaacuaccaucuccccugcccccaccagucuuucuguccucuucaaaccucuuucccugugaugccgaagcauucuguagcuugcuuugaccaggaaaccugcggaggcccuugucuguccaggaguucaaaacggugccauuguuucuuuuaauaacauacaacguuuaugucccuuuucaaacuauaacacgacuccgagacucugauauguucccauaaaauaaacaaagcaaaaagcuuugcaaaaggcaucuuggcgaugggggagaugacucgggugagccuggcugggucuccggccccacaggcucggagcagcauccucccuacccucucaggaguccugcccugcagagcccugugggaccacaggcacaucgugugugccaggcacccugccaaggccagaguucacuuucucucucaagguucacaaaagcccuuggagguggguacugucacuguccgcauuguccauaugcggaaauugaaccucagagaggggaagcaaauuguucaaggucacacugcuacuguaaagcggugggccuggggucugagcccccagcggaagccugcaaccaucaggcauugcccuugcucuuaguauagcacggauuggauugcagaauguuccagaaugucccucagcauggggaagggucuucucacccuccugguuucgugccgugacauguauucccgcauuucucuccuagcccaagucgucagaugugacaccaagaugaaggacaggugcaaaggguccacguguaacaggugagccugugcugggcuguccugccacuguagccucugagucugugcugggcuguccuaccacuguggccucugggccuaugcugggcuguccugcuguugcauauuuagcaagcugcucucagcaggcagaacagggguuagggcugggcagugucugggcauguguucgccucggccguuggcagauccuaugggaaugcugcaggaucugagcaggcugcucccagugggccccaccagacagaugggccaccgguauauuccccccaugguagaugaauaaauccaucuaguuguugcagucauucagaugaugaacgcugucugccaaaaagaacgcauuugguuuuggcagugugacugcugggcuguucuuugugguaguaaacagccaacaggugcagccgccgcacgcacacccucagagucaaaugggaaaaccaugucauugggagaggggaccuugcucgucuuccuacgaauucuggcaucaguuugccgaaagcugaaucgaguuauuuaaagcacauguuaaaaagggaagguugaaucuucgguuuuauaucgcaaggguuuggaauucaguuugccaggagaacacuucacuuagacguuggcaggacugugaugagauggacuuggagcagccgggaugaggcggcucagugggcucacaugugguacugucguuuguuggugagaugagccucaugugucaacagucagcaguggaauaacagugccuaaaaccucgcgcucaguguuaggguagcauuugcaugucucugugcugggcgaauugggaaaaagcaggcagcgccuggcaggggccuccgccgugugcacugccccgucugggcugcugagaagccggaguuguccuuuuguggcaacgcaucuuucugaaugcuaagcacauugcgauagcaucaccccugaguaguacucaguggaaaaaggugagcacguauuggagaacauuccuugucagacaacaucgaggcaguuccagaguugggguggguggggcacuccccaugcagggagaaggcaagaaucuguccacacaaaggcucuuaaaggccuccagucaagaaaaguuacucagccccagugugccacugugggagcauccucauucucucuguagaagccggcccacagucuggcacaccuguuuucuguucauggugcuuuuacaaaaauaguagucaguggguuuuuuuucugacuugaaaaggcaucuaugcucauuaauaauuauucaggaaagcaauaacaacaacaaaaaaguagaaagaaaaaaauguguuccaaaaucucaucaauaccagcagcaauuugauguauuuccuuccagucuuuuuuucuguguacagaugaggcuaaugcugcccauguauuuuguuuuuuuuuuuucuuugaguuggagucuugcucugucacccaggcugaagugcagcagcaugaucucggcucacugccaccucugcuucccggguuuaagugauucucccaccucagccucccgcguagcuggaacuacaggcacacgccaccaugcccggcucauauuuuguauuuuugguagagaugggguuucaccaggccaggcuggucucaaacuccugaccucaagugaucugcccgccuuggccucccaaaguguugggauuacaggcgugagccacugcgccuaggcugcuuauguauuuucacuuaguauuuuccaaauauucuucacgcacuucaugcuuagugacugccugauacucugacacacgacuguacaugaauguguuuagccauugcuuugccaccugcuggcuuauuuccagcuuuucaccauuauaaacaguugcggccagguacgguggcucaagccuguaaucccagcacuuugggaggccgaggcggguggaucacuuaaggccaagaguuugagaccagccugggcaacuggcgaaacccugucucuacuagaaauacaaaaauuagcuggacaugguggcauaugccuauagucccagcuacucgggaggcugaggcacaagaaucgcuugaaccugggagguggaggcugcaaugagccgagguguacuggugcacucuggccugggugacagaaugagacucugucucaaaaauuaaaaaaugauaaauaaauaguugggauaugcuugcaggucuggcuuucuugacuuuuugcuuggaauauauauuuacaagggaagcugaagagcuaauggauaugaauguuuaagucuuucuuaaagauuuucuuaaacauuagagugauuuacacuuccaugaacagcaacaccaucauugaguuuuacccuauuaaaaaauccuugcaggccaggcaugguggcuugugccuguaaccucagcaccuugggaggucaagguggguggauugcuugagcccaggaguucgaaaccagccugggcaacauggcaaaacccccaaaauuaguugggugugguugugcacaccuguagucccagcuacuugggagacugaggugggaggaucaccugagcccaggaaguugaggcuacagugagcugugauugcgcugcugcacuccagccugcgugauggagucagacucuuucuugggguuuuguuuguuuguuuguugguuuguugagacugagucuugcucuguugcccaggcuggagugcaguggcacgaucuuugcucacuguaaccucugccuccaggguucaagugacuuuccugccucagccucccaaguagcugggacuacaggugccugccaccacacgcggcuaauuuuuauauuuuuaguagagauggguuuuugccaucuuggccaggcuggucuugaacuccugaccucaggugauccaccugccuuggccucccaaagugcugggauuacaggugugagccacugugccuggccuuguuuuuuuucaaaugagaaaaaaaaaaaaaaaaaaaaaaaaaaaaagacuaugguugaccuucuauuucuguggauucaaccggccucugauucaaccaaccucaaauucaaccaacugcagaucaaaaauauauuucuuaaaaagugugugguauuacaguauaauaauaaaaaacugauacaaauuuuaaaaacaauacaguguaacaacuaucuacauagcguuuaccuugugguagguauuauaaguaaucuagagauguuuuaaagcauaugggaaaagaugcaaagguuauacgcaaauacuaggacacuuuacauaagggacucgagcaucugcagacuuugguauccuagggaaguucuggaaccaaucccccacggauaccgagggacgacuguauugugcuugcgugaaucagucugcgccuggguaaagucugacuuguccaaaaacaauggaauccacaugaaugaagcuuuucuauauuuaguaauagagccaucgaugaaaaaaaugauaaacucauugugagauguaaucaacgugcuuaucucugaacaucauuuuauuucuuccucgucagguaccagugcccagcaggcugccugaaccacaaggcgaagaucuuuggaacucuguucuaugaaagcgugaguguggccaguccuccucucaauggcuugugugggauccuguugcauauguuuaaagcaggugguuggcuuuaguaggaaaagauuuucuuuccacuccuuagucaaaccuggcauuucuagaacuggggcggguguauauuuaugggcuuacaaacuagcaaagccacuuucggggaccaauccuccugaaggccagucuccgucuuagacugagcauucacacacuggaccgagcagggagaaagggauguuugucacucuucuuaguuuguaaagcaacucagaugaguuuuuaagguaagcaaccccaggaacaaauaugugguuacagacagaggcgagaggcaggagcagagugagcuuuggccuguccuucaggcuuuuagugaguugaggacaaauguuuggguauuucuggugaaacuugcugacagagguugagaaugugccucuggucuucucuucccuucccgccagucgucuagcauaugccgcgccgccauccacuacgggauccuggaugacaagggaggccugguggauaucaccaggaacgggaagguccccuucuucgugaagucugagagacacggcgugcagucccucagguaacuacucugugaucggggcucugugaaacgguuuuccuguuuaugacgguguuguugaaauuuugaaaaauaccacacaggccgggcgugguggcucacaccugcacuuugggaggcagaggcagguggaucaccugaggucaggaguucaagaccagccugaccaacauggugaaaguccgucucuacuaaaaauacaaaaguuagccaggcgugguggcaggcaccuguaaucccagcuacucucaggaggcuacggcagaagaaccgcuugaggccgaggcagagguugcagugagcuaagauagugucacugcacuccagccuggccaacacagcaaaacuccgucucaaaaaaaaaaaaaagaaaacaacaacaacaaaaaaaaaaacaaaaaaaaaacccacagcucuaacucuaaugcaaauguguuuuuauaauuugaucaugauauuaauaauaacuucuuuguaauguuuuaaauuuaucuucuuaaaauuucuuuauuuugcagcugugguuagauuaaauuuaucuuauacauuugaaaaccauuauucuuagaagggaucuauaggccucaccaggcuaccagaagaguccuugguacaaaaaaaguuaagaugcccuggucuagaacauucuaagagcucucaggcugauaggaaacaaguagaaaagugugaagucgagacugcaaauaagauaaguauaggagcaagcguucacuuuuagaagcaauucuauuugcauuuaccuaaugcccguuuuuuuuuuuuuuuuuuuuaaacagcaaauacaaaccuuccagcucauucauggugucaaaagugaaagguaagcuagccagucucuuuugcgaccauaauaccuggguuaucucagauuuuccuggaaauuucacuuccuuuagucgcugauuuaauguuuaucaugcgugugaacauuaugguucucaucauugucaagccuuuuucaagacgucaucucuuuaaccagcuucuaagaauaucuggacuggaaauuggccugagaucacugaaccagaaacacagggcugagguugccagcugaaugucacagacauacugaugccuggggcuaaaguggcugagagguuucacugggagugccacuuucugucgauugguaauggcuaccuggaguguuguguuaagaaggauucugaggccuccaucugggcuuaguggaaaacagagcuugauagauuaguaaugucugccaugagcaagagagggaagugaagggaaguguguggcacuuacuugccaucucuggcccagcuuuuuacauugcuuaguguauguucauuuggaaggugggaugcacgaugggcgagcacacuccaaccagaagugaagggauggaucauagcugcccacacugugcccuugacuagaauaaucucaggcaagcaaggauguaggagccauuccagcuuccuccccggagcucugccggcagaccaugccuuuguuuugggacagcaacucuuaucauuugcccucaugcaaaaguucuaguuagauaucuuuauuaaaauauguaguaguuuuuuuucuuauugcaaaaagaaugccuguuuauuccagauaauuuaaacacggaguggaacauuuuuuuguagugaugaccuaaauuccagcagccagagauaaccaucgugaacacuuuggcaaauauuccaguuuguuuucucuacauauucaaaguauguacauugguaauauauacaucgaugacuuuuaaaacuugaaauggaguuacauacaauuugguaaccuaauuuuuuucuuaaauaauuaugugucuggcugaugcagcagcugacaccuguaaucucagcacuuugggagacugaggcgggaggauugcuugagcccaggaguuugagaccagcccuggcaacacagcaagacccugucucugcaaaaaacacacaaaauuagcugggcaggguggcacacaccuguaucucagcuacuucggagucugagaugggaggguugcuugagccuggaaacuugaggcugcaaugagucauguucaugccacuacacuccagccugggugacagagcaagacccugucucaaaaaaauauauacauaugugugugugugugugugugugucaggaauauauuucugugccuuuaaaucaagcuuguccaacccacagcccaugggcugcauguagcccaggacgacucugaaugugcccaacacaaauuuguaaacaugagaaacaugagauuuaugcauggacuuuuuuuuuuuuuuuuuuuuuuuguagcucaucagcuaucauuaguguuaguauauuuuaucuguagcccaagacaauucuuuuuccaguguggccuagggaagccaaaagauuagacacccuugcuuuuuuuauuuuauuuuuuauuuuguuauuuuuugagauggagucucucucugucgcccagccuggagugcaguggcgcaauuucagcucacugcaaccuccuccucauggguucaagugauucuccugccuuagccuccugaguagcugggauuacaggcacccgccaccauguccagcuaauuuuuuuuuuuuuuuuuuuuuaaguagagacgggguuucgccacguuggccaggcuggucuugaacuccugaccucaggugauccacccgccugggccuccccaagugcuaggauuacaugcgugagccauugcacccggccuggacacccuugcuuuaaauguucuuccaaaccuaaugugaaugaucuccccauugaauagaagucccuugauguacuaaaccaguccccuuuguuggauagcuauauagaaccauggccuguucaagugacagacuggaccagcaggguucagcaaacgaugacucauggguuaaauccugccuauugccugcuuuuguaaauaaaguuuuauuggaacacaguuacaccuauuccacaucaucuauagcuccucucugcuacaacagcagaguugauuaaucuugacaucaaacauaaggaccacaaagccaaacauguuugcucuaugguccuuuaagaaaaaguuuaccuggccgggcgcgguggcucacgccuauaaucccagcacuuugagacguccaggcagaugggucaccugaggucaggaguuugagaccagccuggccaacauggugaaaccccgucucuacuaaaaauacaaaaauuauccaggugugguggcaggcaccuguaaucucagcuacuugggagguugaggcaggagaauugccugaacccaggaggugaagguugcagugagccaagaucaugccauggcacuccagccugggcgacagagugagacuccgucucaaaaaaaaaaggccggugcagugguuuccaccuguaaucuuagcacuuugggaggcugaggcagguggauuaccugaggucaggaguucgagacaagccuggccaacauggugaaacccugucucuacugaaaauacaaaaauuagcuggcugugguggcaggcgccucuaaucccagcuacucgggaggcuaaggcaggagaaucaguugaacucagggguggagguugcagugagccaagaucgugccguuucacuccagccugggcaaaaagagcaaaacucugucucaaagaaaaaaagaaaaagaaaaaguuuacuuagcccugaacuaaauaaagacaugcugucagagaucacagguggccaguauuagaacuguuuccuuaccuguguuguuuaaacacaacaaaaugaccuugaagauaaaagccccucgccccucagcagggaugaaugugccuugauuagcggcaggagguaggugguaugucagaaggagcucuagagcaggcacuggaaagcugggcucccaccucaguccugggaagggcacucugagcucucugagcuuccauuuccucaucugccuacuuagaguaacaccugcugugaggagcaaaggugaucaagucaggaaaagcuuccaaauaagaaagucaccauucagaugaaaagcaccaucagccccacagagaaaccacugggggugacaacgcccucaacccgccaacacaugcaggccguggguuuggucucaucucuuaagugccccuacgugggguacgaggagccugcugggucguagucccagcucuauucaagggcccagggaacccauaggcccugguagucuaguggcccauugcacagccugguagccugaggcccaggcgugcugggaccugacccuuucccccuugcuccuguucacagugcaggauuuggacugcuacacgaccguugcucagcugugcccguuugaaaagccagcaacucacugcccaagguaaggcgggccugaucugucaucuuuucuauggaagauguuagaaguagcuuuuuaggcugggugagguggcucacagcuguaaucccagcacuuugggaggccgaggcggguggaucacuugaggccaggaguucgugaccagccuggccaacauggugaaaccccauuucuacuaaaauuacaaaaauuagucagccauggcggugggugccuguaauuccagcuacuugggaagcugaggcaggagaauugcuugaaccugggaggcggagguugcagugagcugagaucacgccauuguccuccagccugggugacgagugaaacugugucccaaaauaaauaaaauacaaauuaaaaaucagcuuuauugagguaaaugauacgauccacccauuagaaguaaacgauguguggccgggcacgguggcucacgccuguaaucccagcacuuugggaggccgaggcaggcggaucacgaggucaggagaucgagaccauccuggcuaacacggugaaaccccgucucuacuaaaaauacaaaaaaaaaaaaaaaaaaaauuagccgggcgugguggcgggcgccuguauucccagcuacucgggagucugaggcgggagaauggcgugaacccaggagguggagcuugcagugagccgagaucgcaccacugcacuccagccugggugacagagcgagacuccgucucaaaaaaagaaaaaaguacacaauguguuuuggccaagguauacagggucacaaccaccacccgucaaaguguagacauugucagcaccgaaugucauuacugcucugguggccagucccucucccuccagcucccggccacaccccugcaccagggagcuucuuucuguugcucugauuuugcuuuuucagcaaaauuauggcgccguggcaggguguggucuugggugucuggcuucucacucugcgucauguguuggagacucagccguguuguggagcguguuuguuuauucuuucaaauccucaugcagcauuccauucuguggauacgugacaacggguuugucccaggaaucgguucuacaggcagcuaaccccaaaugagugguccacggaggacgaugccucccagcauaaaauaaaggguguccugggaacagcugucgcugaaguuccugguagauccucuugggaagggaacacaggaacauccucuuauuugaaucggcugaggcaccuucucagguggaaaaggccgcaggucucugggacguccccacuuuauagauguuccccaggguucagaucauauaauacaucuguaaugcuaagcugcccuucaaacagagcacgcuuucugacuuagcuccauuguagaauuagaaauagaaugacagucccaggacccuggguugaaaugcuuugaggaugaagacagcugcccuggaggcugggugguguggcccucaugagcccucauccugggcuggagaccuguggauucuccaagggacaauagguggugaccccaagguuccgagcagggaaaggcccaggagggugacugguugggaggggcccagacugcuuucccuugacugccaccccacuucaggcuuucucugggccuccacugccuccgcaccaccgucuugaucccccuugaauguucgaguggggauaacagccuuuuaguagauuuucccugaauauuagagagaagcagaaggaaagaauuucagaaaauacaaacagaaaaacuugacacagugcaauaugcaaaauguuaauuucugaucugccauuccaaaagaaguaggaaagaauggagacuguucuuagacucuuuccaauucuuuuuuuuuuuuuuuuuugagacugagcuucgcucuuguugcccagguuggagugcggugguacaaucucugcucacugcaaccucugccucccagauucaagccauucuccugccucagcgucccgcguagcugggauuacgggccugcaccaccacgccuggcuaauuuuguauuuuuaguagagaugggguuucaccauguuggccaggcuggucucgaacucccgaccucaggugauccacccaccucggccucccaaagugcugggaucacaggugugagccacugcaccuggccuucuuuuuuuuuuuuaaauccacacacacacccuuucucucuacccacucauuucccuuccucccagccccuaagaacuguuucaacuucucagucccuuugccuggccuucuuccuucccauaauccugccugccuggggccagauggcuuccggcugccauuuugguuucuuggucccugggcuccagcccacgguggacuguuccagauaaacacagaagaucuuuucuuaaguaaagcccgugcucuuuccuggcuugaguuugucaaaccacccaggggucacccauuuccaguuugaggugcuuuccucaugcccuggaggaucuguggugacugacacacagugaucuaaccccuuccaccccagguuaucagugcccccgccuuggaauauucugugacucagcgaggugagggcccuccacccuuuccuccuccacacagggaagcggccuuagaaaaagucucuugaugcuaaucuccauaauguacccacagugugaacuagccaacauccaagaaugggaggggcagccucacaauuccacacucuucucucuuagauuuuuauucucuuuaccuuuuuguuugugcaugucuuuuguggauguguguguguuuuuaaaaauucuaucuacacuguuuaagagaagcaaaaauaguaauaucuuuaccucugcugaggggggagaaguauuguuuuuuuucuuaaugaggaaaacuguauggcgguuuccuuucaucuacgaacuuaaaucuuggaauucaaauaaagagagccagcuuaagaaguuugguuuucugugcucagacccaucacauaaaugcuuccuguuuuucagaauccauuguccggcacacugcaaagacgaaccuuccuacugggcuccgguguuuggaaccaacaucuaugcagaugugaguaggaugcauuuucaacaacuaucucgcaaagccuguuaaagaccucaacaugcaagcuccaagaucuggauacuugaaacuuuauuccagugccucuuagcuaaauuaauuaauuaauuaauuaauuaauuucgagauggagucuuacucuguugcccaggcuggaguacaguggaguaaucuuggcccacuguaaccucugccucccagguucaaacgauucuuguaccucaaccugccaaguagcugggguuacacagugcaccaccaugccuggcuaauuuuuguauuuucaguagagacaggguuucaccauguuggccaggcugguuucgaacucccaaccucagaugauccgcccaccucugccucccaaagugcugggauuccaggugugaguccccacacccggccaaccucuuagcuaaguuuagaccacucauuucugcaaacauuuuccccauuuccccauuucuagagauaguagugcuucuaccuaccuguccucacaaaugcagauucaggagugccuggccuuacuuaaauguuuucgcaguuugaaggcucucaugcuucagauaguucauuuuuccggcuauuuagucaucuucccagcucuccggaugcauuuauagaaacugguccacgcacuguauuucuucucaguuaugcacacacuuagcuaaaagcacaaagaagauaauacagaccacccuaauuuacugcuuguugauagccacucugguuauaccaaucucuuccucuguuuuuucccuccgaauuuuaaccagggagcuuuagcccgguuuuucuuagguggauccugcagaacauugucuguucccucugguuguccaggguuuggggacauggugacccagacaaugugacuguggucccacuucugcugccagcaggcugugugaucuugucaagcuguuuccuuguggcggaacggcccagaaccgggauuaucaaauccagggaaucuucuagaucuaaaauucugugauuagggcagcaucauucaucucuagcuaauguuuuuuauuuuuuuauuuucugaauagaggcaaggucucacuauguugcccaggcugaucucgaacuccugggcucgagcgauccucccuccuuggccucccaaagugcugggauuauaggggugagccacugcacccggccuccagauagagcuuuacucagcugcuugucaucauccccuccuuuacagcucucucccgcuuccccgccaucaucuuugccucugucugccuuaauguguuccagauuccuguaaauaugaggucacugggcucuguaaggucagagcaggcuucaugacuaagcuuaucuccccccaucuuuuuucuuuccucuuuaaaugggucuuuuuuucuucuugaaagugauucagcuaaaauugaguuauaagaguuagaauuuuuaugaaggaguaaaauaauauugucgauuauuacaccaaauguuugaaccaaauucuaccauuaagagacagaggcugagguuuucaaaugauuuaaaaauaaagagcugggcaaagcaaucccagccaaauacaaacaaacacaugaaaagcaagaguggcaauauuccucucugaaaaaguggaauuuaaaguuaaauguacugaaugagacaaaguaauguuacacaauggcacagaagauacaauuuacaggaaaaggaauaaaaacuguacacaccaaacaauauagcagcuaaaccaauaaagcaaaaaaaaaaaaaaaaaaaaaaaagcaagaacuuaauggauauuugcaacaauagaaggcuacuuuuuuuucuuuuuuugagacaagaguuucacuccuguugcccaggcuggagugcaauugcacgaucucggcucacugcaaccucccagguucaagagauucuccugccucagccucccgaguggcugggauuacaggcacccgucaccacacccagcuaauuuuuguauuuuuaguagagacgggguuucaccauguuggccaggcuggucucgaaccccugaccucaggugauccacccaccuuggcuucccaaaguguugggauuaccaacaugagccucugcacccagccagaaggcuaccuuuuauucaacacauacuauguuuuagguccuuucuuuaaaaacaccgucucuagguaucguuauccuuauuccuguaggaagaaaacaaggcucauaguaaccuguccaaauccacacagugagcacguggcaaaggugacaaacaggugaacauguguccggcuuucgacucugcucuuucccugguguaugcugccuugcuugauguuaccugcauucauagcuacacugauaugaacaggcgugaggggaaaaagcuaugugcagucuucauuaacaaguuucacuaggauuuugagcuuuugggaccacugugcucaugacagggcuugacagacaaucauuguuuguuggaggaauaaauaaaugaagauacugcaguacucaguacuuaaguagcucuucaaaaaaaauaaagaaugaaggagggaagagggaaggagggaaggaagaaagccaccuccgugugagagguucuuuucuggccucaguuucuaggucacuguauucugggaaaugaugauggcuuuuggaaaaugucuauuuagcuaagagauugauuuugggagaguugccuccagaccuucaaagggccuguuccugccugcggcucccgccuguucaccaggacugcauuuccuggcagaccccucgcuguguggugagcugcagacagaagcaucgggguguggcccagggagcugagccacggcggugacauuugccaguugugggaagccaggcaaccuuuccccuccucugaaccucagucuucuguccuccccaucccacuuggugcuuggauacguucucacacuugugcacauaucagaauccacccccgcgccugccugagggcuggaacagauuucuaggccucacccucagcauucaggaucaguggggcuggguggauccagagaaucugcauuccaacaaguucccaggugaaccugcuggucuggaacugcauguugaggaccacugggcuagcgaugacaaucccuugggaauuuucuauugugguggugacuaugacaaucauggagguggcauuugucuugacugacgccuacugagcaugugcugugugccauccugcguuaagccuggggucuuauuuaauuuuuuuuuuuuuuuuuuugagacggagucuuacucugucacccaggcugaagugcaguggcgugaccucggcucacugcaaccuccgccuccugaguucaagcaauucuccugucccagccucccgaguagcugggauuacaggugcccgccacccacacccagcuaaucuuuguauuuuuaguagagacaggguuucuccauguuggccagguuggucucgaacuccugaccucaagugaucugccugccucugccucccaaagugcugggauuacaggcgugagccaccacacacagcccuucuuuaaucuucacaguaacccucuucuuccucacugucaucacccuaggugggacaguggacagauugcuggcuccggguggcagucccgccucugaucuuuaucagcugagugauuuggggcaaggugugagccccccugccccucagucaccugaguguucaaagcgauugauaaugacaacaccuacccggcagaguuacugggaucacugugucaaugcacgugaaaugcauagaacaaagacauguaaagauaugaccugugaccaucccugcuuuauauggagaaaggcggggcucugggguucacacaggucaucccaagucacacagccagccggcgcuggaugcaggauugguuaccagcuucauggaugucaauuguuaguaaauacucagguauuccuguugcagugggcccugaggagaggaauuggaugccuugucccuuuuacugaagccugugagaggagagguguggaggaaggaagaaaggaggaaagguguuugcgugggagaugugcauauugauaacggggcgguaccgggccuguggagugagaaagauccggccaugggugugagcuuuucguacugacgcccugcagcuugauguuaucacagaaaacuuuugugucacuuuuguguccagaaauccuccagggacugagucaaagcaccgccucuggggcugccaaccagaaccucuuggcagcucucaaccaggagggugccccucccccgccagggcuuuuagagguugaguuugugacaccgaagggaugggucccuccuggcguuccacugggaaacagccugggccuugcuccugguacugcagcaguuggcagugcgagcaaugcugagagagacagaaagccuggaggucuuauuucaucuuguuguuguuguuggaaaugcagauucucuggcuccaaucaaccauugauccugaacgcugacagugggacccaaaaaucugcuccagcccucggguaggggcggggguggauucugaaacaagcacaagugugagaacguauccaagcaccaaggcuuccgccugccggaaagaacaaugagcuuaauuguguucgcuuaccaaacucgcccccgcucacggcgauuuuagaggaauucugaaauggucgcuucaucuuaaagucuccucgcuucucuuugagauggaugcaaaguuauugcuccuuagucuuuagcagggcacaaagcucuuugagaauugagaaguuguggaucuuuccuccaaagggggaaaaugcguccugguucagacagggaggccggccauccccgguuugccuagggcugaggggauuccuguguccugugcugacaucagccccugcagguccacggccuucugccugcaacuccagggccucccagauacccgggaccccgcuuugggcuaaggaaccccgcccucauccguuuaguuuauuuauugaagaagaugaagacauguuagcacagaguuuuuagaaaguggccuucaguuacucgguaaaugaauccuggaaagcaggaaauccacuuuucaggucuuugauaugaauguguguuuuggcuccacuuuucucuuuuguuuuuuauuuuucugaauaggcuuaugauuguuaaugugggaauguuggaucccuucuuuuuuuuuuuuuuuuuuuuuugagaugggaucuggagcucugucacacaggcuggagugcaguggugccaucacagcccacugugaccucaaccuccugggcucaagcgauccucccaccucagccacccguguagcuggaacuacaggcaugugccacaacaucugacuaacguuuuuaaauuuuuuguagagaccagaucucgcuauguugcccaggcucaucuugauccaugcccagcuaauuuucuauuuuuaguagagaugggguuucaccauguuggucaggcugaucucaaacuccuguccucaggugaucugcccaccucggccucccaaaguccugggauuacagguguaagccaccgcgccggccaaauugguauuuucaaagagcccgccucucuucauucccucaugccuggaaccugcuagauuguauugcuugucccauuuaaagggcagcucagggugcauuuuccagacaaacugugcuuuuacaguggauccugagacacaggcucucuuuggcuuuagcaaugcuuccggggcccccggaugggccgaggacagugguaaggacgggacaaaggagcuaugagacugugccagggaugguggugggcuggccucucucgagggggcacugauuacuucugcaauggcucccugagcuuggguguagcuccccacuccccucucuguuguaguaaaaaaaaaauucaccauaagccaggcaauggcucacaccuguaauccugagguuuugggaggccaaggugggaggaucguuugaggccaggaguuugagaccagccugagcaacauggugaaaccccaucucuaaagaaaauggaaaaauuagucaggcgugguggcgcaugccugcgaucccagcuacuugagaagcugaggugggaggagcccggaaggucaaagcucugaugagcccagaugguaucaccgcacuucagccugggugacaaagugagauccugucccccgacaaaaaaauacauaacauuaaacuuacccucuuaaccauuguuaagugcacagcuuauuagcauuaagcauauucacguuguaauggguucgaccuccagaacucuuuugucuugcaaaucugaaacccuguacccacugaacugcaacuucccgcuuccccuccgccagccccuguacuuccugucuccaggaauuugacuucuuuggaugccuccuauaaaugaaaucaucccagcuucaucuucuccaccaugucuugcucucuucuugaaggaggcaccagcuuggugaaccaguggcugggacuucaucuucuccccgaugaccccuggggcucggguauugugcagaggggagcguuucagaggugacauagcccagccccgcccuccugcugagugacccauugguggggguuaagcuuuuaagcucagaccugcuggugguggccucugucucuacacuacacgugcagggaggacagaauauggggagucugccccguucacccuccccacccuugaaccacaaagugccugggggcucaguccacugacagccacggccgugacaucacucgguugugaauggaggcaagaccggaguccgucuucgugcccuguagacaacggguccagcuuuucaucuuuccuuaaauuagcaagcugcugccggggacugaucaggcgaguccgugagccugggugagccuguuguccagacacuuauggugucauucuccuggggauucuauuuccuauaaauuugaagucaggccgggcgcggcggcucacgccuguagucccagcacuuugggaggccgaggcguguggaucaccugaggucaggaguucgacaccagccugaccaauauggagaaaccgugucucuacuaaaaauacaaaauuagccagacgugguggugcgugccuguaaucccagcuacucaagaggcugaggcagaagaaccacuugaacccaggagacagagguugcgauaagcugagauugcgccauugcacuccagccugagcaauaagagcgaaacuccgucucaaaaaauagauagauaaauaaauaaauaaauugaagucaucagacuuaagggacuuaauaaaucagaucgcuagauccacccacagugggggacauuuuuguggacagugguuagaagcuguuagguuccuauuacuguuagaauaaaucaccacagacgugguggcuuaaagaaacccagguuuauuaucuuuacaguucuggaagccagaaguccaaugugggugucaccaggcuaaaaucaagguggcagcagggcugcuuccuucuagaggcuucagaggagaauccguuuucuugccuuuuccggcuucuagaggccaccugcauucauuggcucauggccucuucuuccaucuucaaaaccaacaauugggccgagugcaguggcucaugccugucaucccagcacuuugagaggccaaggcgggaggauugcuugagcccaggaguucaggaccagcgugagcaacacagcgagaccuugucccuacaaauaauuuuuaaaaauuagccagguguugugguacacaacuguagucccagcuacuugggaggcugaggugggaggaucccuugagccuggaagguuuuaucacccagaaacugaacuccuugaugaugucagaaaccagcacauccugccucugcgagguacccagcugcucccuugguaccuagaauaguccagacgccacccuguguccagucuacauggcaugaauggccccugcccacaccuccugccacgcucugccugacucacuguauuccagccacccuggcugucugucuguuucuuggauaugaugaguuuauauccaccccagggcauuugcacgagccuuucccucugccugggaugcucugugcagagacauucccacggcugugacuguuuccuuuaugucguucugucuucccugagcaguucccccugaugaaacaauucugaaguagcccccgccacccaggcauuuaaccuugugaacugguuuuguuuucuucauagccgaugcuaccucauuuguguauuuauuuauuugcucacucgacucuuugaaggcaaggucuuuaucuuguucccugcugaauucccccaguuccuaauuccgugccuggcauauaauaggugcuuagaaaacacuuguugaacaaaugaaugaaugcaugauguccagucucucuggagagacccccaaggcaucaagguagugaugauuauuuccuaaggguugaugggguccacaucccaccagccagguugcccagcagugaaugauggagccccagcuggcuugacccaugagcuggaauccgcaucgcugaucacagcccuuccugugcuuccagaccucaagcaucugcaagacagccgugcacgcgggagucaucagcaacgagagugggggugacguggacgugaugcccguggauaaaaagaagaccuacgugggcucgcucaggaauggaguucagucugaaagguagggugguguucuccaacccuugacacccaaucccggcugcuaauggucccucagggggccugggaagaggcccagagucauuacccuuuaaaauaaaacucggguagacuugcacgaauucuuaccaggacucccagguaagagacuucuuugcuuuucucuuucuuuuguuuuugaaacuagggaaugcuuuucccuacuaucacauuugggauuaagaaaaaaaaaagaacuuuuuuuccuauuaccaauggacguuuuuguagaaaauuuauaaucuguaggaacaucagauaagcccgaagauaaacagucauccauaacucaucagcugggagaauuuacuguuagauuucuuggcgugcguccuuccgguuguuuuucuuugugugugugugugugugugugugugugugugugugugcauuuuuuucccacaaaaaaaugggaucaaaugauaguuacauacuagucauauaaagcuacaucguaauauaguuacauagaguuaaauaagauuagggagccuggaguccaacagaccugggcccuguuucuuaccagcuuugugaccccgaguaagccaccugauuuccuugagccucaguuuucucaucugugaaauagggauaaucauaaacccugccccacagggcuguugggaggugaacggaaauggugccuaccuauugccaguaagaaguggcaguggcugggcgugguggcucacgccuguaaucccagcacuuugggaggccgaggcaggcagaucaugaggucaggagaucgagaccauccuggcuaacaugaugaaacccccgucucuacuaaaaauacaaaaaauuagccaggcgugguggcacacgccuguagucccagcuacccgggaggcugaggcaggagaauggcgugaacccgggaggcggagcuugcagugagcugagaucgcgccaccgcacuccagccugggcgacagagugagacuccaucucaaaaaaaaaaagaaguggcaguaagaagcacucugcaaaugaggguuauguugauuacuccguauuuccacucgagaccauaccuuuauggaaaucuaugaccauaagucauugguagugacugugaaugacuguagcgcguuucucuucguagcuggugugaguccuuuccaucccagggagcagauccuccccuaguaaguagucuucuccaggaaugcuugcacacaccgugacuguuuccuuaaaucccuagaagugggccgggugugaugacgcaagccuguaaucccagcacugugggaagcagugguggguggaucaccugaggucaggugaggcaggagaaucacuugaacccgggagguagaggcuguagugagccgggauugugucacugcacuccagccugggcaacaagagcaaaacucugucucaaaaaaaagaaaaaaagaccaaacaaagucccuagaagugaaauuccuaaguggggccuuuccugagugucauucagaaagggcacucagccucccaaguagcugggauuacaggcaugcaccaccaugcccggcuaauuuuuguauuuuuaguagagauuggaucucgcccuguuggccaggcuggucuccaacuccugaccucaggugaucugccuggcuuggccucccaaagugcugggaucacaggugugagccaccgcacucggccgccaugauuaucucuuuaaagaucugcaaauacagucacauucugaggugcacuugaggguuaggacauuaacauauggauuuugagggaccacaggcgagcucguaacagggcaauguugaagauuucauauuugagggacguucuuuagagaaggaauaaaaucaaggcuguaacuugcccugggccccuggacgcucaggccuuccugccuccugggacacggccccugcuuccacugccagccuccugggcacuuugugcagcgggcuugcccugucugugaagaugccacagcaucacuuguacccagaucgugcccauucuucccgggaccccugcccggugacucugccaucggcagcccugaagagcccaaguagacagcuuccacguuuucuccuucagcacgugcggccuuugauugggaaaagcuuaaugaagggaaauuccacugauuuaaugggagggaaaugaagcagcugauuaggaggaauuuccuggccgggcuggaaagaaaucccaggacaucaauuuauugagcucuuuguacccucuuugagagaaaacagucuuccugagcagcgcagccagcugggauuuguucccugucgggcugauucaugagaacaucacagcagugcccugugggcuggggacagggaccucauugugggggccccauugguaggccccuggggagggcagggauggagagaaggcccccgaagcagcuuucccacccgccccacuaucacccaggguguggggggcugucggucuuucucucuuccugugacacccacccaaaucgccacugucgcugucuuuguaggugucuuccaggcaucccucccaagcacacaugucacuggugccuucuguacucuagaaagauuuuagugauuuucugcagcauuuccagaguuaagacuuugcuuuucuugcuccucagacucucugcuccuccguccuguggacuggcaucugugauaaugcuuggguucagcuuuucugugccucaguuuccucaccuauaaaggggggaauaauauuaccugcccccuggggugguggcagggcaggaggucuccaggugggguccccaggccaacaguguccagaucaacccagagcuuguuggaaaagcacauccuccggccccacccagcucugcugaaucggaaucucugggaggggcccagcagccugcgucugagcagguccucgggggcaucgugcugcaugcucgacugugacagcugccguucuaagagucacgcgaaccuggcaaaccugacacaagucagucagcacacacgucccacccuugcuccagccuggccugggggagagugcagagccuguuagauguggaaauaacagcucaauaguuucuguuucuuaggguuucuggacacauagagggauuuucagugacccaacccuugagauucucagcgcugaguuguccaguacaguagccaccaacggugggugcucacugagaccuaaaaugggcuuauccugagcccguuuggagaugugcauaagugugaaaaacacaccgcaucuucaagauuuuauacccuugauucugauauuauuuugcuacuaagagucauucagccaggcgugguggcucacaccuguaaucccagcacuuugggaggucgagacgggcagaucacuugaggucaggaguucgagaccagccugaccaacauggugaagccccgucucuacuaaaaauacagaaauuagcugggcaugguggugcacgccuguaaugccagcuacucgggaggcugaggcaggagaaucgcuugaaaccaggaggcggagguugcacugagccgagauuccaccacuguacuccagccugggugacagagcgagacuccaucucaaaaaaaaaaaaaaaaaaaaaaagucacucauucacugaauauucaucacgcaccugugcugggacccagggcacagaugauugagcccuagaacucacagcucagaaggggagugagcacuggagcccccaacagggugauggccgggacaguauguggcgcccgcugcacuggggacacugcucccccaguccccagcagggucaccuugggcagucucccugggccuuggcagcuccucucucuaauggguugccaugagaauuaugugagagguguguguccagcccucggcuagcggcucacaguaagcaugacaugaaacccaggggcaccuguugccacaacuucaaaagaugccaugguucuuuucucauagggucagguggcuggauccuaagaaauggccuacaugacuuaucucucaggaugaggggucagggaucuuccaggaauucauucuuucauccuugcuuccauccuuccaacgcucacuccaugcaggcaucauacacuuagggagcgcugacgaugucccuggcacccaggaucccacagggagcacaacagcagaccucugccgucaugggauuugccaucuagugagaggacacagugcagaaaugacaaugccagcagcagggcccagggggucacuguuguggagggacaguucagggaggcaucaagagggcuagucuuacuguccagaggggacuccuuggggacauggcucccaagagaacccugcagagacaccuggguguggccaugcccuguccuuuccuuauuuaggugggaucucagccaccaucucugcacaaagcagaggcugggaaauuucccaggagcuuauucccaauaggggcuguggaaacccagccuggagucagaggguggcucugucccugacggcugguaagcccuuggcgagggggcggucacaggcagucccaagggagacguagauguuguauauacugugaccaguucacagcaaacuguacuuuaaauguagggaauccuucaaucacacaaaccaccaaaacccccaaacaggauucucagcacacggggccgaaggucaguucugcuucacagugguuuugguuuagcaaugauccuccucuagaagaggacuuccuggacguuuugaaaggcagccaugcagaaaugaggcaacauaagagacuagcaccugcucucucaccccugcccaccuggguaucaaaggaaagaaaagacaucaggaagagcuuucaauacugggacgaaggugucugaauauucuuggggaaaugccggacaucugggugaaugucaguucagaauuuuucuuagaccagaaccauuuuuuaacacagauuuugcaagagauugggaaauauauaaacaaugacagugagcauucuuggccacuugauuuuuuaaaaugucaccuuuauacaaagguauauaugggugcacagccaucugaaucgcaaauucauucaccuaacacucaugggcagccccugcgcuagggacuggggacacugccgggaacagaagagagaaaaaucccuguccucauagggguguggucugcuguggcaagugcagcagagauaugaugugagcacacaugggauucuaaaguuucuagaagccaaaggaagaaguaauggaagggaaauuuuaggaugcauuuuacuuaucccaauauauccauauuauuucaguauguaaucaauagaaaauuauuauuagaaauaagaaauuuacauucuuuuuuggguauaaggucuuggagaucugguguguguuucacccuuaggcacaucuccauuuggacgagcccauuuugggucucagugaguacccacggcugguggcuacuguauuagacaacucagcaccgagaaucucaagggucaggugacugaagaucucgcuaugggucuagaaauccugagaaacagaagauacuaagcuaucauuuccagaucuaaggagcccugcacucucccccaagccaggcugccccgaggcugggacaugagguucucugugcucugcagaggagcugcugauagcagacaggcagguuccccuccuccacucguauuccaaacuuccaccagcucugcacacguuagcacaucucauuccccaacagcccugcaaaguaggaaccgucauuaucccuauuuuaucaguaaaggaagggaagcacagagagguuaaacgacuugcccaaggucacccagccuaccaggggcagagcugggacucaaaccuaggccgccuguaccagaauccaugcuuuuaagcagcacucaugacuuccucagccuggacaggccacugaacuuggggcacagacccuucccaagaaggggccagggagacccuugaaugccaagauauacuuguuccugucuuuacgauacaagaaauacauacuuauuauuuaaauaauacauccagagagcaaaaaguaagagucccaacaggugcccuguuaaccucaguuaacugcugauuuauaacuuuucuugaccuguuuuucccccgugcacauaaaacucacauacaaaucaaaacggagauuguauuauacgugcuagucugaaacuuuuccccccuaagaauaaugauauauuucaucaaaugagaugaagagguuugacaguucccuagagugugggcuuugugaggauaguucacucaccacuugugcauacccagccugcguugcccacauucucacuuugaagggagggcaagguuuaaaccuagcaggggcgauggcauuuguagcucccggcuacugagcaccugcuggaugcucgccucuggcccagguaccucccuggagaggcucauggacuuuuuacagugucccuaaggagugggcacuuugaggaacccaguuuacagauggggaaacugaggcucagagaaaaggguuaaccagcccaagguccuaaagaugagagcuaaaccuguaccugucuaacuuugaaauuuuccugagggaucaauagaggggugagacucugggagaacaagauuggaauccuuuuuuuuuuuuuuuggagauggagucucccucuguugcccaggcugggaugcaguggcgcgaucuccacucacugcaaccucugccuccuggguucagugauuauccugccucagccucccagguagcugggauuacaggcacccgccaccacaccuggcuaauuuuuuucauauauauauauguuuaguagagaugggauuucaccauguuggccaggcuggucucgaauucgugaccucaagugauccgcccaccucagccucccaaagugcugggaguacaggugugagccaccgugcccagccaggauuggaauccuuuaaaaaaaaagacuauauauagagagagacacacacacacagacacauacacauauacagacagucuuagacacuuaagaucguucaacuuaugacuuuucaacuuuauaauggugugagagccauauguauucagcaaaaaccauacuucaaauuuugcauuuugauugaaaauucuuuauacuaacuuccuuguaaaauaggccuguguuaggugauuuugcucagcugugggcuaaggucaguguccugagcacacggaagguaggcgaggcugagcugugauggaggcgagguguauucagugcauuuccgauguggacuucugacuuccgauggguuuaucaggacgcgacccaccguaagucagggagcaucuguguccacagucauguauguacacucauacauauagagacaguuauauacauauaaaugauauuucuuaauaauuaaaaauaaauuacacuuuuuaaaagccagaagacuaagcacucagggguuccucuucugccguccuuuuagugcuggcuucaggacuccacagggcagcuucccugucugccucuggaaccagaaccggccguccacccuccuuaaucccgucuguguguugggugaugccaaaaggcaagcucuuccuccucaggucacuuucaaggcaauugagggggaugcagccccacgugccugucccuggcuggccucuaggagggagccccgugcuucuggggagcucuucagagagucccuggauuguuccugccccuuuacucuggccuuuaaagggccuuucuaggccgggugcggcggcucaugccuguaauccagguacauugggaggcugaggugggaggaucacaugaggccaggaguucaagaccagcuugaccaacaggguguaaucccaucucuacuaaaaauacaaaaaaaaaaaaaaaagccgggcaugguggcaugcaccuguagucccagguacuugggaggcugagguaggagaauugauugaacccaggagguggaggaggcuacagugaguggagauugcaccacugcacucuagccucggugacagagcaagaccgugucucaaaaagacuagagaaaccucaacaauauagugaaaauaauuuuaagaucuucauagcacucaacuucccauacccagaaacaaccucuguaaacauuccaguguauuuucuuucagguuucuucuguguuuacauauaaacacgccuuuuuuuguuguuuguuuguuuguuugagacggaguuucagaguuucgcuguuuugcccaggcuggagugcagcggcuugaccucggcucauugcaaccucugccccgcagguucaagugauucucaugccucagccucccaaguagcugggauuacaggcacccacugccaggcccggcuaauuuuuguauuuuuaguagagacgggguuucgccauguuggccaggcuggucucgaaccccugaccucaggugauccgccugccuuggccucccaaaaugcugggauuacaggcgugagcuaccacacccggcuuaaacacgcuuuuuaaaaagggauuaugcuauuaguauuguuuuguuaaucggauuguggcuagcucuucaagcccuagccugucuagccacaccgugguuucaguggcugcacagauucggaggcauggagagaccaucauccguuuaucaucacugauugacacucagaucguuuccuuuuuucuuucacuguaauaaacaacacuagaaagaacauuuuugcgcaagccugugcacuuucuugccgauuuauuuaggugacuuccucuuaccagaacagccacagccaccaaagugcuguccuaaugcaaugcacagugucgcaccaaggaaaaaagucagcacauccuuuccuguguaaggcucccccgccaguggcuuuccauuguacuaagaaucaaauccgccccacucccauucaaggccgcagcugcuucggccccugcccgcucccccacccucucugugcaucuuccuccuacauuuccaccucacuggccucucugcuccuugacugcaccaagaucaugcacaccucagugcuuuuguagcugcugucugguacccucugggcucucauacguuccugggcuguuuuagacugaaauggccccucccuaggcagcguucuccaccauccagccugcacuugucuccugcucccugauggaucugugucauuuccccugacucaucaccuucugaaacuguuucuugcauauguuuugcuacuucucaccccaccccagacuguaaacuuccugaaggcaagagccucacuggucuuguuaaccccacagcccugaugcugcccagcacuuggcacauagcaggugcucaguaaacacugguugaaugagacuuugcugaguugagcaauugguucagaguugguugagggcuuuuauuucucacuuauagucccaguugcaccacugcacuccagccugggcaacauaagugagacccugcagccucaacugcagugagcugugacugcaccguuguacuccugggcucacugcagccucaacugcagugaguugugauugcaccauugcacuccuggacucaagcaauccucccaccucagccucccuaguugcugggaccacaggcgugcaccaccacaucuggcuaauuuuuuuauuuuuguagagacaggggucacugugucacccaggcugaucucaaacuccuggguucaagcaaucgccuacguuagccucccaaagugcugagacuacaggugugagccacugugccccgccugagggauuuucaauacccuguaucaaaguuguuuagugcucuuuaugaaaguugcuugauacacuugauaaaaaguccaauaccuuuuaugaaaauuacccagaaauacugcagcaauuuauacuccuucaggcauguaugggaguuacaagcuaauccaaaaagagaaucagagggcaagauuugggaaagaagggcgggaaggguauuuuauaauuaucaagccacacucguuauucaucagacacguacaacuaccaacuuccccagcauaccuggagcuuaauaacugcuugaggcaugaacaacuggggacacugaagguggggaauuuuucuuggugcccaaaccugcgggaauuuuuaccuguggcgguggauggcaccaacaguugaugcugccaguugcacgguggcauccugggcggugucagcacauucuuugauguguuaggaaauacuugcccagcuugucggggccugcucuuaccuccaaggugagcagguuguuuaauggggugcaugguuguccaggcaagauacccagggcccuugggcuggccaugucuacaucuggacggcagccugaaugguucccuugucccuugguuguuuggggcccugagaacaugagaacccacugcaccguccauagaaucugcagacccauaguaagucaggagggacacagaccccugguaauuuuccccaacguggcuugccccccaugcagaauaaccacaguaacuuguggcccugguugguucucccaggauauucacuuggacagagaauucagggaaaucuuacaucccccaaggccugaggagggcccuggaaucugaacuuuccagaaaccagcagggccgccagggucaccccagccccuggccacucuuucuccuccucuugguccggagccaccugcggccaagcguucugccugggucuuggcucuuggcguuucuuugcagcuccaucucuccgagugcucccaucugauacacguuucaaaaguucaauuccaggguagccaaaagugugaagcugccauggagaagggcuaaaaaacaaccaggaauuccaagcggccugcucucggaggauugcagaucuuagcagccugagagggccggggucuccuggcuagucuggcaguuuccaaucugggggcucucuuuguuuggagcggagauccuaaaggaaaccccgcccagaaauggugacuaggcuguuaaucuuauacucaaacuccuucaucaugagcaagaugcaaaugaaaaugauaucuggaugccacucccuaccuucuauuggucaagaaccaaaagcaagacaucacacagcgcugggaggcaucacacagcgcugggaggcaucgcacagccccguugucauuguccggggagucugcagguguuaucuuuaugcagggcagguuggcagcugucaagaugcaaaugcacguccuuugguccagcaauuccacuccuaggcgcucacucucaggcacccucacacaaaagcaaaaagucccauggacaacaaugacauuguuugcaaagguaaaaaauuagaaaacacgggcucaauggcucgcgcuuauaauccgggcacuuugggaggcugagacggaaggauugcuugagcccaggaguucgagaccagcaugggcggcauggugaaaucccaucucuaaaaaauacgaaaauuaaccaggcauggugguaugcacccguggucccagcuacuggugaggcugaggugggaguaugacuugagcccaggagguugaggcugcagugaaucaugauggugucacugcacacacacacacacacacacacacacacacgcaaaaaaaaaaagauuagaaagaacuaaauguccaccaauagggauccaguuaaauauaacacuuuauuacaauggaauacuaugcaguggauaaaaagaaugaguucuuucuguauaguaaagcaacaaaucccgagauauauuguuaagcuaaaaaagcaaagugcagagugguaugucuauggcaguauguauauaauauuuguguugaaaaaaugggugagggaaaaaauauaauaauuguuaacauccacauaagaucuaaacaucucuccucuggggagaacuuggugcagaaagacaggguugagagggagaguguuuuuugccuuaaggauuguguguucaacaacuaaaaugugcggcuaugauuagucuuuuccauuuuaauuuugauguggaaagaacacuccuggcugcacuuuuuuuuuuuuuuuuuuuuugacgcagagucucccugugucgcccaggcuggagugcaauggugugaucucggcucauugcaaccuccaccuccuggauucaaauuauucuccugccucagccucccgaguagcugggauuacaggcaucugccaccauacccagcuaauuuuuguuuuuguauuuuugguagagaugggguuucaccaucuuggccaggcuggucuugaacuccugaccucaagugauccaccugccucaaccucucaaaauguugggauuauaggcgugagccacugcaccuggcacugguugcacuuuuuuuuuuuuuuuuuuuuuuuugaugcagagucucacuguaucgcccaggguggagugcaguggugugaucucggcucguuguaaccuccaccuccuggguucaaaugauucuccugccucagccucccaaguagcugggauuacaggcaccugcuaccacacccagcuaauuuuuguuuuuguauuuuugguagcgaugggguuucaccauguucccaugcuggucuugaacuccugaucucaagugaucugccggccucgaccucucaaagugcugggaugacaggcgugagccaccgcgccuggcccugguugcacacugugaacaacgcuuuggggucuacaaggcgccaugcugccuucuagaacaaaauuccaacaaaugcgaguuugcaagaucuuaucggcuuuuauuagcaauucauguaucaggcaauaucccaaguacagaauagaaaggugcuuccacgaacugagcagcgaggggagguuuuagagucagcaaaggcugcaugcagagaguacaaacgaugaacaggccgggcgcaguggcucacgccuguaauuccagcacuuugggaggccgaggaggguggaucgcaaggucaggacaucgagacuauccuggcuaacaaggugaaaccccgucucuacuaaaaauagaaaaaaauuagccaggcgugguguuggacacuuguagucccagcuacucgggaggcugaggcaggagaauggcaugaacccaggagguggagguugcagugagcagagaucacgccacugcacuacagccugggugacagagcgagacuccaucucaaaaaaaaaagaaacaacaaaauuuggaugggucgucccaguuacuuuucuuguaggauuaaagcaggaaggccacacuauccugcuggcucagagggacugggggcccuuuugauugguuguugcuguguaucuccuauuuuuuggaaaaucggcccauugcuuuuuuuuuuuuuuuuuuugagacagagucucacucuguugcccaggcuggagugcaguggcgugaucucgcucaccgcaaccuccaccuccuggguucaagcgauucuccugccucagccucccagguagcugggauuacuggugccugccaccacagccagcuaauuuuuguauuuuuaguagggguuucacuguguugagcaggcuggucucgaacuccugacuucaagugaucugcccaccucagccucccaaagugcugggauuacaggaaugauccaccgugccuggccuaaaaccagcccauuucuaaguucaguuugaugagguggcaccuagcagggugacuccgaucugauuugguuuggucuguugggccuagcccaguccaaaacaauggccucccgucaauuuaaugcuccccuccucccaccuuccgggucuccucuccagccuggccccuuccuggaccucccccaagaacccagguacccccaacaucggcacugucacagaacauuccggaaaguauccuuagaagccuguaaucccagcacuuugggaggccgaggcaggcggaucaugagcucaggcguuugagaccagcccggccaagagaccagccuggccaauauggugacaccccaucucuacaaaaaauacaaaaauuagcugggugugguggcgcaugccuguaauuccagcuaguugagaggcugaggcaggagaaucgcuugaaccugggaggcggcgguugcaaugagccgagaucacaccguugcacuccagccugggcaacagggcgagacucugucuuaaaauuuaaaaaaaaaaaaaaaagcccaaagagacuuagugacuuugucacacaguuacuaaacguuaguguagggauggagacucgcgucuggaagacaugcuccagaggugagauuugcagaaugccaaagcaggaugcaugggaaaucuuauucccaaaagcaguguucaaaaacagcuguuucaggacuccagaaauacaccacagagucauacaacgaacagggagguguuuguucaaaaaaguguggaccucagauaagaacagagggaucuguggugucugagccugggaccgcuccuguucaccccaccagcuccuguggcuggaaguucuacugggguggggcugugccauccagcggcuuucuugauuugaagcagagcgaggaaaaccacacaccucuggccauugucaggaacaguaucaaaccugguggccaagacacaggaaggccaguugguccaaaggugcaguuaucaucuggggcagaaaaucagggaggaucuagagaaugagacagccgugguggcccuugguaggcucccaggcgucccugguguucuagaaggcugugcccacagcaagaggagcaaagcgggagggggcacuuaggcuucccaauucugaaacauccuauacagcgacagugaucaagaugguggugcugacaucaggacagacacagagauuaagagaacgugauugggccugguacgguggcuuacgccugaaaucccagcacuuugggaggccaaggaggggaggaucacgaagucaggaguuccagagcagccuggccaacauggcaaaaccccaucucugcuaaaaauacaaaaauuagccccgcgugguggugugcaccuguaaucccagcuacuugggaggcugaggccagagaaucacuugaaccugggaagcagagguugcagugagccaagauugcaccacuguacuccagccugggcaacagagcgagacucggucucaaaaaaagguaaaaaaaaaaauuuaaaaaaaaaauuaaaaaaaaaaaugauuggaaguccauaaaauaaaucaucacacuuccagucaauugauuuugacaucggugccaggaccauucagugggcagagaauaauuucucaacaaaugaugcaagggcaauuagauauuuacaaguaaaacugugauguuggaccuuugccucacacuauauauaaaaauuaacucaaaauggauccaaggcugaaauguaagagcuaaaaauuacagaugucugagaaaacaaguauaaauccuucaugaccuuggaugguuugcuagauaugacgccaaaagcacaaucuauaaaugaaaacaaauugauaaauuguauucuaucaaaguuuaaaacuuuuaugccuuaaaagacaccauuaggccaggcacgguggcucacacccauaaucccagcacuuugggaggcugaggcaggaggaucacuugggcccaggaguuugagaccagccugggcaacauagugagacuccaucuguacaaaaaauaaaauauaucaaucaggcuuggugacaugcugcucaggaggcugaggagggaggaucgcuugcacucaggaggucaaggcugaaguaagccacgaucaugccacugcacucuggccuuggugacagaccuugugucuaaaacaauuuuuaaaaauugucuaacacuggauuguggagaugacugcacaacucuauaaaaucucuaaaaaccauugaauuguacacuuagaaagguugaguuuauacgguauguuaaacuuaauaaaguugguuugguuuuuuuuuuguuuuuugaaacagagucucacucucuugcccaggcuggagugcaguggcagaaucuuggcucacugcacacuccaccucccacguucaagugauucuccugccucaaccuucaacuagcugggauuacaggugcacaccaucaugccuggcuaauuguuuguagaggcaggguuucaccauguuggccagacuggucucgaauuccagaccucaagugauccaccugccuuggccucccaaagugcugggauuccaggugugaggugugagccaccgugccugaccaauaaagcucuuuuuuuuuuuuuuuuuuggagacaaagucuuacucuugucccccaggcuggagugcaaugccuugaucuuggcucacugcauccuccgccucccagguucaagugauucuucugccucagccucccgaguagcugggauuacaggcgccugccaccacauccggcuaauuuuuguauuuuucguagagaugggguuucaccauguuggccaggcuggucucgaacuccugaccucaggugguccacccgccucacucccaaagugcugagguuacaggcaugagccaccgcgccuggccuaaagcucuuuuuuaaaaaccaucuuugauuagcugaaggauuuaacuccucuugugagagggcaguuuuuacuagccaugggacccuggguaaaucucuuuauuuccuggugucuccguuuccuccccugugaacgagcgauaacagcucccucaggaggaagguggaaggcggugaagcaccuggcauaugcaguagugcugagauagcaccuguucaucucucccaagacaccacuguucggguugacaggugguagugaaaccaagcagaauucucggagggugaguccaauccagacagacuggguccagcagaucccugaguuaaaaggaaauaacuuaacagccuugaccuagaaucagauggaugcucaugugcagagaaaaugggauuugccaccuguucucaacucaaggcaggcucugugucuggcggcuucaaggaagugucccuuggccauggcucuuccacuacgggagcaagcaggaggcacccaggucucccugcccacccagagucccugcaggaggcccuccagaucucucaguaacgggcccucuuucuucuuuuuuucagccuggggacuccucgggauggaaaggccuuccggaucuuugcugucaggcagugaauuuccagcaccaggggagaaggggcgucuucaggagggcuucgggguuuugcuuuuauuuuuauuuugucauugcgggguauauggagagucaggaaacuuccuuugacugauguucaguguccaucacuuuguggccugugggugaggugacaucucauccccucacugaagcaacagcaucccaaggugcucagccggacucccuggugccugauccugcuggggccugggggucuccaucuggacguccucucuccuuuagagaucugagcugucucuuaaaggggacaguugcccaaaauguuccuugcuauguguucuucuguugguggaggaaguugauuucaaccucccugccaaaagaacaaaccauuugaagcucacaauugugaagcauucacggcgucggaagaggccuuuugagcaagcgccaaugaguuucaggaaugaaguagaagguaguuauuuaaaaauaaaaaacacaguccgucccuaccaauagaggaaaaugguuuuaauguuugcuggucagacagacaaaugggcuagaguaagagggcugcggguaugagagaccccggcuccgcccuggcacguguccuugcuggcggcccgccacaggcccccuucaauggccgcauucaggauggcucuauacacagcagugcugguuuauguagaguucagcagucacuucagagauguaucuugucuuugucaggcccuucgucuucauggcccaccuguuuucugccgugaccuuuggucccauugaggacuaaggaucgggacccuuucuuuacccccuacccguuguggcucccacccugccucggacugguuuacguguccugguucacacccaggacuuuucuuugcaagcgaaccuguuugaagcccaagucuuaacuccuggucucguaagguuccacugagacgagaugucugagaacaaccaaagaaggccugcucuuugcugcuuuuaaaaaaugacaauuaaaugugcagauuccccacgcacccgaugaccuauuuuuucagccgugggaggaauggagucuuugguacauuccucaccgagguuagcagcucaguuugugguuaugaaaccgucuguggccucaugacagcgagagaugggaauacacuagaaggaucucuuuuccuguuuucgugaaacgacucuugccaaacguucccgaggcgccaaggaguguaguacacccuggcugccaucacucuauaaaagugcuucaugagcccagaccaaaagcccacagugaaaugaaguacccuuuuguaaauagcauuuuuuugcagaaggugaaaauuccacucucuaccaccgggccagccaauagaucacuuuggugaaugcuaguuucaaauuugauucaaaauauuucuuaggugaaagaacuagcagaaagucaaaaacuaagauacuguagacuggacaagaaauucuaccugggcaccuaggugaugccuucuuucuuugauugccuuucuaauaaaugcagaaucugaagguaaauagguuuaaaacaaaacaaaaacccaccccuuuaaggaguugguaaaaagcaguucaacucuuagcuugacugagcuaaaauucacaggacuacgugcuuugugcauuguagucuagucguaauucauagguacugacuccucagccccaaaugucggagaggaagaauucggucagccugucaggucgugaguccaguuaccaccaaacaucugggaaacuucugggugcugggugcucugcugcuggacuuuuguggcugugucugugucugcaagauaaauuagaucgcccugugggguuugcagaauuagugaaggguccaggacgaucccagugggcucgcuuccaaagcaucccacucaagggagacuugaaacuuccagugugaguugaccccaucauuuaaaaauaaaguccccggguuccuuaaugccuccuucacugggccuuccuagcaggauagaaaguccuugcccagagcaggaccuggcugucuuuuuuuuuuuuuuuuuuuuuuucccgagaccaaguuucacucuguugcccaagguagagugcaguggcgugaucucugcucauugcaacugccgccucccggguucaagcaauucucaugcaucagccucccaaguaccugggacuacaggcgugagcuaccaugcccggcuaauuuuuguauuuuuaguagagaugggguuucauuauguuggccaggcuggucucgaacuccuuaccucaggugauccacccaccuuggccucccgaagugcugggauuacaggcaugagccacugcgcccggccauggaccuggcugucuuuaucauccccacaaacauuuugaaacuggaauauuugucuucagaaaauggaaacaagacuauaaaugauaagcccugucccuagcaccaccucuccuguguguggaauagaggccccucgugcuaccaacacuuacccuguguuuaaaaagaucuuguaccaagccaacggcguuccuggcucuccugcccacaggaugaacauuuucggcuuccuuaggaguuuugcccuaccguauuccaaagcgugugcugguuucucauauugucuguaggcucacucagcccgcaguuuaugugugugcuuuuuucuaugaaaaaugauguauuuugcuacuuccuguguacaaaguuuuauuguaaauguuuuuugugcuuugcaugaacaggggccacguuguugcaauuguuucaguagaacugguuugauuucuaaaauguuccuguaacauaucuuuuaugaacaaaucugaacaauuugugaaauaaaacauugaaaaccauc

SEQ ID NO: 191981 - RNA, 37075 nt, Homo sapiens
acuuccggcgcucgcaccgccccgcucuccagccaaggcuccgggcugaggcauuugcuuggcugcagccuccuuccgaccugcccggcgggacccaggggaccaagccgagccgagccgcggggcccgcuccagcccggccaugagcgcggccgcaugaugcgucccugccucggccgcugcagucgccgccgccgccgccgcaggccgggaggagccgcagcgccgggcgaccccgcccgggccucgggugagugcggcgggcugggccgggcgggcugcucacucccgggucucccggccacuucuggcccccggcgugcccuguccuuccgucgguuccgccgcucugucuccaccccgccgcacaccugcgaccuucuggaguuccuaggggcaccuccgugcccgcaccugacuucccuuccaggugcccccuugucauuccuuaguugcucucucgggauagggcccggauugcagccccagcuuuuugccugaccuugggcgugacacucagcucuccgagcccugguuuucuguguggcuaaugacgggguggugguuacagagcagcuauaaacccuguguaagcuguaaagaguuuuuuaauaggcagguauuacaaugagcagucucgcacuucgcguuguggcuucucuuccucuuaagcuguaaacuuuucucuuuuauucucugcccaucuuccuaguuaucuucccuccugcuccacgucagucaucuuuggguguuaguugccugaaagggcaucugggacaguaaagcuuucagggcaguaaggcucaccucuccuggugugguuccuucuacaacuuugucacacucaguuagauagacacacuuuauuagcuuaugaagaaccaguuuauuguggccguuaaauuggaguguaagagacaguguugaugcggcuaccugccuuguagcuucuuuuacugucugggcuguauacagugcugggcaaaucgcugcuacaguguugcauuuucagucugcuuaguguaugcacuuaagcgcacguauuuaucuauuuuacuguuacuaucccaagggguuuagagauuuaggucaauguguauuaauauuucuuucugaacucuucaucucacagaugaagaaucucuuuuuuguuauguuuuacaguguuuacauaccugaaaucaccuuuuagucacuuuguggccugguacgcacgcgguggcucguggcucaugccuguaaucccagcgcuuugggaggcugaggcaggaggaucacuugagcccaggaguuggagagcagccugggcaacauagugagauccccuucucuacaaaaaaauuaaaaaauuagccggauauggugguacacgccugaggucucagcugcuugggaggcugagguggggggaucacuugaguuugagaucaugccacagcacugcagccugggcaacagagugagauccccaucucaaaaaaaaaaaaaaagucacuuuguuaaauucgcuuguuaaaagucagaacuuggccaggcacaguggcucaugccugugaucccagcacuuugggaggccgaggcgggcggaucacgaagucgggagaucgagaccauccuggcuaacacggugaaaccccaugucuacuaaaaauaccaaaaauuagcugggcaugguggugggcgccuguagucccagcuacucgggaggcuaaggcaagagaaucacgugaacccgggaggcggagcuugcagugagccaagaucgcgccacugcacuccagucugggcgacagagcaagacuccgucucaaaaaaaaaaaaaaaaagaaaaaaagucagaacuugguuaaagugaaaggcucuugggauauuugaaauauggaauggaacugaaauauuaacuaaauugcaauucuugaacauucuggaaaauagguuaggggcccacauuggcuucugauuugagaguugaaggagaagaagacuauuugaaaagguaauucccaaaggauucgcuaaguaacaaugggaacucuucugcuaccauuggcucagagccugccucaguugacagauuaaugaauugaaacuuuacagcccugcuaaucaaugaacuguaaaaacaaauccucuucaagaacagaagaguauuagcaugaauagaauggcccucucagugagaaagaaagcacugaaaugaacuuuauauaagaacaaucuugauucagucaaaaguaugaacguacuuuuacauucuuacugaaacuuaccugcuggcuuggaugcuuuguugauauaaauaauacaaucuuuguuaaauuaacaaagaaaauggguguagaaauaaguucauguagaaaguuaauguuugggaugaacauugaauaguuuucgugauuggacaacuauacaagauaauuuuacuaaagcagcuuuuugggguauguuucuguaauauuuuaacuuuagaaguacuuuuuuuuuuuuuuugagacggaguuucgcucuuguugcccaggcuggagugcaguggcucgaucuuggcucccugcagccucuaccuccuggguuaaagcgauucuccugccucagccucccgaguagcugggauuacaggccugagccaccguggcuggcuaauuuuguauuuuuaguagagacaggauuucuccauguuggucaggcuggucuccaacuccugaccucuggugauccgccugccucagccucccagaauggugggauuacaggcgugagccacugugccugacccuuuuuuuuuuucuucaaacccuagagcagaacauaaagucaaaacugucauuuucacugaaauaucuuauucccaaaguuagucuccagggucaguguuaacaacuugcugugugacccuucgguuguaacaucugagaagaguuuagcuggacugugccaguuagcuagcuauaaaguugagugggaauagugccaguccacacaggacugcccucacuugugauaccaacugcaaguuggcuuuuuuuuggggggggguguagguggugguucccaaaaccacccuuggguggaguccagggaaguaccagauggggaagcaccaaaggcacgauuguccucucccuguggacucagaacacguuacuuuuuuggcauugaugugugacaguaugcauggaguauugccagccugggaagcucaccugagucuuuguagucaguuuuuauugaggccccauuaugcaggcaugauugauugauugauugauugcccacaugguugauauuaguucccagauagacugauacccugugacgaagagcuccccccucacccuacaucauauuguuagcugaggacaaagggcagaccucuuuuuggguaagauuaaauaagguuaaauuguuuuuuguuuguuugcuuugagagggucuugcucuuuugcccaggcuggagugcgguggcacaaucauggcucacuacagccuugaucuccugggcucaagugguuucuucuaccucagccuccugguuaacagggaccacagguguacgccacccuguccggcuuauuuuuuguagagauagggucucacuaugauacccaggcuggucugaaaccccugggcccaagcaauccaccugccuuggccgcccggaggcauguuauacugugccuggccugguuaaauuauuuacuacauauccuacuucuuuccuggucccuuccuacuugaaaauccuguauacuacugugcuuugccauugacaaaugacugucccuucuagaacauggaggagacacaggccacagggagagcucucaaccuuaguucccuuuuaacuaaaaugucuucgaauauccaucagucauuuucuucugcuuugccucugaggaagagacagucccuccuuccugauguuaacgcuugugucugcuuuggucugcuuguuaugggacugugaauuaucauuuacuaucucuugccuuuuugauuguuuuuuccauuugcugguuucuucacuucuauuuacaaacauauccuugucuuaguaaucuuggcccugcuugcuucugaguuccauuccauuccauucuuuuuuuuuuuuuuuuugagauggaguaucgcucuguugcccaggcuggagugcgguggcguggucucggcucacugcaaccuccgccucccagguucaagcgguucuccugccucagccucccgaguagcugggauuacaggcacccaccaucaugcccggcuaauuuuuguauuuuuguagagacggguuuuuaccauguuggccaggcugaucuugaacuccugaccucaggugauccaccugccuuggccucccaaagugcugggauuacaggcaugagccaccuugcccagccuccauuccauucuugaaaaacuuuucaguagaauccuauuaauccucuaaucaaacccagacuccauauggggcccagacaaugccuuauuuugguucagcaucuuacgguuuugaaaacaccguguucuucuacggugucuuauagguagugggugcuugaaaacuguuuggugaaugaauaauuuggcaaggcagagaaagaauucuaauuggaggaaacaggagcaaaaccacagagcuaugaaaggcgagguaaggggaauccaaaggagcaccauauggaagagaguggggaauguugagccuggaaagguugggagagccagaagguuucgcaacagguugauuuugugaccugugcugugguuuuguuuuauuuaauuuuuuauuauuacuauuuuugagacgguguuauucugucaccuaggcuggagugcaguagcaugaucucaacuuacugcagccucaaccuccugggcugaagcgauccucccaccuuagccuccugaguagcuggggcuacaggugcaugccacugaaacuggcuccuuuuuuuuuaaauuacagaaauggggucaggccgguugcucaggccugucuugaacuccauguugcucaggcuggucuugaacuccugagaucaaaugaucugcccaccucagccuccuaaagugccgggauuacagguagaccggugccacugcaccuggcccuauauauuauuuuaaaauuauuuaauuuuauuuuucaaggaauuuuuauuuagguuuuuaauuuuuuugagacagggucucucucuguuacucaggcuggaguacagugaugcagucauagcucacugcagccuugaacgccugggcucaaguaauccuccugccucagccucucgaguagcugggacuacagcuguguaccacugcgcccagcuaauuaaaaaauuuuuuuuguagagauagggucucgcuauguugcccaggcuggucuuuuaacucaaguguuccuccugccuuugccucucaaagcacugggauuacaagugugagccgccaccucuggccugugcugugauuuugaacggugauuccugcagccauguggagagucauuggaaucuagugacccuugaaguuagcguucugcagagguacaggcuagagaugagggcugccuaaauuuggguugugggaaaggugagaaggaucagagcuguaagugggaagugucgucauacauguaggaauggaggaauuuuguguccagaggcuaaaagguggugaaucaauccugguugcaugaggaaugucacugauuuggaaaaagacgcuagcucuauguuaagcuggugguuugguucaccgggaaacacugccguucauuugcagcacugcgugaggaggggcagucagcuagagaggcuuccagucucauuggagaccagcuuuuagaguucacugaaauguuuugaauucuuagauuccauauuuccaacauucaauuuauucauuacagaaugcacuuucuuaaacugagugcucuggaagccaguguauuuuaguggaagaacacgggcuuuggaaucaaaacaguucugacuccacccuaacuggcuguggaucugagcaaggcacuuagccucuaagacucaauuuugucauccugaaaaugagcucgugauacgccuggcuuuuagggugguggucacguguguaaaucuccugacaaacagaguagaugcucaguaaauagccuuucuucucaccuucaaauguuuuauguugucauuaacuuguaauugagggcuaaauguauuguuagcaugucauauuuucuuaguauuuugaacucugguuaaucuggcauuauaaaagcucauuuuguauuaaacagggaaacucuaggaagacagggaaggagguugggaauaccagccugauugaggcucugcucuucccugggacaggaugcuuaaugagguuuggaacucuagaguucuuuuuauuucuggauuuagauuucuugaggguuuaguuaccaugcugggauuuuuaaaaauagcugcuccauuugacugucaaaguuagguuguggcucucguacagggaugaaaggggaaccuuugggguacgaguaagcauuccuuggaggccaccucaucuggccugcgugcucuagugaggucccgcgcacauguuuucuggaccugaaguugugacuugccuacaggugggguuuuucucuucacccccgucucccucuuucucuauaacccuugugcauuucucuucuacuccuuuucugccaggcuccuuugggccucuggcccacuccccuggcagaucuuaucacacgccccugucguuugccuguggacuuccuuucuacuuuuucuugucucccucaagcacccuccuucccuuacuuauucacucaagaaauguuuguggagugcguggugaacccgggagugcuggggauacuaugaguaacauuccauugaggugauggcagaacaagcagccagggagaggcugcuaggaagggaggccagcaggcuccagauggaguggggcuuucuaggccaugguggugggguggagugggggguggggugggauuuuauucgcacugaaaaggcagugauugcaugagcuuagggaggggagugacaugaucugauuuacgucuguggaagaccacucugggugcugcaugggggacuggacuguugggugagcagaggcaugagaguagagagaggacuggucagcaggugaucuaagcacuccccaggugagagcucaugggaccuuggucugggcgggugaggaggugggagaaguggucggauuugggguagguuuagaggugcaccccauaggacuugcugaucagcuagauguggagagguggggaaugagauacaugaagggcggggccuuuuuuuuuggguguggugugccguugauugagaugggaaagaguggggucgugacugagugggggagguucugcuuugacccuccugcccuggaguuguuaaguggccaguuggauagacgcccuuagggaugcaucgucagccugagaguuuuccagauaucuuuuuuuguuuaaacuucgugaaacugagguuccccauuagcuccuuuguggagagcauguagaugaagggaaggccgaggacuaagcccgggugcucccggcguuuacauggguggaggagaaguauccagucagagaccggguguggcuagggggaagggaagucaguguugucccccaggccccucacuccugagacugguguucccucucccacuuccacgguucauugugugcuguguguguucccccacuuugccauguuuuugaucugcaguguucugauccuacuguagagugauuaaguauuuuaauaugaaaugcccuucuagaaaggucaggcaaugucacuauucaccguaugacuuacgugccagcauaucauugagaucuggcuugaguuggguuaauauucugguguggauuuuuuuuuuccuuaaaaguaauauucugaucuuuggauucaguaauuugaguagaaaaucaugguuucuuagagcaucauuuccuaugguaggauuugaaaggacaaacugaauauuucaugauugccaguugauggcaagagcacuuaggagcgcagucgccaucagcucacugcagugggucagcugagugcugcgcuccuuuugugaguugagggaggacgugagcucccucuguagccuuccccaccuugacucagguucccugacucauccgggcugguggcauaccugggauguggccccguuugcacggcccauaggaaccacugccuccggaucuuacagcgccccccuggacccagccucaguccugccccucacuuccucugagucuguuucucaggcuccucgggcccucagugcccugaguuucggucacuuggcuuaccaggccucuccuccugcccccuggacucugagguuggccucucccgcuugcaucuuggucuugccuucguuacucugcuuuucuagcccaucauccuggcuaaucuccagcccuggguaaguuuauggugcugggcugggcuuuuggauaaaaggaccagccauucccauccucuaugagacacuuaaggugucagcauugucugggcccugcagggugacaguucaggccccucuuggccgccgccucuccaccccauuuccauuuugcggucuccauaggcccucccagcgccgcagccccgcuccuccucucugcugagacacucagcacucgucuuccugagugaacugcuuucacuucucuucaugcccggguuuccccuuucuuccuccagggaggaaggaucauuccgcuuugucgaccauccccccacuccacccacgcuuucuccuaucgauaaaauucacacuugauucagauuuccucagcuuuuccuuaauguccuuucucugucccaggaucccacccaggaucacacaggacaugagugggcacaucucgucagccccucuuggcuguggugcuuucucaggcguuccuuguuuggaugacuggcacuugggagcagugcugugggucagggauuuuuuuguaggaugcucuucucuugggacuuguuugauauuuuccuuaugacuagacuugggugaugcaguuagagggccugucucgccacagccugucaaggcuguguucuguccacaggacucauugcuauggauguggccuugaacaccuggcugacugaggugguguuugccaaguuucuccucaguaaaguuauuuuccuccuuuccguacuccacucguuagaaacugucccugugaacggccauacuugagggguggggagcagcguccucccugcuggaggaggaggagccacaggcauuccucggacucguggcgcuggguauuugucuauuuucuguuuauucagccacugcuuuauaucagucuggacucgugcauguuuacuugaugcuucggguuauaaagcaauacuauuuuauuuuccuggaaaaagcuuuggccauugggagcucuuuuacuugguuccuauaucccuuucaugagcccaccuguccccaugauuguguguguguauugugaacacuucauuauucucuggcaauacaagaugcuccaagcucaucuuguauauauauuuauuuuuuuugccucaguccugguuccuuuuauuuauuagagaaugguauuaaaaaccaagaucugugguggcucacaccuauaaucccagcacuuuggccgacaugggaagaucgcuugaguccaggaauucaagagcagccugggcaacuagcaagaucccaucuugaauauuaaacaacaacaacaaaccaagaucugggaauuaggugugcugguggcuguugguguguugcuucuaggccgucucagcugacagagcaaguaaauauauguguggaugcuaacccauguguguauacauaucuguagauauuuccauaugcaacugcuuguaucuuccuuaaaccaaaaacuuaggucauucuagcuuccuccucuugcuuaccuggaaacuuccaccccaacagugagaagccuggcucuugccauccauuuacuuaauuuuuuuuuuuuuugagacagggucuugcucucuugcccaggcuggagugcaguggugcgaucuuggcccacugcaaccucagccuccaggguucaagugauuuuccugccucagcugcccaaguagcuaggauuacagguacuggccaccaugccuggcuaauuuuuguauuuuuaguagagacgggguuucgccguguuggcuaggcuggucuugaacuccugaccucaagugauccacccaccuuggccucccaaagugcugggauuacgggcaugaggcaccgcgcccggccccaguuaucuuuuaaaccaucugguuuaccuaaggucuggugccucccauuccagcagagugaagucuagaguuccagguuucuuagcguggcauucaggcugugguuccauuggaccucaggcuuguccuucuggucacauuccccucuggaaugcugaauucccuucugugcugugucacaugauuguccucucuuguccaugucuuucuggucugcuggggcccacccaugcugucuguugucuuuauugacacuuucucugguucuuccagaaguagcuguuuucauuucucucccugaucacacuuugcugcuaacuuggggaaagcacuuugcacauuggauccucaccucgcugcugugugcgcucugcuccuguggcucaggcugucuuuggcugcacauccuugaggccuugcacagaguacgugcuuggaugcucaccccccaacuccccagccugauguuugaauugaguggacuguucauggcagggguugaguuuguuuuguaaccuucuguccuaaaacagguuugcuuaauuccguuuuuuauggggcugaaguggguguaugaacaguaaagcaacgacaaguuuaaauaguauuuuaauauaaacauggauaccagacucuaggguggacauucuuagcagugcagugguaaaaauaauuaugucuugguucuuuucuguagucacugaucaccagagaauacugguaucuuuuguuuacuuguuuucaguguguuccugagaaauacauuuucuguuuauagccaaggaaaaaaguaaaggcgaagagcuuaagacacuugcuugaaguuacagauacaaguaaauccaagacagggucuggacucaggaacgcggguuauccaggaagaaaagugacuccacugcucgcugggacuugccuugugccgcacccuugcacuaucacaccggccguacauaccugugcuggguauuuuuucuccugcucauguuuuuaauugaggcaugauuaauguacagugaaaugcacaauuuuauuuuauuuuauuuuagagacagggucuugcuuguugcccaggcuggagugcaguggcacaaacacagcucacugcagccucgaccuccgagacucaagcgauccuccugccucagccuccugagcagcugggaguacaggcccugcccagccaauuuuuaaaaaauuuuuuuuguagagacagggucuugccauguugcccagauuagucuugaacucuugggcuuaagugauccugccuuggacucccaaagcacugggauuacagguaugagccacugugcccggccccacaauuuaaaguguauagucuauugggcuuuuuuuaaacagcgaauuguauuuuguuuugacaaacgcauaugccugugucacccacuucccucucaagauacaggcaugucugucaacuuacaauguuaccuuggcccucuccacagucacuucuacuugugcucaaauccuuauucugauuucuuucuaaauaaacgaguuugccucauuuagaauaucauacacauagaaucacacuauauauucuuccgugucuggcuucuuucacuuagcauaauauuuuugagauuuagccauguugcuuguaucaguaauauuuuccugcuuuuuugcucagaaguaugccauuauaugaauacaccaauguuuguuaucuauuuccuguugacggguuuggguuguuuucaguuuggggguauuaugaacaaagcugcugugaacaguaucggacaaguuuuuguguucauauuuauauuuauuuuucuuggguaaauaccuggaaguggaaucucugagucacaggguagguauuuguuuaacuuugagaaagugccagacugcuuuccaaagugguuacuuuuuaaaauuuauaaaauuaauuggagauuugaucucauuguagaaaaucugguguagaccugaugcuugcgauucacaguccugaauuuugcaaaccaguuuccgauuuuaagacauugcuaagauaagcucauuggaaaacaguucaaaauauuacuaagcauuucaaguuucuggcuggugcauagauguuugaauaaaguuacuauauauaaaugcugcauuuaggcugggcacgguggcucacgccucuaaucccagcacuuugggaggcugaggcgggcggaucaccugaggucaggaguucgagaccagccuggcuaacauggugaaacccuguuucuacuaaaaauacaaaaaauuagcugggagugguggcgugcaccuguaaucccagcuacucgggaggcugaggcaagagaauugcuugaaccccagaggcggaaguugcggugagccgagaucgcgccacugcacuccagccugggcaaaggagugagacuccaucucaaaaaaaaaaaaaaaaaaaaaagguucagaagggauugagagcuggagcucuguuggggaaccagugcugugucaguguuugucuagggccugggcagaagcuugagggaaaagcgaccccugagggaucuugcagucggugugaugggcacagggaccuccacagagcgggcccagguggaggcuuggcacacuagggcgggagacagcgagccaucucggguuaucgggaggcaccccagaauauguuuucagaaacuagucagggcucuugguuucagacaacagacaguagcuggggguugacucaggcagaaaaagcacugucguggaagcaucucagcuacagauggaguggaggagccaggcagccggcgccgaagccagagccgaaaccuaccacaaggagaucugcuugcgcccuuuucucccagggaccccugugcucaaccucuguuguuuggaagguggaccuccugacccgaucuucuaauuuuuuuuuuuuuuuuugagacagucucgcucugucacccaggcuggagugcaguggugcgaucucggcucacugcaaacuccgccucccggguucgcgccguucuccugucucagccucccgaguagcugggacugcaggcgcccgccaccacgcccggcuaauuuuuuuuuauuuuuaguagagacgggguuucaccguguuaguagcuagguuggucucgaucuccugaucucgugauccgcccgccucggccucccaaaguacugggauuacagacccgaucuucuaauuuuauuuuacauucucuucucaguguuuucucucugucuucuaguucuccucucugggacauuucuauuuuuuuuuuuuuuuuuuuuuuuagacggagucucgcucugucgcccaggcuggauggagugcaguggcgccaucucggcccacugcaagcuccgcaucccggguucaugccauucuccugccucagccucccgaguagcugggacuacaggcgcccaccaccacgccuagcuaauuuuuguauuuuuaguagagacgggguuucacuguuuuagccaggauggucucgaucuccugaccuugugauccgcccaccucagccucccaaagugcugggguuacaggcgugagccacugugccuggcccauuucuacucuuuuguccaauucuguuuaagaauauuuagaggccgggugcgcugucucacaccuuuaaucccagcacuuugggaggccgaggcgggcggaucacgaggucaggagaucgagaccauucuggauaacauggugaaaccacgucucuacuaaaaauacaaaagauaauuagcugggugugguggugggcgccuguagucccagcuacucaggaggcugaggcaggagaauggcgugaacccgggagguggaguuugcagugagccgagacugcgccacugcacuccagccugggcgacagagcaagacuccaucucaaaaaaaaaaaaaaaaaaaggaaaauuuagaaucuauagacuguuguauuuucguuguagaauaaccaggaaguucuuaaacuguuccucuuuuuguuucacagaaccaaucucuucucuuauuuugaagaauaugaauuuuaccuaugccuuguugacauuuucuucucugugcauugugcguguucuggacucuuacccuucauuucuguuuugugcucuuucaugaaucguguuuggauuuaauuuuuuuuuuuuuuugagacagagucuugcucugucgcccaggcuggagugcaguggugccaucuuggcuuacugcaaccuccgccucguggguucaagcaguucucugccacagccucccgaguagcugggauuacaagcgcccaccaccacguccagcuaauuuuuguauuuuuaguagcgacgggguuucaccaucuuggccaggcuggucuugaacuucugaccucaugauccacccgccucagccucccaaagugcugggauuacaggcgugagccaccgcgccuggccuggacuuucuuuuuuuauaauggagcuacgacaagcacuuggaaccucuguguccguggcggggguuucccuguggccccugacuuagggaggucugacagugaaucugaccuucuuguuggguuuucccuacaucgcagagucuuuagaccuuuuucuugggucauguuagugccagagaggauuccucgacccucccaucugucaggguucggggagcuacgugggagaugcgugccaggagucucugcucucauugaguggcccucacuggguuccacugucuuccuucaccuccucgccccucccacagcagggccugccauucuaguccaccccuccugccucaagugcucugucucucuguucugugauuccuuuaauguggccaguaaaucagcuuaucgacgguagaagugcaggcuacccagauuuggucugcccuaggggauuuuucuggagggauuuuagcuuauagaucuguauuuaacacuggggcuaaaagagcaggaggguaaauggaaauauuuaaaauaaauuacuugauuuccaggauugugaauuuaccuaguaaucaaaacuuagaagagcaaugauuucauacuuaaggauaguucugagugacagaacuugaugcgucaaauguuacgcuccaaaaauuaaucauacccuaagaaauaugacacacgucugucauaaaauaaaucacuuuuucuaaucagauuuuauuaccuuucagauccgaucacauaggacaguaugcaccuuaagauccugaagaaacggcacaaaauguucaagugauguuuagaaauaacuugugagguaagagugugauuauuuaggguccaaucacuguuuccuuucucacagcugacacuagcuuguauauuacuaaaaagguaaccugugcauguggcaaagcagaggcguggugccaagcugacaggcacgccuuccuuuucacccgcugccuuccgguccuaaaaggaggguguaucuguggaggggacuccaugaauugaauugaugaguucuuggccaguaucacaagaugaggggaauaccccgcuuuccaccugaaauggaaagugguuugguuuuuuuugucuguuuuuuuugagauggagucucagucuguugccuaggcuagagugcaauggcgugaucuuggcucucugcgaccucugucucccagguucaagugauucuucugccucagccucccuaguagcugggauuacaggcacccgccaucaugcccggcuaauuuuuauauuuuugguagagacgggguuucaccauguuggccaggcuggucuugaacuccugaccacaagugauccacucgccuuggccucccaaagugcugggauuacaggcgugagccacugugcccggccugaaacggaaaguuuuugcuugugugguugucccuuuaaauauggagauuuguaguguugcuuuugguguucugggaaacagggcuuuauuuaacaugccgagaaagagcuuagguucgggaguguugagaaaaucccauuaaaucggccauuaggguagaagagugaugcuggggcaucugugugagagugcccaguguuucacgguucccucagaaacugucuugaguaugaagucaacggugguuuuggaauucagugcagaauaaggcugugcccuugcuccuaaggaauguguacauuuuaauaccgcaucucaaauggcugugcuguuugcuuuuagauuagcuuccauguaaaggaaugguuucuucauuucuuccccucccuuccuguugcauuacucaaguguaaauacagugacucagagacacgagugagugcacuguguuacugagagcuguauuuguccagccuaacuuugcuauauucguuuguugcuuuguugaaaauaaagcaguuuuuggauuucauguuauuuuccuguugacuucuaauggaucuuacagauauggcacuaaagcccucaaguaugauaugucacccuaauaugugcuuauaggaacguccugccauggccaguguuuggugucugugggcgcucuccuuacacagcugugccugccauccgcacccccaggucaggcauggagccacagcagcauccugcacuccguggaggucuuaccaggaccugaaccaggaaggcggagcugagcuggcucaggugucacaugugugccuuuagaagacuuucaagaggcccugcuuucuggagagagcucagacugcccaaacauugugcucugacaaaaguauagcuuguuuuacugccuggaaagcacccuuccuuuucucauggaacguguccuauuagagaagucaccauaaagcaaaaugguucugcucagaggaauuuuucagcuuacggccuugauguaccugggcccacagauaacgauucaccaagaaacuuagauggaaaucagcaggaggugauuggaaucugagagagggacugcuugcuuuuuguugcaucugccuuuuagcaaacaugcccuugcugugcgccagacagcaugcaaggcaugagggggacagggcaggaggagacccagaccccccuggaggggcugacaucaggccgggaggucggaccugcaagagcucucagguagcaagugguaaguaccugggagggagagcuggugagcgugcccagggcuucagcggaggcagagaaacuuccagguacuuucucagcccccugacagucaggcuuuacuaguagugcaggcagaagcaguuucagccuuuaucuccggauagucacaucugaugucuagagaccucuucgcaaagugcuccucagaagaagagaacucccuuuucagguuggcuugccuagaagagagaaaaguuaggcccugcagggugaaugagguuuauguagaggcaauggugcugcaaagguguuugcaggggauguugagcagacagaugcagaagauguagguucagaaaaugcugaaggaaugguuggcuaaggggucuguccaaauucuuuugaucuuuaguuuuuucuauuucacucaaaugauuauuuuuaaaaguuuuuuuaauuaaaacaauuuuuuugacauugggucuuacuuacucuguugcccaggcuggacugcaguggugggauuguggcucacuguagccucaaccugccagucucaugcgauccuuccacgucagucccccaaacagcugggacuauaggugugugccaccaugccugacuauaaaaaaaaaaaacaauuuuguuuuguagagauugggucuucccauguugcgcaggccagucucaaacuccugggcucaagagauccucccaccuuggccuccuaaagugcugagauuacagguguaagccaccacacucagccuuaagcauguauuuauuuauuuuuauuuuuugagacaggaucucucugucauccaggcuggagcgcgguggcaugaucauggcucacugcagccuccaccucccaggcucaagcaaucuuccccccucagccucccuaguaggggggacuauaagcgcaagccaccaugccugguuaauuuuuauuuucuguagagaugaggucuuacucuguugcccaggcugaucucaaacuucugggcucaaaugauccuucugccucagucucccaagugcugacuugagccacugcacccagccuuaaacauuuuuuaaagcugcuuuuaucugauugaaaaauagggcuauuuuacugacuuuggaaaacaauuucauuuugcucuuguaccagucagcauuuuugcaucgagaggaaauuuuuuaaaguauuuggcgaaugaauccucaccacauguucauucggcaaauguuuucauaauugcuauguuccaguugcauuuaagaaaagaaaaagucacacccagauuugaaaaacagcacccagugcuguuacucaguuguagugaccugaccucugagaacauucuuacuacacuccuuuauucacauuucagaagccaugguuucugcacucugccugcuuaaaauaugaggagcgcuccugcucugagaaggugcccgggucaguucguuaaaauauuugucaguauuuucuccucauggcaaagcuaggugaaauugacugucucuuccuuucccuggcucuuuaucugugauauuacaacucucagagcaaacaccgauaagagaagggcguacaaucaaagaagcagucaaaacaguuaccaggaaaagugcacuuuuuucuuuuuguuucuggagagggagugucacucugucacuaggcuggagugccgugguacgaucucggcucacugcaaccuccaccccccggguucaagcaguucuccugccucagccuccugaguagcugggauuacagguacaggcgccugccacugugcccgacuaauuuuuauauuuuuaguagagacggguuucaccagcuuggccaggcuggucuugaacuuguaaccucgugauccaccggccucugccucugaaagcgcugggguuacagguaugagccacccgcaccugacccacuuuuuucuuuucuuuucuuuuuuuuuuugagacugaguccagugcaguggcgugaucucagcucacugcaaccuccgccucccagguucaagugauucuccugccucagccucccgaguagcugggauuacaggcgcacgccaccaugcccggcugguuuuuguauuuuuaguagagacgggguuucaccauguugaccaggcuggucucaaacuccugaccucccaaagugcugggauuacaggcaugagccacugugcccgguccuacuuuuuucuuuaguuucuuuagaucuuguauguucuuagaaaucagaugcuauuggaaauagggaagaagugucaaaaugauggcuugcaaaagaauggauuaauaaaugaaggaaaggcugggcaugguggcucuaccuguaaucccagcacuuugggaggcugaggcaggaggauugagcccaggaguuccagagcagcccaggcaacauagucagaccucaucugugagcugugauugugccacugcacuccagcuugggcaacaaagggagacuguguucccaaaacaacaaaaacaggaaacuuuuaaaagauuaaaauagaggccgggugcaguggcucaugccuguaaucccagcacuuugggaggccgaggcagauggaucaccugaggucaggaguuugagaccagccuggccaacauggugaaacuccaucucuacuaaaaauacaaaaaaauuagcuaggugugguggugggcgccuguaaucccagcuacucgggaggcugaggcaggagaaucacuugaaccugggagacggagguugcagugagccaagaucgcaccacugcacuccagccgggcaacagagugagacuugguuucaaaaaaaagauuaaaauagagaugaagggcauucuagaagcaggguagagugucaaggaacagagauauaaaaaugggagucugcuccaaaaacaucacagauaagcgaggauaaacugagaaucaaauugaggaaaaucagguaagaccaaugaggucaguguguaugaggcgguguaaagaugaauagagaaccagugacuuacucgucauucuuucaucaugcugcuugcugaagugugugccgagcaccugcuugggagcauuuaggugagcugcugagcagagcaggaacagguggggcucaggggagcaggcgcagcagugauacagcagagcuccucuccacgcugccggggaacccagugcugggacuucgcgucuagcuugugcuuuccauaaucuuuguauguggccacggcuggccauagauagguuuuguauauguaggcauaaccuguacugugggacuuacuguguuguaguaaagcaaucaaucaagucagagauuuaaaaauucagaucuuaguuauguuuuuauguucuuucccacuauguguauuuagacuaacuucaugaaauggccaaggacaaacuguaacacaucauauuuaagguagcuugugagcuuuuugagccuuaccagcucugugucgucccccuccccagggugcgucagggaaaucaugcagccaucaggacacaggcuccgggacgucgagcaucauccucuccuggcugaaaaugacaacuaugacucuucaucguccuccuccuccgaggcugacguggcugaccgggucugguucauccgugacggcugcggcaugaucugugcugucaugacguggcuucuggucgccuaugcagacuucguggugacuuucgucaugcugcugccuuccaaagacuucugguacucuguggucaacggggucaucuuuaacugcuuggccgugcuugcccugucaucccaccugagaaccaugcucaccgacccugugaguacuggcugcgucucuggguggcucucuugugucuggucuaguguccucggguguggcugacccuuuggaggaagcagugcacagggacauauugacauggguguggaacaagaaagguggauugagcucauuuugggagcagauucccuuuaggcugagaauaaacauaggccagaccuagcgcagugaaauaccccuaguuccugacgccuugcaggccaccagauucagcuuccagcugggcuuucaggcuguuccugaguuuugagacauccuucaaucagggaggggcauucgggccgaucguacagaucuugcagcucagccauccgucaccucuaguaagugaguuccaggcuucccacagagcucggaggagacgcccagcagcugcaggcaugcaaagucagguauuagcagucaguagauuuucauuugaaaaaaguucuuuccacugcuuuaaaacagugguuuuaaaccaugguauagggacucccaauuugucaauuuaaaaucuacuggguucuugucuguuucuaagcuuucucuaaagaagguacccagacguuaauaagauaaggacuuuuuuuuuuuuuuuuuuuugagacggaguuuugcucuuuuugcccaggcuggagugcaaugugcgaucuuggcucacugcaaccucugccuccuggguucaagcuauucuccugccuuagcccucugaguagcugggauuacaggcaugcaccaccaugccuggcuaauuuuguauauuuaguagagacaggguuucaccauguugaucaggcuggucuugaacuccugaccucaggugauccacccgccuuggccucccaaagugcugagauuacaggcaugagccaucgcgccugaccaggacucuuuuuugagaauaaacugaaacggaucagcucacagaauguggucugcacguggcuuuaucugucuuugcuuuaucugaauuaauuauucaggguuuggauguacauuguuuacugucuccuguuuuacuaguagaggucaugggcagcuguccugggaaugggacaguauuauaggcccaaccagagggcagcuggggagugguaccuuggggacaaacuuggaagcaaagucugccaguggcuuuguagccugaucugaugguggagucuuugaccauaacugagucucuucgauggguuugugccuucagagaauuaaagccugucuugucauuuccuuuuacgcggcaggucucccucuaggagccagacccugcuccugaucccugugugucuccgcccucuccuuccuuggcugcagcagaaaccccuuguuuguugcccaaagugcccaggcacuucgacaaaggagagggccagcuacagggccagguccagcucagcgauuuuuacuggaauauugccuuguaggaaaaauccagugacugccgaccaucugccugcacagugaaaacugggcuggacccaacccuugugggcauuuguggugagggaaccgagucugugcaaagccuccugcuugugagugugggguaggcacaugggggagggucagccuggcugggaguccucagcaguuugcuccucuuugcugacaagcgcacuugccccuuccuccucugcgcucagacucuacagcuacucagcaguccagcuucugcucccaccccgcuccugcuccugcggaaaaggccccagaagccuggagagcuggaggcggccaggaagucaggguagaaggugugugcagggcgugcugccgcccuggugggcagauuucuuuugcuuguuguauuacugcagagaauguugaauggaacauacugagggagaaguuggagaucuuggaugucagggguguuuugauugagauuuaauucacauagcacuaaauccauccucguguguagucccgugguguuuagugcauccacagaguguccaaccaucacccagucgguuuuaggacauuuuuaucaccucagaaaggaaccccacaccccuuagccaucacuucccaguuccccgaccccaccacccgacgcccucugccccuggcaaccacucaucugcugucucuguggaauuugcauguucacagacuuuuuuuuuugagacggagucucacucugucgcccaggcuggagugcaguggcgcgaucuuggcuuacugcaaccuccgcccccagggguucaugccauucuccugccucagccuuccgaguagcugggacuacaggugccugccaccaugcccggcuaauuuuuuuguauuuuuaguagagacgggguuucaccguguuagccaggauggucucgaucuccugaccuuaugaucugcccgccucggccucccgaagugcugggaugauuacaggcgugagccacugcgccuggccgccuguugagggacuuucauagucaucucgucuguggccuuuugugccuggcucucaccaggcauugcgucuucgggguccaucgugcuguggcaugaucagugcuucauuugguuuaaggcugaauaauauuccaugcucuggccggacccuucucaccuauagccaucguuaguugaugggcaucugggcgaguucugcuuuucggcuguuacaaaucaugcugcucugaacggccgcguguaaguuuuuguguggauggguguuucauuccucuuggguauauaccuaggaguggaguugcugggacauauggugacucuguguuuaaccuuuuguggaacugccaaguauucucuaaaguguccccacugggggaaaaaaaagaaaauggaaaaaaaaucuuguggggaagggaaugaugaaaaaaaaaaaacaaaccccaaaacaucgaagcauccacaccauuuuacauucccaccugcaguguguccacaucuucaacacauuauugccauucuuuugugacgccguaucucacugucuuugcuguguaucucccuaaugaccaacgauguugagcaucauuucaugggcuuguuggccauuugugugucuucuuuggaagcaugucugcuugaguccucuggugacaagugacagaaaccaccaggagucacuguaaaugaaacugaggaagggggaguacgcagagccccagggcaaggaugcuucuggcugcuggcaggcuguggaguggaagguggacagaggggagaggcuggcagcuguccucaggcuuugucugucucucugaguccuggcuuuccugcugcccagggaagaagggcaguccucagagcagguggaguggcagucacugauguccaggucuacuuuucugaaggggagagugggcauggcccagcagggucaggugucaccucuguucucccaguggggaguugauuucuucucuccacagaucaugucuuuacccuaccaggguccaguccaggcugaacuagaaccaucacaucaccucugaacugaacaguugagggguuggggcagauaccccagugggacuucaugucauuuuucuaaaccaauaggacugggcaguccucgcugggauugcccuggacaauacaaauugggauuuguauugucacuugaggaaagucauuggugcuuugagugaggaguggaggggaagauggggucagaggccuacugauagagcaaugaacccugcuguggaaggaugcaacuuugaucccaggcuucacuuugggaucgugagagggcugggagggaggaaggccacccacggcccugggcccugcaucccuuuacuuguuagagccugugucuucaaugccagccccguggaugccuacgagccuucucggcagccgugcgagugccuuccggagguagccuucauggggccgcgacugcuguccaggagcucugccaaaagcgugcuuuccucccaccgucacagcagugcugggacguagguguagcauccgugugagaacacgaggccucgcugugccaguaagaggccaggcugggauuugaaccagauugucuaucuucagagccccggccucgaaaauuucacuucuuaugggaaauuccaaaugugcacgguaggaagaaaagagcgcuccaccuugagcuugucaccacaucaugugguggccucgcccacgccguuccccucccccagauaacccgccuaaaucucacucauucuuuuguuucauuuguaaacguguguaucuuuuaaaagggcucuuuguaaaaacauaaccucaauaccgguagcucauguaaagcaauguauuuauaccaccucuccuguuagaguucagauuuccucaauugucucaauucuuuuuuuuuuuuuuuuuuuuuuuugagacagucucacucuguugcccaggcuggagugcaauggcaggaucucagcucauugaaacgguugccucuuggguucaagcgauucugucaccucagcuuucugaguagcugggauuacaggcaugugccaccaugcccggcuaguuuuuguauuuuuaguagagaugggguuucaucauauuggccaggcuggucuugaacucuugaccucaagugauccgccugccucggccucccaaaguucuaggauuacaagugugagucaccgugccuggccugucucaauucuuuuauaauuuuuuucccuugaaucaggauccaaauaaggauccauacagugugauugguuuaugugucucugacaucucuuuuaauuaaucucucuggucccugcaaugucuuuuuuucccuugggguuuaaguugaagaaacacaguucuuuguuugcaguuuacaucccuguacuggguuuugcugugcuccucguccccagcauuuuccauaaauuaggaggcagauccacaggcccggccccauucuuaccugccgcuuaguuaggcccuggggauccagaaugcaugacagggagcugggguggagagcaggggagagaggaccggaagcaugcucugcgaagccuaacugcccuggaagggcgagguggcacagagcgccuugccugggccuggcuggcugcuuugucucaucagggcugacuggaagugggaugugggcaggggcaccagaagagggaacagccaaucagggagcaccucugaagggaggccgcuggguguuugggugggagggaggagccugaaggcaucccauggccuggagccuauggucagucccacaagaagaugagugggaaacauucaagaaguguuuuagaaaaaaacgucccgaaaaugguuaaaaugggaacugaggaaugugcucaauuacuuggaagguuuguucuggugggaagaagaaugccccaugggugcagaggaaacggugcuccagccccugccgcugucaucgugggcacauccuggcgaggcccuuugagauggugcagccgugcacacccccucugcauauggucucuguuucugccaaaccacaucucgaaaggcucaggaugaaaauguaggugauagacucggggccucagguggaaggaaccccuccuugaaacccccaggacaccaugcccgugaagaguuucacugauugucugcccaagguucugagcagcaaaaaggaaucccuggacccagcaagugccugaaaucccacauagucucaggucccugaggaucacccaauguguacuuggcuuccccuucgaaaugccuuuccuuggucauaagugaccaaaaacugggguagcguugggguagccgcuuuccagaaguguaucgugccacaucguaucauauuugcugcugcuguggaaaagugcaugcauggcucauaaaauuacgguguuuggaguuuuaaaaucuggcccauuuccucugaggagauguguaacacucgacugucaccuggggcauauaugcaacauuguggaauuuuauaaaucaaagcaguguuaagaucccuagauuguuggaggaaaguugauugaagacuccaggccaggcacgguggcucauaccuguaauccuagcacuuugagaagcugaggcgguuggaucaccugaggucaggaguucgagaccagccuggccaacacggcgaaaccccgucucuacuaaaaauacgaaaaauuagccgggugugguggcgcacgccuauaaucccagcuacuugguaggcugaggcaggagaaucgcuugaaccccggaggcagagguugcagugagccaagaucacaccacugcacuccagccugggcaacagagcaaaacucuguuucaacaaaaagaaaaaaaaaaaaaagacucuaaauuguagaauguaaguuaaguaaaaauuuuuuuuuuuuuuuugcuggagugcaguggcgugaucuuggcucacugcagcuuccaccucccgggugcucugccucacccucccgaguagcugggauauuacaagcgcaggccaccacgcccagcuaauuuuuguauuuuuaguagagaugggguuucgccaucuuugccaggcuggucuugaacuccuaaccucgugauccacccaccucagccucccaaagugcugggauuaaagccgugagccacccugcccagccaguaaaauguuuuacuuauucugauuuaaguuuucaaagaugaguuuaaacccuuuucuaacuucuuuaaggaggcagcauguuaggaaacacuuugaucuugaccaaaacagcuuccccauauugcggccaugggacugacggggccuuguuuggaggaaguaaaccucaggggagguuugggcagucaacacucacauuugcccuggggccccccugccugugcugcccaaggcuccagcucuggccuguugguagcccugaauccagcgggcagcagucucuggcucugcagggcgcucaccugcugaacuuucuaaaauuuggaugucaacccucacccugcagagguucagaucuguggcuccggagcccagcgaggcaccugcauuuuaaggagcuccagcagggccaucugcuguuggcagagcccuucaccaccucugccaucucccaggcuguuagcucccaccuuccauuugccccaccuauauccccugucuuugcacaaucacugcagcccugacugcuguucccaguguccgugggucucauucuccagaucugugauuucuacgugaagugcaggauccaggcuaagaggcagacacaaggccuuguuccucuucuugaggcauuggaacccccaggcaggucugccuauuuuauuccacccugccacagcucccagaauugucucccacaaacaugguuuugaugacuuaucuccacugcccaaagaacaaagccucugcuguugcagccagcucuggccuuaccuucccuacagcggguccucaguugacauggugcugguagggugacucuuggccuucagcucugccccuuaccagcagcucacagccuccccaacuccucuuuccgcugcuucgccauugcucaucuucuccagcuccucuagcacuuggggcacagauggaugcauguucaaguuucugaugccgcugggcggccucguugccagacaugaaucgggucagguggucuggaccgccaccuccagguuugugugugaaugccuuugaggaaguuggccaagagacaaaaguaucaugucacuuuagcaacacgaaauuaaaguccuuuuugagauuguuuuguucuuuguuccccgacugcccgauaagaaaacucugggcagugcuuaucagucaccucccugucagcaggggcuacagggaaguggugugcaaagagguucccugccccaccuggggacagucagugcccuugucugggaauaagccuugccucugaaaaugcaggugguuaagccauuuaucaaaaggauaauaagguaguuuuuuuuaauuguuugaugauauagaaaauauaugauuuuuuuuuuuuuuuugagauggagucuugcccugucgcccagguuggagugcaacggcgcgaucuuggcucacugcaaccucuaccuccugaguucaagcgauucuccugccucagccuccuaaguagcugggauuacaggcgccugccaccgcgccuggcuaauuuuuuguaucuuuaguagagacgggguuucaccauguugaccaggcuggguuggccaggcuggucuugaacuccugaccccgugauccacccgccucagccucccaaagugcugggauuacaggugugacccacugcgcccggccugauguuuuuaacuuucauucuccccaacuaaaguacauucuucuuauaugguagggggcaguacccaaaggaaacgcuacgaaagaauacauggagagcuugcagcugaagcccggggaagucaucuacaagugccccaagugcugcuguauuaaacccgagcgcgcccaccacugcagguacgugcgcugcuguauuaaacccgagcgcauccgccacugcggguacgugugcugcuguauuaaaccagagugcgcccaccaccguagguacauggcccccgagcaucugggcaacguuguacgggcggggccguaggugucauguucuuucugggguagggagcugaguaaagggccggugcccuagagucuuuuugggagcugggaaacaguauggauucagggauccccuccuucccgagggacucgcuguggcucaacaacuggaggaggugacaagguucccgccucuguuguggcacacaugccacacaggccagcacgugugugcucacagcuccugggcacauccugugugggggccagaagaaaggcucagaaccuuccccucacuccugcucuggguucuuccagccagccagagaggcuguugugcguucacuuuuguucuuaccuggggugguggugcagcguagaagcaagguucuuuuggaugugcucucauuuuuuuguuguuuuguuuuuuuguauuuauuugggcgugcucucaaacaccaguuacuguauuuuuuaaaagccacaguccaguuaucugccuggcucaaguagccuuccuggcccucacaccucaccccugcuggucuugguugcauuuuauccucuucccccacauuugccaguuccugacuccuuuuucugcuccuggaggggcuggcuguugauuucacguguugaagugugaaugucuggguguauuucuccauuccuugaaauaguugucacacgucccuguacugugugacaggcugcaccuggacagugcccuucuccuggggggucguggccugcuugaauaggcuggaagccauugauggccuccaacgggaggaaacccagauacagggugcugacugcuuuauggcuggagugaaagcuuuaagagauucauauccucaugguuuggccagaaaguaaagaaagaugaaaugguaucggagaguaaauggguggcuguuuugggcugggguuagaaauaggcagugacugcauauggggugagguuucuuucugggauggugggaauguucaaaaauuagauggugauggucucacaacucugcagauagaauaaaaaucauugaauuguacauugcaaaugggugaacuuuuaugguauauaaauuuuuuggggauggggggauggagucuugcucugucgcccaggcuggagugcaguggcauaaucucggcucacugcaaccucugccucucaggcucaagcgauucuugugccucagccucccuaguagcugggauuacaggcgcccgccaccaugccuggcugaucuuuguauuuuuaguagagacgggguuuugccacauuggccaggcuggucucgaacuccugacuucaggugauccaccugccucggccugccaaagugcugggauuacaggcaugagccaccucgccugaccuaugguauauaaauuauacuucaauaaaucuguugaagauaaaaugggaauguuuuggaagucaggugcuguggaggucgggcagggagccaaggucaaugaauaagaagaaggugacgcuaugggcgggugcgguggcucacgccuguaaucccagcacuuugggaggccggggugggcggaucacgaggucaggagaucgagaccauccuagcuaacacgaugaaacccccaucucuacuaaaaauagaaaaaaaaaauuagccgggcauggugacuggugccuguagucccagcuacucgggaggcugaggcaggagaauggcgugaacccgggaggcagagcuugcagggagcugagauugagauugcgccacugcacuccagccugggcgacagagcaagacuccaucucaaaaaaaaaaaaaaaaaaaaaaaggugacgcuaugauagcaagucugccugcagcgaaccugcugccaucgaugucugcuugauguaauuaaauggugcaagcuuggacuaaaaaguaaucgauaaucaaauuaguuauuuaaaauuggacauacagaguguuuugggcaaaaguaaaauacagcuguuaaaaacaagacgacuucaugccuggguguguaguugaugauucaagaugaauaugcaauccauacugcauauucaucagugaauauggauucagugguaggaauuauuugaagauacaaagaauguuucuccuugaggguaaaauuucaguuuuuguuuuuuauugaaauagacuuguaagcuugcaaaauuaggaacauuacugauagguguacaugauccagcucuacugggggagugucugagaacucgugaaguauggcuuaguuugaccuuucgccccaagcuguugguccauugaguauuuuccuuaggaaacggaagacauuuaauuaaaaugauaaaccuuaaaggaauauagugagaauguaugauauuuuuugacauguuguauuagaauauacauucuaauuuuccuccaccuuugauuuuauuugguuguguuacucugguuuccucagagcauggaauacugaaaaaucaaacucuccuuuucaguauuugcaaaagauguauucggaaaauggaucaucacugcccgugggugaacaauuguguaggagaaaagaaucaaagauuuuuugugcucuucacuguaaguaaaaauauuuuuguauugaauuuacauugaauuugaaauucuuuaacugcuucuugccuggagcagagaaaucuacuaacgucaggccaguuucucuccagccuuuucuccaggauucaaauuauaauacugugcugucauuggcaggaaguagucccaauaaguaauauguugcuuguauuauuuuagguguucacuguaauuuaauucucucccagauguccucaaucgcuauuguuuauuaauaauaacaggaaucuuccuaaaguauguuagaguuuauuuccuuuuucuuuucuuuuuuucuuuuuuuuuuuuuugagauggaguuuugcucuuguugcccaggcuggagugcaguggugugaucucagcucacugcaaccuccgccucccaaguucaagugauucucuugcuucagccucccaaguagcugagauuacaggcauguaccaccacgccuggcuaauuuuguauuuuucguagagaugggguuucuccauauugguugggcuggucuugaacucccgaccucaggcgauccgcccaccucggccucccaaagugcuaggauuacagucgugagccaccgugcccggccguuuauuuuuuuauagacgggguuuugcuguguugcccaggcuggucuuaaacuccugagcucaagccaucugcccgucuuggccucccaaagugcugggauuacaggcgugagccaccaugcccagcuauauuuuucuauaaaauuauucuacuuggucuaauaugaucuuggguaggaaaaugucaacugcugccauuuaauccuucccucauuuuuuucucugacaagauggagguauacacaugaugugucaucagccuuugcucuuagaaagacuuguuuaaguuacuaacuggcuggguggaucacuagaggucagcaguuacagaccagccuggccaacauggugaaaccccaucucuacuaaaaaugcaaaacaguuagccgggcauggugcuuguagucucagcuacuugagaggcugaggcaggagaaucgcuugagucuggcaggcggagguugcagugagcugagacuacgccgcugcauuccagccuggacaacagagggagacucuguuucuaaaaaaaauaaaaaauaaaagugacuaaccaaucucccccucauucuagauguauauagcucugucuucaguccaugcucugauccuuuguggauuucaguucaucuccuguguccgagggcaguggacugguaaguucccuggcuaugugucauuccuggcuuugcaugcuguuauuggaugaaaggggaaagcuuuaaaggaagaaccaguuuuccaauuuugaaggaaaucauugcaauuauuuuagcaauugaauuuuaaagaauuuaguuaaguuuuaacaccaccauuuuacuaguauauuguugccccaaaagcuugugucugucugcuggucagcuagcucgccauuguucaaagcaggcuucacguugcuuacgugagugaccgacccuaagcaaguguagugaaaauaggugcucguuauccuaccuuagauaugcagugaggucuggacaggcucaucccaccccaggggaacauggugaacagacuccugugagcacugcucacugguaugggugcacacaacucuucuggucuggcuucauuugccauuuaauucauaaauacagugucaauagaaaccucagaaaauacagacucuuuugaaaccacuggccaggaagucaugguaugaauuuuugcuuggaaggguggcccuccucugcuccuuggagaacaaugaaugugcccauuuagaaagugaacaacuucccccuggaagcuggccaggggcuggcccuagaggauucuucucugagccaaacauucugccacucgggguauucaggaccaguuauaaccaacuuccucuuguccgcagaaugcagugauuuuucaccuccgauaacuguaauccuguugaucuuccugugccuugagggucuucuguuuuucacuuucacugcaguuauguuuggcacccaaauccacuccauaugcaacgacgagacgguaagcuuuguucucggcuguguggacuucauaugugguccaagcuugaguaaaugaaaaguccuaaugucaacaauaggugccuguggacugacucgggaacguaaugggacggucuugaugagcugcaaccagcucccuguguuugcuguuucuuucauucugggcagugcauauuucuagucucaguuugauuugcaagucagcagagccaggcagauucccagcucccagugcagucaguaaauuucagggaacugacugccuuuagggccuggcucugcaggccuggaguggcgcucaguaaaugucuguacacaguaacuaacgagcgacaaauguuggugccuggcugggagggccauugugguagucugggcuggccacguggcugcagccgggcugggcucacagaggccacggggucuggaucggggcagagcugggaaggagaguucacucaccuacccuccaucgagcccacacugugcuugagcacggugugauucugaggcuugguggggucugccgagcuuccuggagccgcugccacuugcuuuucuuucugcuuccaggagaucgagcgauugaaaagugagaagcccacaugggagcggaggcugcgaugggaagggaugaaguccgucuuuggggggccccccucacuccucuggaugaaucccuuugugggcuuccgauuuaggcgacugcccacgagacccagaaaagguggcccggaguucucagugugaggcguggcucaucagacugaaacuugcucacagacuuccaguuauuuauuuggggucugaaggauaucaacagcucaucugugaccaacagggcaacuggaaccuacacaaaccaauugcuugcagcaagcagaguuuuauauauuuauagucacagauggcagaggaagaggcucucaguccccaccuguacaacaacggaaagguguguggccacacgaagaagccaaacgccguggccuccugcagagcuggggcuucuguggagaauacuucggguuauuacauggguuauucaaauccuggguccugagcugcuguuuccaaucaugaagaaaaacagugaauccagugaacagggauucuccaagcagucauuucagggggcuccugcugaccccgccacucagcagugcacuccccggaucacagcagggcguuuacauagaaagacguuuuggucucgauuagcuccgaugcuuugcacugaaguugcaaaagaucugugcacugaacagugaagguggcuuccggcacacuccccgcugccccggaagagacauccuuugacccucucagcaagucugugugugugcgugucugugcgugugcgcgcgugugugcaugugugucaaaauugccaguguuguuuaggcaauguaacauuuaccggcuguguacagcaaacaagcuauuuuuuagaaaccgacguuucagggaagaggggagagagccgcgggguccugcccgugguuacuaugaauguauugcuguuggaggacaucucgauccaaagaacagccguuccugugcggcccuucguugcccuccugcuuucauuuuuuaaagaaaucuugagugcuugagggccuuggaacugauuuuuuuuuuuuguuccagccaaauuagcaguguauaaauggcaccuagguaagagcagagcugcggcucggugacuugauacuuggggcagcccgaugcuguguguggggcaggggaggcauccuuacuggagaggcagggcccagccauugggcaccucugggaaggggaggggaccaugaggcagccagccccuggcaggggcgacugugccaccgcaggcagcgcuccagucgggaauggccaggauggcgcccucuuguuggaguuuuugguuagcuuuuacguuuucuucuccacccacggcacaggugauaaaauaggauccuuggugcggagcuuaaaauuaugccagaaagccaacagcuccccucguggggccuugccuuaaacuugccugguuuguacauuuuuugccggacgcaucaagaagcaaucugugacaaagucugagggucuuccuuuaugcuugcccuccacacuaagagaaguuggcgucucccuccugggaauuguuuugccuuucuguucaucugugaacuguuuuuuguuuuuaauuacucuguaccccauccgaaucagggcuucuaccacugcugaugcaaaaccacaaagggaccuaccugagccaccguccuagccaagcgagcaaaccugcaggggguuuggaaguggacuuggucaccgcagaagcgugugcgccguugggggaagagcugcgucacagccagagggacaaagugugggugauccuggagacgccaguuuccgagauuguucugcauauucauuugcacauuguugucuggguuggacaugcgugugggcuucagugugaggcuuuuaauauguauauccuguuaucaauaaaacaauuauccaagugguugaauccugugagacuuggcaagugugugcaaaucaaguauacuugacuuuucaaccucuucuuucaauguaacuuuuauaugaaauaaaguaaucaauuaacaguucucaa

SEQ ID NO: 191982 - RNA, 7435 nt, Homo sapiens
aagcagcccggcccggcauuuuacgacguucgcagcgcuacccuuuuccgcuccacggugaccuccgugcggccgggugcgggcggagucuuccucgaucccguggugcuccgcggcgcggccuugcucucuuccggucgcgggacaccggguguagagggcggucgcggcgggcaguggcggcaggugagacaggagguggccggugcggcgccgccaggccgggccgggucggggggccgggagccaucaagucugcacguccgcagccuggccgcucggcuucagcaggaagcaccgaaugggccucggagccaggugacauugaggccggcccguggggacuccgggcucgguggcuccaggcucggggggccgccccgaagugcccgguccaucuuacccggucucgcagcggcugcggaccggccucgggcacugaccuuggagcgcccgcuggccgagggcucaggcugcggggaggcgggcccgcgcucugugccugcagccuccgcccuugcuccuucaaaaggucccugugcaaccccucccggguuuugcggggcucccgggcggcgcucggcuuuccagccuggaaggcgccuauuguuugcucacgcaagggcuaggcccaaggagagaagcuagacgcgggcguucagcccugacgucaugcuuguuuauucugccccaaggaggguauuuccccacaucacucucaccaguccuccgaagggucgauuuaaagggggccguguaagguugaugggccugaauagaggagggcccgggugagggggggucucauagguuuuccgcucuccucagggauuggaaauugaucggggcuguguuggcagccuucuccaauuuccccuucuagucuauguacaggcgguauuagguuuuaaacacucaguugaaugugaugcgugccacggucccugugagcugucaccuccccccaccgcucccugaagaauggagucugucacggcagcacagugcuuuaaugaucucuagcuuuuucagagucaccuuguuagcauuuuuucuucuugccuuuuuuuguuugagacggacucuugcucugguugcccaggcuggggugcaguggugcggucucggcucacugcagucucuaccucccggguucaagcgauucuucuaccucagccucccaaguagcggggauuacgggcgcccacuaccaugcccggcuaauuuuuguauuguuaguagagacgggauuucaccauguuggccaggcuggucuugaaccccugaccucaggugaucuguccgccucggccucccaaagugcuggaauuaccggcgugagccaccgcgcccggccucuccuuguuuuuuuaaaaagaccaauguucuguuaauuaccugaagcgcguauauauuauggcaguugauuuauaaugaagcuccuuaaaagcaugccaauuacuaagaaaaaccucauccuaggucauuuugugaauucagagacagugauaaagaauggaucauuugcguuggggagaagcaaacaaaaaaauuccaaaaugcucuggggcaaaaagaagacuaauuccuugcuguuuguccuuauucauagagaagguguacauuuuuaucuuucagaauguuggcuaccaggguauuuagccuaguuggcaagcgagcaauuuccaccucuguguguguacgagcucaugguaagugugacuuuucuuacuuuuaaauaggcugaacuaauuucauuuugcuccugcuguguauaaagcccugugcuggaguuuuaaagaccuuaauucggcucuugagggucuuuaggggagauauaaauguucucacagggcuugguucuagauuaagaaguguuuauaagucaaauugaaucucuucuggaucuuugguuauacugauacuuccccacuuacccuucccuuccguuccacuuuuuuaagcuucgagaucuaccccuuucaaaagaucuucugcaccauaacugacugaccuuaaugaccucccuccccaccuugcccccacaacucccaaccauuugcaucaccucuguuuacauuauagaggcaauggaaacgaaagagccuggacuuccuagccugagcuggguuuucaucucauuucuaucaaggacuagcuacugaagcucaggaaucucuuugcucaccugaaguauauggacagagcuuaguucugugucuggcauacagcacauuuacuuuugcauguaucuggcgucuaucuacuuuguaccagacacuguuaggcaccgagaagaaaaagaauaugaaauacacacacuuuccaggaggcuguuugcaaucugaagagggacggaugggugaagacaguguuuuauuaagagauggcuccuggguagaagcauuuagcccgauguggguuucagggaaggcuucuggaggaaacucuccagggucuuuucauugccuuaguagagucuacacccugccugguuagagcuggucuugccugccuuuccgaucuuauuacugacuguuguacucaaaacccaaaaacuaccaucagaaccacccauccccacuugcucacugccccagcccccuggccuuacuccauuccucccguagagccccgaguuguggguggucgcuccugucuaaucauucacccucgauacaaaugugcuuuuagaacggccucuccugaccauccuuucucaggaagcucccugucaccucaccuugcugugcuuuuccuuauaacacuggaugccucaugaaugcaugucuauuugaguauugcugucucagccucuuagaguguaagccuuuugaggccagggagccugccugucuuacucauugccguaucuccagcacauaggaggcagaugaagacgaacugcaggcucuuagacaagucuucucuguuaaguuauaacuuacguaagucauacaugaauaauacaugaauguguucucaacauaagauauuaaagcagucuggaauaccaucagccgucacugaagucaguugggauauuuguguggugaugcaccugaguaaggggugcccagauauaccagaucuccccagcagaggcucaacagaaauccguccauguugaagcggugacaaacauuccuuacaaucuggagucuuuguuuuucucucucucuaaaagaaauguuugguauauuaaccauugauuuucccuuaauugcugggggaccaggccugaagcucugaagaaccccugaaaccaugaauuggccauucuuauucuggaagaugcaauuuugagguuugcaugcgccaagguuuugaggguuuacgucguuauaauagcuuuuuccccccagucucccugucauggcauuuacaacagcuuuacaagauguaauucauauaacagucacccauuuaaaguguaugcuccagugguuuuuaguauauucauugaguuuugucauuagcaccacagucaguucuagaacauucucaucacccauauuuacauuuauuuuuaauaacucucauguguaagcugaguguuuuaaacuuuagagacuucuggggggugcugaacuugauaaaaauauucaguauacaaguguucuuuauaguucacucaucauuuucauagaauuaggguuuuaaaauuagaaaguaauuuaggccauuuccaucuccugucccucaaaucccagcucaguuuugggaugaggugucaaguauaaguuuguaaguaugccagucauuugcacggcuaagagaaacaucuagagaagucuauauacgacuugcuuaaagcugaauguugauuuacuguucacaugauuugggugauuuuagucacugggacugagcuaauggaguugaagcauuguugcgggcauuguaccuccagaccaguguguaauacaaagaguucuugcagacauaggacagaauuggagaaacagcuucuaacagugggaagacucucaguacaaccaagcuauuccuuaccuuucugauuucugaacuuuuuuccaugugauaccugcugcuuugaaggcacuaaaauaacagaagcagauagagcagaaauccucacucagaucuuccuccuuccuaccuguauaacaguuuguggcuugccuugucuguuuugugcguuucguuacgcguaugugaguaugugcacgugauuuccagaaaggagaagcgcacgauacugcccgugcucugugacuccugagugcacgcuuccucugcauuugggcuccuaggucggccucguccuguggacguugccccuuguuucgugccauccacacauuccugaugccccgcugcucuacucuuucuccagaguacuuuuuccaaacaugugauuugcacauuuguuauguuuauuguuuguuuuccacuucuagaagugugccacuaggcaggaauguuugauuuguucacugaugaucccagaucucuagaacccugccuugccuguagagggugcuugguaaaugugcucugaaugaauggcuccaugauccucguuucuaagagcuagcacgauuucucacucaguccugguuggacacagguucccuggaacagugcuguugugguuaucuucucacgugucuuuguuucugaacuugaaacgcuuugaguuuuuuauuguuuuuguucuuccucauuaguuugagucccuugcagauaggcuuucauuuuguccagucaccuguucagggagcccugagggccuuggcccacgucugcagguaacugguuuuuuuauuuuuauuuuuuuauuuugagacgaagucucgcucugucaccaggcuggagugcagcggugcgaucucagcucacugcaaccuccgccuccugcguucaagcgauucuccugccucagccuuccgaguagcugggacuauaggcacgugccgccacgcccggcuaauuuuuuguauuuuuaguagagacgggguuucaccauguuagccaggauggucucgaucuccugacaucgugauccgccugccugggccucccaaagugcugggauuacaggugugagccaccgcgcccagcccugcagguaacuguuaauguaggaagugcugccucugggcaccuuggccccaggguucauuagcaguugccccugguggguuuuuguuggcugugaugagaagugcuucuguucccccuccaccacacuccugcaacuguuuaaacaguggcugugacccccugagaugauccaggguuucaaggcgugcacaugucuguguuucgguuuucagaaguaucaccuuggggugacucucaacuuacauggauuuucaaagauuuauucaauauguuuuucagaaaguguugugaagagcgaagacuuuucgcucccagcuuauauggaucggcgugaccaccccuugccggagguggcccaugucaagcaccugucugccagccagaaggcauugaaggagaaggagaaggccuccuggagcagccucuccauggaugagaaagucgaguguggguauugaagggacccacaggcgcgcccagcagcucucggaagcgugugugugacagagccucugcucacuucugggccuacugucuagaggcagucuugcacaggaggguugcucugcuggguuucggggucacugugccagggccccaguuuaugugcucaccagucacuuagcucugccagcugacaggaucuuuugcuaggcccccuucucugugcugaguggagguagccucucagcauaucugcuggguaagacauaguuaacuguaaauuauugaaagaaacucagcaaaaugcauaguguuugguaugaaaggggcagaaaaauaacaagauuaaauagacccuaauacuguaauucaaguaagaaauaauuuugcaguuuuaauuugcaccugaagcgaacuguaugcauuuucuucuuuccuugcccugucacaugccugcgugggcacgugugugcacguacgugcgugaacaugauguggccuggguugguguauccuucagcucuguguuuccuccuucacaagugugguuuuggggagaagugguugaauguugcagaggagggagcugcugaccuuugugccuguaaauggcuguccucucugcccccaguguaucgcauuaaguucaaggagagcuuugcugagaugaacaggggcucgaacgaguggaagacgguugugggcggugccauguucuucaucgguuucaccgcgcucguuaucauguggcagaagcacuauggugaguagagagggaggaaggcaugggcgccuggacuggggcuccagccugcagugcccauuggugggcugucggggaccuccauaccuugaggcuaugagauagggacugcauuccagaguucaucucaggauuguuuccaggccuuggugaccuggagaacugaagucgugggagguuaguuuauaagccagcaucugauuauucauagccaugcuuguuggguggugaaauaccuuaacuacuuuguacagcacaccacguuuucaguagcaauuuaugugcucaccagucacuuagcgaaagaugacuucgugaagguucgagcaaggauaaggggacucauucauugaaugacugucuggacuguugugaggacugcaucucaacagccagcaucugggggucccgaccugauaguuugugugugggcauugccggguugcucgcucgugguaaugacucuuccccgagguucuuucuguccaggcagaacaggcauuuuugcauucugaauagguauauucucguacuuuugguuugaauguggauguggguuaauaacagacccgaaucuauuugaucuuccaggucaccuugggcucuguuugucagauccuguuauccauagccuuuagagaggaccuucugcuuuuagcuuauuuuguugcuaacuuuuuacaaacaaagggcuaauuuuaaaaugucaguguugucaguggucagaaaccguguguuugagcggguguugaguggcagguggcucugcugaccugguggcuggugugucgggaggauuuaaccugugugagggauuggccuagaaacaaccuguugagauagucuugccccauaaccugucucacaccguaguguacggcccccucccgcaaagcuuugacaaagaguggguggccaagcagaccaagaggaugcuggacaugaaggugaaccccauccagggcuuagccuccaagugggacuacgaaaagaacgaguggaagaagugagagaugcuggccugcgccugcaccugcgccuggcucugucaccgccaugcaacuccaugccuauuuacuggaaaccuguuaugccaaacaguuguaccacugcuaauaaaugaccaguuuaccugaa

SEQ ID NO: 191983 - RNA, 7435 nt, Homo sapiens
uucagguaaacuggucauuuauuagcagugguacaacuguuuggcauaacagguuuccaguaaauaggcauggaguugcauggcggugacagagccaggcgcaggugcaggcgcaggccagcaucucucacuucuuccacucguucuuuucguagucccacuuggaggcuaagcccuggaugggguucaccuucauguccagcauccucuuggucugcuuggccacccacucuuugucaaagcuuugcgggagggggccguacacuacggugugagacagguuauggggcaagacuaucucaacagguuguuucuaggccaaucccucacacagguuaaauccucccgacacaccagccaccaggucagcagagccaccugccacucaacacccgcucaaacacacgguuucugaccacugacaacacugacauuuuaaaauuagcccuuuguuuguaaaaaguuagcaacaaaauaagcuaaaagcagaagguccucucuaaaggcuauggauaacaggaucugacaaacagagcccaaggugaccuggaagaucaaauagauucgggucuguuauuaacccacauccacauucaaaccaaaaguacgagaauauaccuauucagaaugcaaaaaugccuguucugccuggacagaaagaaccucggggaagagucauuaccacgagcgagcaacccggcaaugcccacacacaaacuaucaggucgggacccccagaugcuggcuguugagaugcaguccucacaacaguccagacagucauucaaugaaugaguccccuuauccuugcucgaaccuucacgaagucaucuuucgcuaagugacuggugagcacauaaauugcuacugaaaacguggugugcuguacaaaguaguuaagguauuucaccacccaacaagcauggcuaugaauaaucagaugcuggcuuauaaacuaaccucccacgacuucaguucuccaggucaccaaggccuggaaacaauccugagaugaacucuggaaugcagucccuaucucauagccucaagguauggagguccccgacagcccaccaaugggcacugcaggcuggagccccaguccaggcgcccaugccuuccucccucucuacucaccauagugcuucugccacaugauaacgagcgcggugaaaccgaugaagaacauggcaccgcccacaaccgucuuccacucguucgagccccuguucaucucagcaaagcucuccuugaacuuaaugcgauacacugggggcagagaggacagccauuuacaggcacaaaggucagcagcucccuccucugcaacauucaaccacuucuccccaaaaccacacuugugaaggaggaaacacagagcugaaggauacaccaacccaggccacaucauguucacgcacguacgugcacacacgugcccacgcaggcaugugacagggcaaggaaagaagaaaaugcauacaguucgcuucaggugcaaauuaaaacugcaaaauuauuucuuacuugaauuacaguauuagggucuauuuaaucuuguuauuuuucugccccuuucauaccaaacacuaugcauuuugcugaguuucuuucaauaauuuacaguuaacuaugucuuacccagcagauaugcugagaggcuaccuccacucagcacagagaagggggccuagcaaaagauccugucagcuggcagagcuaagugacuggugagcacauaaacuggggcccuggcacagugaccccgaaacccagcagagcaacccuccugugcaagacugccucuagacaguaggcccagaagugagcagaggcucugucacacacacgcuuccgagagcugcugggcgcgccugugggucccuucaauacccacacucgacuuucucauccauggagaggcugcuccaggaggccuucuccuucuccuucaaugccuucuggcuggcagacaggugcuugacaugggccaccuccggcaagggguggucacgccgauccauauaagcugggagcgaaaagucuucgcucuucacaacacuuucugaaaaacauauugaauaaaucuuugaaaauccauguaaguugagagucaccccaaggugauacuucugaaaaccgaaacacagacaugugcacgccuugaaacccuggaucaucucagggggucacagccacuguuuaaacaguugcaggagugugguggagggggaacagaagcacuucucaucacagccaacaaaaacccaccaggggcaacugcuaaugaacccuggggccaaggugcccagaggcagcacuuccuacauuaacaguuaccugcagggcugggcgcgguggcucacaccuguaaucccagcacuuugggaggcccaggcaggcggaucacgaugucaggagaucgagaccauccuggcuaacauggugaaaccccgucucuacuaaaaauacaaaaaauuagccgggcguggcggcacgugccuauagucccagcuacucggaaggcugaggcaggagaaucgcuugaacgcaggaggcggagguugcagugagcugagaucgcaccgcugcacuccagccuggugacagagcgagacuucgucucaaaauaaaaaaauaaaaauaaaaaaaccaguuaccugcagacgugggccaaggcccucagggcucccugaacaggugacuggacaaaaugaaagccuaucugcaagggacucaaacuaaugaggaagaacaaaaacaauaaaaaacucaaagcguuucaaguucagaaacaaagacacgugagaagauaaccacaacagcacuguuccagggaaccuguguccaaccaggacugagugagaaaucgugcuagcucuuagaaacgaggaucauggagccauucauucagagcacauuuaccaagcacccucuacaggcaaggcaggguucuagagaucugggaucaucagugaacaaaucaaacauuccugccuaguggcacacuucuagaaguggaaaacaaacaauaaacauaacaaaugugcaaaucacauguuuggaaaaaguacucuggagaaagaguagagcagcggggcaucaggaauguguggauggcacgaaacaaggggcaacguccacaggacgaggccgaccuaggagcccaaaugcagaggaagcgugcacucaggagucacagagcacgggcaguaucgugcgcuucuccuuucuggaaaucacgugcacauacucacauacgcguaacgaaacgcacaaaacagacaaggcaagccacaaacuguuauacagguaggaaggaggaagaucugagugaggauuucugcucuaucugcuucuguuauuuuagugccuucaaagcagcagguaucacauggaaaaaaguucagaaaucagaaagguaaggaauagcuugguuguacugagagucuucccacuguuagaagcuguuucuccaauucuguccuaugucugcaagaacucuuuguauuacacacuggucuggagguacaaugcccgcaacaaugcuucaacuccauuagcucagucccagugacuaaaaucacccaaaucaugugaacaguaaaucaacauucagcuuuaagcaagucguauauagacuucucuagauguuucucuuagccgugcaaaugacuggcauacuuacaaacuuauacuugacaccucaucccaaaacugagcugggauuugagggacaggagauggaaauggccuaaauuacuuucuaauuuuaaaacccuaauucuaugaaaaugaugagugaacuauaaagaacacuuguauacugaauauuuuuaucaaguucagcaccccccagaagucucuaaaguuuaaaacacucagcuuacacaugagaguuauuaaaaauaaauguaaauaugggugaugagaauguucuagaacugacuguggugcuaaugacaaaacucaaugaauauacuaaaaaccacuggagcauacacuuuaaaugggugacuguuauaugaauuacaucuuguaaagcuguuguaaaugccaugacagggagacuggggggaaaaagcuauuauaacgacguaaacccucaaaaccuuggcgcaugcaaaccucaaaauugcaucuuccagaauaagaauggccaauucaugguuucagggguucuucagagcuucaggccuggucccccagcaauuaagggaaaaucaaugguuaauauaccaaacauuucuuuuagagagagagaaaaacaaagacuccagauuguaaggaauguuugucaccgcuucaacauggacggauuucuguugagccucugcuggggagaucugguauaucugggcaccccuuacucaggugcaucaccacacaaauaucccaacugacuucagugacggcugaugguauuccagacugcuuuaauaucuuauguugagaacacauucauguauuauucauguaugacuuacguaaguuauaacuuaacagagaagacuugucuaagagccugcaguucgucuucaucugccuccuaugugcuggagauacggcaaugaguaagacaggcaggcucccuggccucaaaaggcuuacacucuaagaggcugagacagcaauacucaaauagacaugcauucaugaggcauccaguguuauaaggaaaagcacagcaaggugaggugacagggagcuuccugagaaaggauggucaggagaggccguucuaaaagcacauuuguaucgagggugaaugauuagacaggagcgaccacccacaacucggggcucuacgggaggaauggaguaaggccagggggcuggggcagugagcaaguggggaugggugguucugaugguaguuuuuggguuuugaguacaacagucaguaauaagaucggaaaggcaggcaagaccagcucuaaccaggcaggguguagacucuacuaaggcaaugaaaagacccuggagaguuuccuccagaagccuucccugaaacccacaucgggcuaaaugcuucuacccaggagccaucucuuaauaaaacacugucuucacccauccgucccucuucagauugcaaacagccuccuggaaaguguguguauuucauauucuuuuucuucucggugccuaacagugucugguacaaaguagauagacgccagauacaugcaaaaguaaaugugcuguaugccagacacagaacuaagcucuguccauauacuucaggugagcaaagagauuccugagcuucaguagcuaguccuugauagaaaugagaugaaaacccagcucaggcuaggaaguccaggcucuuucguuuccauugccucuauaauguaaacagaggugaugcaaaugguugggaguugugggggcaagguggggagggaggucauuaaggucagucaguuauggugcagaagaucuuuugaaagggguagaucucgaagcuuaaaaaaguggaacggaagggaaggguaaguggggaaguaucaguauaaccaaagauccagaagagauucaauuugacuuauaaacacuucuuaaucuagaaccaagcccugugagaacauuuauaucuccccuaaagacccucaagagccgaauuaaggucuuuaaaacuccagcacagggcuuuauacacagcaggagcaaaaugaaauuaguucagccuauuuaaaaguaagaaaagucacacuuaccaugagcucguacacacacagagguggaaauugcucgcuugccaacuaggcuaaauacccugguagccaacauucugaaagauaaaaauguacaccuucucuaugaauaaggacaaacagcaaggaauuagucuucuuuuugccccagagcauuuuggaauuuuuuuguuugcuucuccccaacgcaaaugauccauucuuuaucacugucucugaauucacaaaaugaccuaggaugagguuuuucuuaguaauuggcaugcuuuuaaggagcuucauuauaaaucaacugccauaauauauacgcgcuucagguaauuaacagaacauuggucuuuuuaaaaaaacaaggagaggccgggcgcgguggcucacgccgguaauuccagcacuuugggaggccgaggcggacagaucaccugaggucagggguucaagaccagccuggccaacauggugaaaucccgucucuacuaacaauacaaaaauuagccgggcaugguagugggcgcccguaauccccgcuacuugggaggcugagguagaagaaucgcuugaacccgggagguagagacugcagugagccgagaccgcaccacugcaccccagccugggcaaccagagcaagaguccgucucaaacaaaaaaaggcaagaagaaaaaaugcuaacaaggugacucugaaaaagcuagagaucauuaaagcacugugcugccgugacagacuccauucuucagggagcgguggggggaggugacagcucacagggaccguggcacgcaucacauucaacugaguguuuaaaaccuaauaccgccuguacauagacuagaaggggaaauuggagaaggcugccaacacagccccgaucaauuuccaaucccugaggagagcggaaaaccuaugagacccccccucacccgggcccuccucuauucaggcccaucaaccuuacacggcccccuuuaaaucgacccuucggaggacuggugagagugauguggggaaauacccuccuuggggcagaauaaacaagcaugacgucagggcugaacgcccgcgucuagcuucucuccuugggccuagcccuugcgugagcaaacaauaggcgccuuccaggcuggaaagccgagcgccgcccgggagccccgcaaaacccgggagggguugcacagggaccuuuugaaggagcaagggcggaggcugcaggcacagagcgcgggcccgccuccccgcagccugagcccucggccagcgggcgcuccaaggucagugcccgaggccgguccgcagccgcugcgagaccggguaagauggaccgggcacuucggggcggccccccgagccuggagccaccgagcccggaguccccacgggccggccucaaugucaccuggcuccgaggcccauucggugcuuccugcugaagccgagcggccaggcugcggacgugcagacuugauggcucccggccccccgacccggcccggccuggcggcgccgcaccggccaccuccugucucaccugccgccacugcccgccgcgaccgcccucuacacccggugucccgcgaccggaagagagcaaggccgcgccgcggagcaccacgggaucgaggaagacuccgcccgcacccggccgcacggaggucaccguggagcggaaaaggguagcgcugcgaacgucguaaaaugccgggccgggcugcuu

SEQ ID NO: 191984 - RNA, 14622 nt, Homo sapiens
uuaagagguggccaguuuagaguuucacaaauaacauuuauugaccacauucauaacagaaacucacccacauucacaugaacuuugcuacaaccaagaaucaccugaugagaaaucauuuggguugaauccuggguguggauucuguucugagaagacagcgacugucacagacgccuccugauugguggacucucaaagaucuugaucgugacacauuuuuguggcuguucuugacaguagcugaagauuccaacuucaaaccccaaaacacuggcuggaaagcaaagagagacaguuacuaggacccggccccaggcugagaccagcugcccucagcgcgugcccuugggaaaccuccaugagcggaaggcagaggcgcuccacagugcacagggcuggaggaaucccaggcagggaaggggugcagggaugagggguggggugcaguccuggccauaucgcuuuccagccgcaggacuggggugaggcauuccaccugagugcccacuccuucugaaaagggaugauaaugcuggcuuugcagaacugugaaggggacaggugaaaugaaggcaggucucacccugcucuugggggcucccugccaagagauucuaagcccacccucuccccccacccccggcugcuguagcacaucucuccaggccggcagacgggccgccgaggcuucuccugagauaagcuggguugguggcuuggggcaucucacagggcacccaaacaucccagcuggacaagcugugcccuccccugggaugcugguuggugccugcuccgcugcccugggagcuuggcucagaagcagacaccugcuauggaagcauaugaaucaccaacaccacagagugagugacuuccugggucuuucuagacaagcuguugauaaggacaggaagagauggggcccuccaagugccagaauucaggggcuggaaaacaggaagcugcaccaacaugcaggcgggucuccaccuggacugcacuucuggggaacuucaaaacaagagcaugcccaggcccuccccagaacaguuacuccaaaucucuagacaaagcccaggcaucuuucucuuuuucuuccccucuccuuccuuccauuccuuccaucuuaccaaguaauuugagccugaggccagggcuuagcaauucccuuuugggcccccugaccaucuacuuaacauugauccuuuaaaauuguuucuuaaauuucuuuuagagauaggaucuugcucuguugcccaggcuggagugcacuggcacaaucagcucacugcaacugcacucuccugggcucaagcaaucuucccaccucguucucccaaguagcugggaccacagcacuacacucagcuaauuuuuuuauuuuguguggagauggggucucacuauguugcccaagcuggucuugaacuccugggcucaagugauccucccaccuuggccuccgaaagugcugggauccagguguaggccaccacaccuugcccauccucuaaggcugggauccaggugugggccacugugcccggccucgcccauccucuaaggcugggauccaggugugggccaccaugcccagccuugcccauccuuuaaggccaaguguucuucuuugcuucucccaguguggguacaaaggagucaaacuaaaugugaucaucaagcugccaaacauaaaaagaaagauaaauccacaagaaaaacgacaaagaaggaaagcucucgcuguugcccagguacugcucaugcucagagaccaaacagagcucaccgcgcccgcuccuggcccccuucccagugcauggccuggagaggcuggcgcccaggcccacaagggacccguaccccgaugcacaucacagccucaacugugacugcccagggagugggaggcaacguccaacucuaggagaauggauaacccaaaaaacaggggagagccucccgcucccgcucccagccguggcagagugaccaagaccgggcuaagcuccugcugugaacaacuagaaaacaggacaggacaccuggcagcuaccugcagacgcugcacauuuucuagaaucuuccucuugcaauugcauggaggagacaacgagcaaacaaguaaaugcauguaaauucgacugugugugugcguuuguucacaggucuccucauccaugcagugugaugcaggcccccaggcaggaaggagcugcacugggcaaugaggaggaggaggagaggagagaggcuuugcagaggagccaccgccuaggccgagaguaaaggaguaagaggaaguagcuguuccccgaagcccagcuguggcccggggaguggccccggaggcuuccugggggagguaucccagcagaaagccauggcugugggcagcaagggugccaggggcgaaacucgaagccugggcgaggauagggacuagagaccaggggaaggggcuuucuaguauggagacuggcggcuggggcucaagcuggggacaggcaagagguccccauaccugagggggugcucagagcucagaggcuggagggugaguggcuguuaagaugcaccgucaaccccaacauaacaaugaaaauuuauggaaacugggacccguguccuucugggagcagggccauuuuagaacuugggaagagggaagggguggaagugccccacgaggcccccgccgcccccaggcugcccuggcaucucuaggugacgcggggcagagccugcgcugugcagagcaccacaggacacacucacagugccgggccuuggacgccugucaaguuaagccccaccccccacucuuccacaucccugauggccaccaagccucccucagguggacgucaccaugccagggccacccacugucccccaucccccaccugcucaccgaauggccaugaugacccucgggauggccuggaggagggucaggaggccgaggggcagcagacgcgcugcaggagccgguagcugguccugguagggggccuggagcugcuggaacuuggacaacaggcacucaucaccgcagauccgccagcaguugugccagcagcaugcauccagcaggggugcuaggcaaagaaaagguggguugaggacagggcguguucuccgggacucugugagccacgaggaggcugcaacaccagccccagagccuccgggaaauggggacuuccaggacccagccacagccccgggguggggacacugacccggagcucacgagauaaaggccgucuugcggguuuaugauauccuggguaacggcagccuuggggcuguuuuucaagaggcuugcucuuuuagaacagcauauggaacaugugcaaugucuagcugggacuuguuuccaaauccucuuuuuuggagcgggaguggguggugaagaucagaggaaccacacuggauaaugacuggagccgagugaugggcacguggggcugauuuaagccaaucuccacuucgggguauauuugaaauuuuccauaacaaaaguuuaaggaaagccacaagcacggauggaauuccaacguuuccauuuccuugaugcucuucggcacuuucuacacggggucuggucagcaugugauccucuggauacuagaguuuguuuuuauuuuuuauuacacuguuaauaugcuacuaauauaaaauauacauuaauuauauuaauguaaauaucauaaauauacuuuccuuaugaaaaauuaugccacaaaaacauagaggagaaaagcaccuaagucugucuuuacaagaaaaaauguaagaucagaaauguggacuuucucauuaaaauggaaaccagucagauuugcagccaaagaaagugucucacauuuuuaaaucacuccguacuugcggccagagggaagaacugucauaauucuccuggcagcaaugagaucugcucucuuaauucugugcugggaaaucuucuggcgugaauggguuugaggcuugaaacauuacuuauauaagucaccuaaacuacaaaacaaugauuggaguaaaaauuaaugccauuuuuauuuuaaguaucagauaccagaugaugcaugucaacuaagcuuuuagcuuuucuuaaaagaugcaaagguuucaaagccaaaaauauuuaauaaaaauaaacccaacauaugugauucuacgguucgaagagccauaagaggugagcaguugguuggugauuauuuguuucccaagcauuccccgaccccugccucuggggguuccacucaaaucacucaccuuuuccagggaccccaacuccauucacagauuuacucauucauagauuccaucaaggcaaacucacuacaaagaguuggugcaccaagagaaggacaugaugccagcccagaaaacacagacacggcagcccuccacaacagaaaacaccuucaagaucaagucuagccuacuccuuuuagagacaaagaaaguaaugguggguguggagguccugaucuccccauauacuaugucaugagagcaggaauacacauaugugccaggucacagacagaucaaucuacauaccaggucacagacacacaaauacauaaauauacuuaacuaugaauacauaaagggacugcaaaaaguuuguagaaaauggaauuaaaagauaaaaauaggccaggcacgguggcucacgccugucaucccagcacuuugggaagcuaaggcagguggaucaccugaggucaggaguucaagaccagccuggccaacaugguaaaacccaucucuaauaaaaauacaaaaaucagcuggguauggugguacacuccuauagucccagcuacuugggaggcugagguaggagaauugcuugaacccaggaggcagagcuugcagugagccgagaucacgucauugcacuccagccugggugacagagugagacuccauccuaaaacaaacuaaaaauaaaaauaaaaaauaaaaaauaucaacuuuguuucucaacauaagcucuacaaggucaagacacuuuugucagugaugacaccagcuacuuaguccaucuugaaagagcugaggguccugggaauuuaaccacaucaaugcagucuuuuuuuacaucauuaacugaagaaaaugggugcccuuuaaagauuuuuuaagauuagaaaagaaagaagacagaaagagccaaaucaggacuguaauuuggcuguaagguggaugccuaauaauuucccaucaaaacucucacaaaguugcacugguuugacaagaggaaugagcgggagccuugcugugguagagaaggacucugguggagcuuuccagaguguuuuucugcuagagcuuuggcuaacuuccucaaaacacucccauaauaagcagguguuggccgggcacagugguucacgccuguaaucccagcacuuugggaggccaaggugggaggaucacgaggucaggaguuccagaccagccugaccaacauggugaaaucccaucucuacuaaaaauacaaaaauuagccaggcaugguggcacacaccuguaaucccagcuacucaggaggcugaggaaggagaaucacuugaacccaggaggcggaaguuguggugagccgagauugcgccacugcaagccugggugacaaagugagacugcaucucaauaaauaaauaaauaaauaaauaaauaaauaaauaaauaaauaagcagauguuaccauucuuugguccuccagaaagucuacaagcaaaaugccuugagcaucccaaaaaacuguugccgugaccucugcucuugucccauccacucuuaccacgaugggaccacguucagcucucgauagccauugcuuugguugugcuuugucuucaggaugguacuggcaaagccauguuuucacuccuguuacaauucuucaaagaaauguuuuaggaucuugaucccacuucuuuagaauuuccacugaaagcucuauucuugucugcagcugaucuggacacaauggguuuggugcccucugaguggaagguuugcucaacuuugauuuugcagucagaauuguguaagcugagccaguugagaugucuacgcuguuggcuaguguuucugcugguaaucaucaguccucuucaguuagggcaugaacacgaugaauguuuuuucucacaaacugauguggaugggcuggcgaugcaggcugcaccuucaacaucgccucaucccuucuuaaaugagucacccaucuggaaacugcuguucugugguacacugucaccauaaacuugucauaaagcaucagugaguuuaccauuguuccacucaaacuucaccauaaaugugauguuuguuuuggguucaauuuuagcagaguucaugcugcucugauagggacucuuuuuaaacugaugucuuuuccuucuuagcaccucaaauuagauccuguucagauauguuauaauaaguuaguaucaguuuaguuuggugcaaaaaaaaacugaaauccauacauuguuucacugcuuuuuuuauuauaugcauuuucuuuuucuuucuuuucuuuuuuuuuuuuuuuuuuuuuuuuuuuuguagacagagucucacucuguugcccaggcuggagugcaauggugugaucucagcucacugcaaccucugccucccagguucaagcaauucucaugccucagccuccuaaguagcugggacuacagacaugugccaccacacccagcuaauuuuuuguauuuuaguagagacaagguuucacuauguugcccaggcuggucucaaacuccuaagcucgggcauuccagccucuucagcuacccaaagugcugggacuacaggugugagccacugcacccagcauauuauaugcauuuuccauaaacuuuuucaaggccccucacaugaauacauauuguauugugaauacaugaaugugaguauauacuaugucuaucaugaacaugugaauguacauacacuaggucacaaauauaugaauguaugagcauacuauguaaugaauagauacauaauuauuauguuuugaauauacaauaugccaugaauauaugaauguaugaguauauaauaggguacacauaggaauauguacuaugucauaaauauauauacacacacauacuaugucauaaauuauagaagauuagagcuuaauaaaaccacuugaggucucauccaagcccaggcggggaguugguuucauccagagaaccgaugcuggcagauggguagggucugccuguagagcagagguuucucugggcucacugggggaaggcagugggugaccagggauggcuguugagcaggggaagggaagccacauucaugucacugucacacugugggcaggugucuggugaugagaggucugcccccaccaucaugaugcucacgaaccccaccuuucuggggagggggaugauaugagacacacacacacuggaguuaccuuggaugccuuucaaacucugcugccuccugacuaucuaaaagacaagaauggaggcaagcagucagccuggcgacccuccaagggggaaggccuggugauugggacuccaaaccuccaggaggggcacuggccagcucaagauaaaagccaagggcuccuccuuaugaggucugcgggcucuuuucucugaggacagccugccacccaguaauggaaaaccagcaacuggaagucagggggaaggaaggaagcccuugucuaccacccaggacacagggaaagcaggggagcgagaggcccagggggcuaggaagagaccugcugccgcugcccagaacuagcgcuguggaggcggccagcaagagcagagaggacaggccaucuacuggugguccgucccgggcacccuccuucccaccucccuccaugcagccagggccaggggagagagucagaggaggggcugggccagggaagggagguagugugggaaggaggaggcagggaggugagagaggucagggagagugcagagggggaggaagagagggaggaaagcagcagcagcagcagugggugccagaacaaucaccccucugcagagagcagcgcggcccugcccuuccagugccaacugggagaccugagccagcccucccugagccacaccugcccucugugcucccaagcccauggccacagcugccaggggaucuucucuggacaccagcagaggccuuugugggagcagagcccagguaccccucuuccccuucuuccucccaucuccccuucccccggcccccaccucacucuucaguucucacugcagugugcgccuccuccuuaccugcugcugagaccucaggaccuggggcacccaguagggcaucacugccuggucccuaggcaucgggaggcggcccccaaagcgguggcauaggcaggggcacaucuuggcgguuugggggauaggaaauugaaccgucuuuugacucuaacagagaggaugggaggagaagauucagaaggggauggagccaugccuguccccaaugacucccugauggagccaucccccagaagauccccuggcugggucuuaguaucagggcaggcccuggagagcuguucccacccacaagcacacccaaccacuccagauaugggacuguggucuacccucuacaacaugcccacuguugggagacacgggaccuccguggcucaccuggccucccuacccaccaucugcaccugugcccuggcggagcacacagguugguauugggagaccuggcucuguccuggucugguggucuccagcuggggcccuugggcaugacacuuagcaucccugugccgcagugcucucagcuaugaagagggcucugcuggcaucuuaacaaaguuuaucagguucuaaaauagacagccuuugaugcggcaauuccacuugcaggaaugugucccaugaggauacuuucacaucugcaaaguguccuaugcacagaaauauuuguugcaccauugucaggagugaauggacagcccgaauaccuuucaguaagagacaauaaaugacagacaucgggcaacaggguauaggcagccuugggaauaauggaacagagcuguccggacugacacggaauaaacucugagacaggcuguaaagugaggaagaugcagcaccgugaguucacuacacuaccauuugcauuuuucaaaaaagaauguacaugcaaucacauguaugugaauuauugcaaauuacacucuugccucaguuccucacccucccuaaagcccacccuuggcacugugacccugcagcuucuccagcggaaagacaggguggucccaccucucagcugcggguucaacgaggcacaugguucgggcaacaggaugaggaggagguuacagcaggaggaggaguuacagcucugcacguagugguagaggcuauuagacacgggaggaaggccgggagcaguggcucaugccaauaaucccagcauuuugggaggccaaggcagguggaucacuugagaucagguguuugagaccagacuagccaacauggugaaaccccaucucuacuaaaaauacaaaaauuagccgggagugguggugggcaccuguaaucucagcuacccgggagacugaggcaggagaaucgcuugaaccugggagacggaguuugcagugagccgaaaucaugccacugcacuccagccugagcagcagagugagacuccaucucaaaaaaaaaaaaaaaaaagaaagaaaagaaaagaaaaagaaaaacugaaugccaucccucauaagcaggacaagaaugucuccucucacugcucucuucaacacuguacugaaaggucuagccaguguaucaagcaagaaaaauaaaagucuccaaauugaaaagggagaaagaaagccaucucuauuugcagaugacacaaucaucuacauagaauagcugauggaauccacaaaaagagcuacuagaauaaauagguuuagcaauauuguagaauacaagaacaauagacaaaaaaucaguuguacuucuaauaccagcaaugaaaagucauaaauugaaauucaaaaacaaugucaucaaaauuaugaaauacuuauggguaaaucugacaaaagauguguaaagccuauauaauaagagcuacaaaauauuuaugggaaauauuagagaaaaccuaaauaaacauagaaauguaucauguuuaugggucaaaagauucaauauuuuucaaaagacaguucucuucaaacugaucuacaaagcccacacagucccaaucaaaauuccaguaggguacuuuuguagaaacugacaaacugauucuaaaauucacauggaaauuaaaaaaaaaaaaagagaaaagccaagucugaaaaagaaaaacaaaguuugaaaaugaacacuacuugauuuccaggcauuauaaagucaagacacaauaaucaagacaguguaguauuagcauaaagauagacaauuagaucagaagagaagaggguucagaaauaaauucauacauauaugaacaacugucaguccacuuguauggccauaaaggaauagcugaggcaguguaauuuauuaagaaaagaggcuuggccaggugugguggcagcucaugccuguaaucccagcacuuugggaggccgaggcgggugggucacuugaguccagguguuugagacuagccagggcaacauagugagaccucaucuccacgaaaaauaaacaaaauuagccucguaugguggugcacgccuguggucccagcuacuuggggggugaggggggaggauugcuugagcuagggaguucaaguuuguagugagccaugauugugcacuccaaucugggcaacagagugaggcccggucucaaaaaaggaaaggcaggccaaagacauggaaagacauuuacaaauugaaucucggaucaagaacuuguaucuagaauuuguaucuagaauauauaaagaacuaucaaaacucaguaauuuaaaaaagcaauucuuuuaaaggggcaaaacaaacagaugccucaucgaguaagacaugcagauggcaaaagcacaugaagagauccuugacaucaccaauuaucacggguauacaaaugaaaacuacgaugagacagauacccauuaagauggcucaaauuaaaaacaucagcuaaaccaaguguuggugacgaugugaggaacuggaacuuuagacacugcuaguagagauguaaaaugguggaaaacagucaacagguuucuuuuuuaaaguuaaacauacaccuaccauaugauucaggaauuccacuccuugguauuuacccaagaagaaugacggcauaugugcauacaaagccuuguacacaaauguucauagcagcuuuguguguaacacauaagaaguagaaacaacccaaauguccuucugggcgaaugaauaaacuguggccuauucacauaaugcagcauuacucaauaauaaaaagaaugacuauugaugcccaugaucacauagaagaaucucaaaauaauuaugccaagugaaagaagccagacaaaagaguacaaagucuaugaccccauuuauauaaaaucaucaaaaaugcaaauuaaucuacagugacagaaagcaggucagugguugccuggggaugucaggguauggaauguuggguaaaguuacaaaggagcccacggacaugauuaaggguuguguauaugcucauuaucuugaugguggugguggguucaggggggaauaccuacggcaagacuuaccacauuguacauuugacacacgugcaguuuaucacaugccaaucaaaccucuagaagucuaguuuuuagaaaaaacuguuuaaaaaucacagauccuuuuauaguucauaagcaugauaacuggguacucaugcacaugugugaggugugccucccucagaccuugcuacaacgacagcacauuacccaucugacaugaaaauaaauaaauaaauaauaucaaacugucucccugaaauguuaaaauauccauucauauaauacuucuaauucugaggggugacuggucaacugacauucacccuggacccuaggggaagaccuccugguucaagucaccuaccugcuuucggggucucagggacagagggacccaguaaggcagugcugcuuccacccuggacacaggcaggcggcccccgaaucuggucuggcauucacagcagauggcccaggggccagggugcaucugaguaagauccagaaaugacagaacugagcuugaugcugcauuugcagggagacaggaggcucucaagcacaguagauccgugcucaggaagaugguguccgggggcaggguccccagcuccuacugcagcuuggaaagaggcaggcuaccguggcucgcccugaggccuccaaggucauuuggagggggaucccccggagcuugcaaaucaggugcgcugggauucucagcugcuuccugcugugcuacaaugagcaagucucgugguccccucugaaaaugggcauguacaagcagcucuagagcuuaugcgcacaugagugcugccuuuauggccaucugucacacucuggugugcaagagcuuccacauccaucccaugugaccuucgcaacacccucaggcaggaaggagaggugcugccaucaccuccaggggcacacggagaagcugaugcccagagcagguauauuagguggccuccugaacucugagguguugugagggccugggagguguucuggaggcccagggauagcuccugcaaccacacuuuuguguuuggaggauucucucaugggaugcagcuucuggacccacauucccugcucuccucaccccacagggauauguuggggucagggccaguggcugaggauuugcuuuccuuaccgaaugacgggggaggcacacuucuuucuuguagguuugaaaugugcuauuccuagaagagaagaacagaaaagcuuaggguuuguguaaacuagggggcagggaugcuagagcacaggccuggaccugucuucucagaacugacucuuaauaauaaagcccacgggugguggggauggggggauccucugagcccaagaagagugagagggugacaucagaagcaggcgugugcuagcucaugcgugaaugucuaggggcuccugggggcuggcugucauggaauccugcauucccaagccaaccagcuucaagcugacuccagcuacacuugugcuuggagcaucagaaaagacaggagcauuccaaccugcugagaacuuuccaagacauguagcugccaaucacaucaccuaggaugaucugucagacacccucaacuuacugaaauacugaagaaaaaacaucgucaaacuguccauuaaugaaccuccuuccacuauaaaaacccgggugcuuugucucugggaugacaaagcacuugggguuacacagccuguguggcucuucccuguuccacuccccaacaaacugcuugaauguuggcuggaugaagcgucuccagugggugcaaagcccugcuucccugacaguagugggucaaagugcuuuguauguggaaaccguaagagcgauauaaguguuuuuggguuucauugucauaauaaccauuauuauuauugcuauuuuugugagaguaauagguucacgcaucaacucucccagauaaugcuugaaaacagaggauggggcacugcccuccacagcauccgaggccccuucugguaaugacagcacugcuauauuccugguggggagggggggggccacagccaucucaguccuuguaguucaggugggccaaacucaccacugcccagccuggaaagcugggaaaaaaaagaaucuccuuuuuguugagguugauaaucugauaacauguaaaccucaggagguccuggugaucaucuugccuccacaagggaagccagcaaaaaggaaggaagcugagagauggagagaaaccuuccaggaccauggucaauguguaccuggauacauccaugccugaaggccuacuucugacauuuucaguuauguggaaccaucaguugcguuuuuguuaagccaauguaagugagguuccuguggguggcggucaagaguucugccugugcauaggucauggagcaaugccgggccgggaacucacaggcgaggugucggguagccgcgggcaggauucaggacucacuugccugccauccugcgcgcugggugugagugccaaccugcagagcccgacgcaccccgcgcccggccccccggcagcagcgccugaggcugcuccaguggccucaugaugauggugacaacgccgcggggacgguggggaccggcucgcacgcauauggcuucuuauggcugacgcgcccuuucacacacacaucguccgcaggcccugacgcccuggcucccgccuuucccuccugccccaggaggaacccaacccgagcucaaccccagccccaaccucaaccgcucagaggagcccaacaacgcccgcgcgcccgcccgucccgcugacu

SEQ ID NO: 191985 - RNA, 39472 nt, Homo sapiens
uaggaugauugaguguuucuuuaaaaauaaaaaccccacaaaaaagccagaacacccuacccaacccagcccaguguaacagguuagccauuaacacagaauaaagaaggucccagccacacacgucauuacucggcagaggguguccagccuggucggccgacgucacaguggauggcccugcguggcugggacacagacagggagcaggcauggcaccugcgccacgcagagcagcaaggcugagcaugaccacuggaaauaaauaaacauggugccgacagcaucuuuaaauuaguaagacguuagcacaaaacaaaaaagcacaacgacugaaaaugcacuugcuuguugugguggguugugcuugaaaacaccugaagcccacaaguggaaaccgcuggggacguuugucaguggaguguggagaaaaagggacggaaaaaucaagucuucugagacaguccccugcgguggcccuggucccuguggaauuccagcacagcaggagggggagggggaagcaggccucagucagcaccgcgggacacggccccuaccuucugaagugggguccccaggcuggaguggggcacacagcaccaaggaucacagacuggaccccccaccaaccuucugcggaggagcucccaccccagcucagacgcccagaagagaccugcgcagugugaagacggaccccagcggccccagccauuucacuagcagcuacuuuccacaacagacgcuggcagcccccaugcucgcccacagccgcagcagccaacaggcaagugcgugccgucgagaggccgccggcucccuguauccuugaggcauguccacgucccagagcaggagguuggaacagaacggcaucccgaggaccccuagccgaggcgggaagguaagaggcugacgucgugcgugggccccgccggccccagugggaagcaguggugcgugccuccagggagcacuucuccuggacccggggccguggcugccuacgauguccacugccuccuggauucacacagcaaugcaccaggcagguggggcaccagcugcuguccuuauuugcagccaagagaacaggcccagagggaagaggucuugcccaacacagucaguccaccugccugcuggugguccucggccuccagaccgugggcugucccuuggacgaguggaauucguccccaggaaggaugcagguccuaugagcagacgcugugaagucuguccaugugcagcgggaagcaacggggcaggggugaauaaaggucuucauuccucaagcaagagagacggacaucugguccugaguccccaaacuguucaucagguuucuccgggcccacuggauggugagggggucccggugcccaggcgggggcggcaggcuccacugggcacuugcugagagcuugcggcuugagcagccgcuggucagugaagccguguccggcuucguuggcucccggcuugggacacucagggcugugccacaggccagcuccuccagccacagcugagcacuggagugacgcuggaccacuuggcuccaccucuggcuggggagaagggaagcccggggccugagaaggcagagccccccgagcucaggagggauccugcggggucuucuuguucugggggucccuggcugcugccauggaggcagcgacagcucaggaaagugggccgcauuggccaggccucggcugccucccauagcgaaaaaaauucacgggaacaacagaaacaaggggugcccuaguucccucucugcaggcggguggggacugggugagagcccaggggccuccaaacgcaggcggcagagacgugagcagugcuuggcucugucuccuagacaacgggcaucaggaccaggacaggacaugagcgugacagggagagcggggaggugccuaggccgggagugggaacccagcaccggccagaaggggcugccgggcgguacagaggccaaugcauuggaggcugaggguagcugcgaccucuggggcaggggacacugcuguguggagcccagggugggcgcccacaugggugccuggccgcggugugucugccuuucuugucucuguuucuagaagacugaaggacagggcuuugucugcaugaaccagaacucagccuccaaaacuggacacagaaauagccaagaggccacacugcccagaggccaggccuggugagcuaggggagaugccggcaccccccaacccuggggcuguucccuggcucaggauggugucucggggcuaggauuauggucaggaguccaucggggccucaagcaccuccugggaggaaucacccaccuugcccagaucccccacccccucccagugccacccuacggcugaguuuccacucugcaaacccuaaggcagagacauaagcccacaggguugguuuucacgaaugucacaagcccaugugucugggcagcuguccggcuucagugcaagucugugguagcaaugagguuccaagucucaguagcucuguuugcccagggucugggcccuuggggcaggagaaaggaaggcuccugccuucccccagcuccuuaaaaaaucaucuuaguggugucaaguugacccaaaauuuaaguuuaaaaaaaauauauauauaaguaaacaaaggagggaagggaaaaagggcccaaggagaccaaaagcugcuccugggcaggagcacaggcacaccugggucccuggcccucaguugagggaugagauucguaccagaguuuucacagcagccuccacugcccgaccugggagggacggcgagggacugggaugggcagcugagcuguggguugcggggaaccggaguggguucgaggaggugaucuacuuuaacuggccucugcgcaugcuccuccggcagccacucggccuccuggcuaugucuccugggggaccaccugcaugagcuucugacacaggacggucguggagacugucaggagagaagacagcuguguuagccugggggcuggguaggcacccgugggacacgggggcgugagcuggggcucccccagcccugcugucaccaaacccagcgccgcugcccagcgcugggauuuuaaggaaccuucccuuguguacuugcgcaugugggugccgggugcccgaggcgcugucuucaacugaaaugcggaagugccacaucccacucggcccaccccucgccugcuucagaacccuggggaggcagagugcggccccuggggcacacgaaccaggcccuggugucucagcaaagugcaacggggggaugacaggccuuccugcagguccacacccgggccaccaccuggacacaugccuggacuguucacagcaggcagggccggaggggccaaucugcuaacggguccucggaagaccugucgcgccugggacugucuacagagacaucacucuguggagggggacugcuuucaggauagagacggggguuugcuuuaagcucuugguguccugaaugacaguuaaugcagaucccacugcaaagcuugaggcaaauguucuaccaugacccuggcggugaucagagugugggguagggguggggggucucccugccuguguugcugccaucccgggaauucuccaagccacccagugacauggggaucagcauguaggcccgcaagcaccccggccuuuuucuacgagccuggccacauuugcaggcgcugaggacgggguccugagcuuggugacaaagcaccccuggggcugccgcugcacacagggccggggggcggguuucuccuucugccuuuuuuuuuuuuuuugagaagagucucgcucugucgcccaggcuggagugcaauggugcgaucucggcucacugcaaccuccgucucccggguucaagugauucuccugccucagccuccugaguagcugggauuacaggugugugccacuacacccagcugaucuguguauuuuuaguagagacagaguuucaccauguuggccaggcuggucuugaacuccugaccucaagugauccgccugccucugccucuuucugccuuucuggguaagucugcuguguccgcugguggcagccagcaggauuuuguuacuuggcagcaguagccugguuuuccggaaucccucguccugagagauuagcuggugcugcgcugugugucuuaucccugaaccaugugggcugcgugucacuggcggacacugcagugaccugaacccuccugccacccaacacgcuucgccccauguggguggagacggccgacgccucucaacucccuucgcugcccagggcagaggguaccacgggcugugggccagcgagauacucacagaugcccuggaggagccacuugggcuuguuuuuccaccagaccccgaagaaguagacgggcagcccgcugaggaugauggugaagccgaugccacacuccacgggugucuuccagaaggagacggcgaucaggaagaggcaggccaggaugaagaacacaggcagggccagguucaccuggggcagaggacagggccugggugagcccucuccuguccagccucccucccccaugccccgagguuccucagcccuccugggcccuccacacccacggcugcugacuuccaggucaccaagaugcgaucugcacuccaucugccucacacaccgggcugucccgcccucgacucugcauacagugcugggcauguugccaggggcucaggcggcuuaugaugagggauggaaggagacagcuucgucucccgaggccucccacgggcagggaaggucacggcuccauucccacaucacaggccuggaaacccugagccgccaggacgcacaggggccugaugcuuccaggagacaguggccacccacuaauaagccaggagaccacccucuuggagacgccgcuguggacagcgcugagcaaaagcccaucccugaagcugcagccuaaacugucaccuucagcagaugagcuccacccggcacagaagccaggcagggcugcaaggagccugcaggccgcaaccugcggcucggcauggcugggggauugacucagcuguccugaauccauacuuggacagggcacccugggagaugcagggcugaccacaggucccagcccaucagugugggcugcaugacugcccuguccccagggaacagacgccaacccgugcccaggcucacaacaguggguagagccuaccccaugcccagguccccaugggggcugagcccccgcugugcgcagugacugcccugugcccuaggcacugccccaggcuggcacagcaggcacaagcuggugcccauguagggcggcuccucccugcccucugcagccuucucuuggggcagcaucuggguucuugugcugacuguauuuuaaagccccuguuuuuuuuguuuguuugagacggagucucacucugucguccaggcuggaguacaguggcgcgaccucggccucccagguucaugccauucuccugccuccaccucccgaguagcugcaacuauaggcgcccgccaccacgcccagcuaauuuuuuuguauuuuuaguagagacgggguuucaccguguuagccaggauggucucuaucuccugacuuugugaucugcccgccucggccucccaaagugcugggauuacaggcgugagccaccgcgcccagccuaaagcccguucaacagcauucacaggcacccccggggcccccaggcuucgggaacacagagggagagaugguccgggcagggaagcaggggcuacugugacagccauaggccagcugagugacaaaagcugcuggcuagcagccaccaggggcucuggccucuuguucugugucagggccagggcggcgggacuugcugggccccaggcaagagcauggccucugcuggacggccccguuuuuggagaaggcagcccacggauaacagcuaccccucugaaugagccgcuggggacggggagaguccaggagaguccagcugggcccaggcgcuccucgggccggguucccugcauuccuccugccagcacagccccgacggcccuuugaaugcugcgccaggcccggcucugccccgccccugccggggcucaccaccgcccaccuaugacugcaguguccuuaucugcuucccuccacccaacggagcacaagcucugugccaucugcuguccuuugaggaaccccggcuccugcagucacacuuggcacccucguagcugguggucaagucaucaccggaauuagucgacccaggugcaugcaggcaggggcagguccagaggcugagcugggaugcuggcucccaacucaggguccuuaggacccacggacccugccucugugaagggugccugggugagcgggaggccccgggcucaccuugaugggccgcucaagcucaggcuuucuguggcgcagccagaucaugccgaugauggccagggccacgcagagccaguugaagaagcugaagaaguugaugacggagaagauguccuuggagaaggcguagagcagcgucaucacacacuggaagagagaggcggcuggcugagcccuggggcccacgagcagggcuguggacggccgugguggccaccggggacuguccagccuggcugggcccagcugagcaccagggaauuuuguuuuaaaggagaaaccucaucugagcaacaugcaaggucuugaaggaggaaaggagggaaggagggaggagaggaggagggaagaggcggggaggagggaaggagggaggagaggagggaaggagggaggagaggaggaaauggagaccacauuuggguuaaggacaggugaagaacacaguguacauacacagcugggcucugcuggacuguggcucugugugcgagggccacaaccugaccuaacccaguggucaccaagaaaacaguuucuguaacccccggcacagccgugcucccgaggaccgugcagcugccaaagaguccaggacuugcugcccuuccugacuggcuucuaacucagggaaggaguaguaagcaagggccaggaccucugaggccagcccacagcugccagaccccagcuuccucugcuguaucucacuggcuuugggggaagcagccuguugggggagcccagugugcucagggguggggccugcagcccacagcccuggaggaagccacuguggaguggccucuccagcccuggucacacccuacgaugagaacacagcuucaggcaccagcucccugaauuccugacuuacggaaacugugagauaauaagugcuuuuccuuuuagaacacuacauuuuggagugaugugugacacagccagagggaacaaaggcagucacgcgggcuggcacggaaagaugcaggagaagcggaaggaaacugugugugaugcaccccgcugagaaacgaacagagugggcgcccacggaggugcagugagccaggcggcuggcagagcagcaccccgggucagcuucugccucccgcauuuccgauggucugaaucguuuguggcagccaccauauauuauuuuuggaauaaaaucuaaagccccuccagcgcucucuggcauucagcggagcucggcaggaggccacauuugagcugucacccaguccacaccccagacagagcugcaagcuguggcagccucccucugggagcccccggacaacccccagggauguagggcacagggccgugcagcaggcuuaccgugaacacgagggacggcacgggggugaggagcuguggguggaucauggagaggauggagggcagguggccuucccgggaccccacgaagaagagccuguggacagacaagaguggcagagucagccaccgccccacaacucagcacguggacaggggacacgcaggcuggggaguggcagggccugugccuggcuugucugggccucucuggccacagugggaaccaggccccuccagccgcuggcugugggccucucaguucccccaaccaacucggcaaggacagcaacuugggagccacugcucacuccagcccggggggucaagcggcggccacagggcaucuaggacaccacagcugugucaccuccaggcaggaguggggaggcgagggccaaaguucaugcuuccuuuauuucuguauuauuugggcuugcugcugccuuuuuuuuuuuuuuuuuuuugagauggucucacuuugucacccaggcuggagugcaguggcaccaucucggcucacugcagucucaaucuucuggucucaagcaauccuucgaccucagccccccaaguagcugggacuacgggcacgugccaccacgccuggcuaauuuuuguauauuuuuguagaaacgggguuuugccauauugcucaggcuggucucgaacuccugagcucaagcgaucugcucaccucggccuccuaaagugcugggauuacagguaugagccaccaugccuggccuauuugagcaauuaugcauccccaguaucacagagacaaaccuuuuacagacauggaacauguugaaccuggccaugaggccugggccucccucaccuguggugggucgggcugugcucaccuggaggaugugaacagggacccauugacggagccgaagcaggacaggcccacgaagacggggaugauccaggacaugacgcccaggugauaguucccgaaguccuaggcaggcacaaccagugagcugggccccaccgggccggcccucgcccucccugugcucacugggagcccucugcaccgggccagcccucgcccucugugcucacaagagcccucugcagaggaccucucaggcuggauucuggccucuggggggacuucccaggacagggcuuuccagugaccccugcccagccugcuuguuggggagcccuugcugguccugauuugcccccuccucugggacucccuggagcaagcuacggccugcagguggggaucuugccuucccccgugggguccuccacaggcucagcacggugcccugccggcagcgggcugggagucagagcuuguucaguaggaagcuggccagagcacccacucccuguucccccagcccugggagggcagugggagaagccucgggaacugcgaggccagccuggcugagcugcccggugacaccgcccgggccuggccucccgccugccaagccagcagcagccgugccuucuaacgaaccccacucuguggcagacuccaaucuuucuguacucagauuuaaaaugaccucugcccuggacuccccaggcauucuggcuuauagcugguucuggguguggcuugguaucagauuuuaaacccuucuccccuuugacucccccagcagcugagcuugaggaugauccccagacacuuccucugcggucgcugugaggggagaccaccacuccaccccuccggguaggggaggcuuagagacgcggggcccccucugcguaggggaggcuuagagauguggggcaccacuccggucuggaagggacgggcuggccacagccucucaggccccugguggaagcuggcggguagcggcucaccacggccacggccucggacgacagcaucugcucgguggacaggguggugaaguaggccagguuggucagcacguacaccagcgucacgaugggcagggagaugaugauggccaggggcagguuucuggaaagaacagggacgacaugucacccaacgcagcccgggcugaaggccaaacccugugcccaggagccaggugggcuccucgcaagcaguagcuccagccucugugcugggcuucucggggaaggugggaagcagcaagagaacacaggcuggcggcaggaggcugugccuggagcgggacacugcacagcccuggcuggugccuuggccgcggccucagcuuccccaccugagaaauggggauucuucggggugaccucaagggcucaggagaguuaagucaggccaccuggucugaauucuaaggcucugcccacgagcugcacagccggggaccagagccgagagcccaggcagcuccucuguaccgucccgcccugaguggggcccucacuugccacccguucucuggagaaaccgugcucaaggacacacggccagaagccacccgccccacauccugcuggccccagaggccccaaucacggcccgacugugaacuggccugagccgaccaacaggcuucgaguggaauguggcugcuuccugccucacauuaaaauaaugaaaaaagacggcuccauccauucuugcacguaccuguagggguugaucauuuccucugugacgaaauucaaguaauuccuaaaauuuagagaacagcguucaaauuauaugauccucaucagggaaaauaaaucaccggggagagagcaucccagggcagcuggugagccugccccccgguggucugcucgcugggcuggaaagcggaccuggagugggagggagcucagccuccugcguguuccggggggucccugcuaccccuuccaggcccucccgcacauucccugccuguucgcccuacuggggugauucucaggucccugugaggcccgccugagcgcaggagucaggcuggggaccuggaggaaaggggccgcagggcucagccgccuccaccugccaccuucgccaagacugcgacguggagcuagagccagaguagggcugcagcgggcggccuccccacgcuucgucgggaugugggugacucuggagggucaccugccacucuuuaacugccaaggggcaguuaaagggaggggcaguccacucccuuuaacugccccuugauggcugggagauuugggauuccuggacacgucagggacuguauguccccagaccaagggacccagacauuccagaaccuaccauccuccauaggcaaagaggccgcuguauaaugccagcacaauguuccccacauccaguuuggugccuucaaaugagaaguugggaucuagauuggacacaucaccuggcagggccaaagaaaggaaugcuggguuagagagcgcugaacagaggucaugcuaccaguucuagaauguuccuggagcaaaauacauagcaaacaaaaaugcuggagugaaggcuuuucacugugacaaaugguauguaccugcugagccacauggagggugcaggguuccaaccacaaccagggggauguggcccugccagaggcccugugcccaccugagagggcacaggcaguucugaccacugcccaggagggcuccucagacgcuugucuacaggaggucaggauggaggggucaaccagccccaguugccuucaagaagguucccugagaccucacgacaugagugucaaggcaguauaaagccaggagaccucgguuugcauccuggcuacggcaacaaggaaggcccagagccacuagggcccugcuucuuggggugcgaggagcucggaacagacugcccucccuccagggcuggcaggacaggccugggcaagaacauagguuuguccuggaccgugcugaguguguggccagcugcagccggggcaggggcaggagcagggcugccagggccgagaacgauccccgugcugugugcagagcucucuccuuugcccucugaggacacgcgucacuggacuucgugacugcuccacccuauuccagaaggaccucauuucaaaacuugaacuucagucacaucugcgaagacccuuuuuccaaauaaggccaccagcauucacagguuccccaggaggacaugucuuuugggggaaggggugucuccggaaggucacguggcugcugggacagcacuggcccuuucuguggcuguugccuccucugugaaaugggccugguguguucgagcccggaauauauugcccagacaucagucucacagaccacugcgcuucaggaaggagaacuuggaaagaagaccaaagacaccaccggaacaaaggagccggguccccuccugccuaccugccaggugcauauacagcuggaggcacaaguggaaaucuuggucaggcuguggacuguuaguucauuagagaaccgugugugacaguauccuuccugcuggaaagucaccagcccgucucacagggccaggcagggacgggcccuggggcugcugugucccaacauguggccuuggaccacaggucaccaugggggcccaagaaggggaaccaccuuggugguccagggaacaccgcagagugacgaggugagcaaauuucaaaggggacccgugaagggagguucccauaagaccuuggcaauuaccccaaacaaagugcgcacuucaaagguggcaccagauuuccuacggcagagcccacgguggggucccuuccugauggguggacccaguuccuguuuugcaccugcuuccccguggcgugcuggaugccugcggcucugccuccagcucugucugucccagaugccaggugugcuggggccuuugaucuucagccuacacugggggugcugguggguucccugagggcugcccgccacccugcccugcugaggccuugaucuccugagaaggagcuccagggcccacugccugcgugugauguauucuggucaccagguggucagcaggcggagcuugacucugcaggccuggagcgggggcagcucagagcagcucaggacagggcacuuugcacagcaccucggcacagccccucuggccucucucccaucugcucucugauggaauguucuggaaugugcagacccuucacaucugcauagcccuacugugucucgcccacuuacuucugcuggggggagcaucuguccuacaagugggggaaugcagaccugccaggcugcuugagaaucaagguccugccucccccaucuggcacucauggugggagggggugaaggugagcccuggaggccagaaacacgugccccauucacugugaccacccccggacucagccugagcugauggacaggaggccucaguccaagguccccgccagacacaucaauccucauagcugaccuccagccucaugacagaaaggcggcugauccuacacagaggguggcugcuuuugcuaaggacaauauaccgaggcuugacaugguaugaggucuucagucaggagccagauauuggcagcccuaaggccugaguaacuuuuuuuuuuuuuuuuuuuuuuuuuuuuuuuuuuuuuuugagacagaguuccaccacgcuuggcuaauuuuuguauuuuuaguagagaugggguuucaccauguuggccaggcugguccagcucugcuuaaggguggccuggagggcugcaggagggaccugcuugcagcccagggcagcuggacacagggaggucaccacacucauccagugacuccacgcuacacacaggggagagacacaccagaggugggaguuagacagcguucaaacccugggggcagcaccccuguaccucucagcaugaccagcgggcauucugcacaccgggagaccugggcugucacgacggcggggugcggcgcuacuggcacggagcaggaggccggggaugcugcuggauguccugcaaugcacgggacacccccacacaacagagagcccacgguggcagaggugccaggcugaggcccugugcaagaagaccaugacaaggcaucagccacgagccucuaccccugccgggaggacaggaccagcuccucucagcuuucucucccauggacccuagacucgggcgugguccuggcuucgacaugaagccccaggcacugggcaggacuggaaggaauggcugagcggcccacucauccagcagccacccagccuccacaccugacagucugcuauccagucagccuccacccacaaggaggggacagcgugacagggaagugaggaagagaaucaccguggacagacggugacaucugccagagcccacagagacgcgagaacagacucagcgcagagccugaguggggcccuccagccccuuccuugucccuaagaggcaucuuccucaggggcugguggagcugccaugaaagcaaacgcacagccaaaccccggguggggggaaggcaaacugcaaacgccgcggcgaccccggcacagcagcccugucagcaggauucccccgagagcgggguaauugcggugggaacgagcgcuccaaaggcccuggggagaugauuucagggaaaaguggccuugaucccugagucaggcagaugcggccaugggaaccauccaccccgaggcuggaggggagacuccgccgguggcuaaagccauccugcugacggggcccagggacgcccccaguggccaaacgcacgugggaacgggaucuucccccuccucugugaugcggccaacccuccaagccucuggcuccugacucagaggacgaugucuccccaugaacgcagugucccuggagagaagagccugcccagcguggggaacaugggaauguggagauggagggcaucccggaaccucagggcugacgggccccugccccagcccuggaaacaccucagggacaagagagucacuccucaagcgcggacuuuccacugugcuggggccuuccgccuuccaaccacucuggccccuuggggcucuagguggagugugcugaacaguguccccaaaauucacguccaguggagcugcgggauguguccuagcugcaaaugcggucuccgcaggugcaauuagcgaaggaccuugagaugagaucaucccggauuagaguaggcacuaaggccgacgacaaguguccucagcgacacagagacagauccaggggagacagagccagagccagcccaggaugccuggagccacgggcagcuggaaggggaagguggcaccuugggucuggaccucuggcugccaggaccaggaccgucugcaugucuguugcuaaagccagucuguaggcaucugucaccacacaugaggggccaaccgugccacccaggggagaccucccggcuucucagugcaucaggcauggucaggggcaggacagcugcagcucacaccccacuucucagucaccagccgagugcacagccaauggcaccucaucuaagagggggcugugagucccauguggucagcacccuggagcuagcugcccugugggcucagggaagucgugcagugaccgccacauggguucaguccagagcccaggccagaguccaugcccaccccacagaguccacgcccaccccagaguccaugcccacuccaggcagaguccacgcccaccccacagaguccacgcccaccccagaguccaugcccacuccaggcagaguccacgcccaccccacggaguccacgcccacccuaggccacggcgccgcuuuucagaugccuguuucgcucuggccaucuaaugccugggaaccgugauggggcaggaauuuggguuuggggguucuggcggcaaccagauggcacuuuuggaccaccagcagugucugucggucuuggaaacucaugaaggagugggcccuuugcuuagagcugccaaccucacaccagaaguaaaagcuuuuuccaacuccacaggcggggaaagacccugagaacuguccccagcacagggcuguggcugcccuggccucuguccaugcgucugacgaagggcaccgggaggugaaggccgcgggaaaacaagccccgcucccguccuuugauucugucccagcacacggcaccggcagagccccagcuuccccagccugucauccucccgaggccgacggcacagaagaauggcaggcccaggacacacugagcucccagagcaagcggcgggucaagcauccuuuaucaacugcgaggucuucgaggcccaaaagaggugcccugagucgcgaaguacccacccuuggggcagccaacgccgcagcccuggcuccaggcccagguuguccggaguggagccacacucgagccuggcaccaaucugggagcuccugagcgcaauguccugucugucccugcaugacccugagacugucugagaugccucacagagagaugcccuggagucccccacaggcaggccagccuggaagcuucucuggaaagugagcuuuggcagcucgaggccgagcuguggccgacuccucccuugguuaacacagccuguacccagcugggauucacuuugaggcccuggggcuugcccuauuuccugccaggagagcggggcccgaagcuccauccugucccccaaaacucagacguggaagcccuaaccccgguguggcuguacguggacauggggccucuacagauuaaggguaagugggguccucaggguggggccugaucugacaggauccuuguccacacaagaggaggccccagacagcucacucucccacaaggaaacacagcgagggggugucuaggagccaggaggccgagcaccccgcccagggcaucagggucccuggccuggcggggccucucaccgacucucccgccggcauccagguagcagggcccuggcaccagacccucugaagcugagacccacccacccaggccugcuccgcucuugcugucacccccggagaaagcggcagucagggcgugaggugaggaaaaggggcuguuggacccugcauggcaguggcucccgugccggggacgcggugagccuggccuccucccugcaagggaggacagcccauuucccaggggaagacaccgaggcucagacacccuggccggggggcggcaaaacuagaaucccaaggcagcugcacaucuagcaccugcccuugcccucucuccgggagggcacccuagaagcccacaguccugaucugggguucggagagcaggcugggcugagcucugcugggagcgccuagaagcccagcuauggguccacgcacacacucaggugaagccaggcccagaagaaggaacagcucuaagccacagcccaggggggcuucucaguccacgaggcgaccccuccacaccccagagccacagacagccaaggugugggugaaacguuuuucucaccagaacagcccagcagcugggcaugugcugugaccacugagggggccuuugucagaaacaucgucugggggcuggacgcccccacccacaggaagaggagaccaagacagggccgcacacccccagccagaugagggccagaugagggaggcggcaccucuuccuccaggaagcuccucaggagggacaucgggaggggcucagggggcugccuucaaggaagcucagugaagcucagagaccagucugaaaaggaauguccuccagaccuccacccucucaggauggacguguuacucaggaacugucccgucagcuuuucccguaacacaugacaccccacgugaaccucccaagagcagaugggcccagugcuguccacccgaacgcaccuugggaacagaggugugggccuccccccagcagcgcaugacccugcacacugcacccagggucacaguggggguggggagggaccugcccacugcucacggcugugggaccuggggcagggcaccccacuucucugagucuaaggggcccuacuagcugaagaaccaaaggaaaaccaucauuucaaaacugucacgugacacacaaaugcaggccccugccccacagcccaguggcacacacguauuuaccgccugggacacgggaccguccagaagugcccuacucauagguguaggucacauccaggggucucggccaccgggacccagggcccagcagcucagcaaagccauucagccggggucugagcccugcccaggggaagcauuuuccccuccuggggugaaggacagcaagaggcacgccgcccuggcaggcugcggcuuucuuuccuuuuuguggacagagugaaagggcaaauuugcuccaggggaauacugaccuccaacaguacaaugugggaggagaaggaaaagaaaguuuuuaugcaaccuuuuuuuuaaaucugcccaacuauccaaucuguaacuguucaaggagagauuaguuuguucugccgcugacggcugcagcccaagcaaagcacaaagcgccccauuguguccuccaggagggacgugcugcugcugcugggcugggacggcagagccugugcccucgcucccacccuccgcccugcaggcgaaggcccagccacccucuccuuaggcaacagccugcgaguggacucaugggacggugggucagaucugaacccucaugaguacugucucccuuucgaaaaggcugggacuaacuguagaaccucaugugacaccuaagccugcguguccccaugccccagccuaggggcagccaugacucccccaagacgcggaggaggcaagggcucccgaccacucaggccccugcagagucgccccugucacucagccagcugccccucccagcccgcaucucaggaaaggcccaaccccucagaagggcuuuucuggucugcaccagggccccgcuuauuccccacugcgacucucccauucacgugccuauggcucucagguccccccaugagcucuggaugcggggccauguucucauugggacccggcauagaugcggcacacgggacagaagaugguucugcggauggccaacugggaaggggugauuacaaacuucccugacgaggaggaaacaggucagccaaggccuacaggacccuagggccagugccuuuccauagcacagggcccaccugggggccaagggcagcaaggaggagccuuuucagccccaauggagcagggcacccagggugcgggacaggcaggaacaggugcgugggccaggccugcucugccagauuuucgcugcauucuccagacccggaaagggccacuugccagucguugcaaaauugaggccggagucucugccuugaaguaucugggggcgcugcugccaggugccagcgaggggagggggcagcugcccaagggcuuugcguccacugggggguauaaaguuggacaacugcuuugggagaaaggggucaacacaauguaucuucuaaaagcaaggcauucaucugguaacaaaauaaaucuguugaagccaaacaggagacaggaauucugcagacacugcacuguaucccaaagcucagaagggaauugcuggggggagcacggugggaggacgcuuucaacagcuaacggaauuauaaaccuauuauguauucaagucgaacaaaagcucuuugcucucccuaccgaaauuuguuuuuacaaaaaucacguuccccuccuaaaucuuuccuggcuaucugaugagcgcagccaagcaaaggccuucacgagcaaagcaccccuuccgugcccacuucugggaggcacaggauggauuugucuccugcccguaaaaugucacucaggcccaaccaccucccugggcaacuucugagugcccgggagccauggaaugagcucgucuugccuugaguaaggugccggaaccugaggucccaggaagguucagaauugggacuuccugccagcccuguccugccagcucuuggguggcucugguaccccgggcgacucugagaaucccuggucagacacaugcaugggggaugggcucgagcuccugaaggauugaccugggcaaccuuccagagccaccugggaaucaagugggacuuccccucgacgaugaggcagguaacuaacaccugcugcagacuuuguacagauugauacauuugauaaagacagucuggccccagccccuggagcucgccucgcuguggugaggucaguauagcccggcacugcaucccccugcaggcccagguuaccugcuugguguggagaccccuccccagcugcagccagacuuuguccuaaggcgaagugccacguacagccagcagggggcgccaggagcaaggcggaggcucagcuaaagcugcgugcugggugcugggugcugcggggcacuguucaguucacagcccaccaguggcacggugcacacaggagagccucccagcccugaggcagggccccacacaggaggaggcagcguccuugugucugcauguuuuggccuggccgugcaugggggcggggcagcucacagcuugcugggugaggaccuuccugccucuaggagcaagguccuugcccuguccucugcagcccugggguccuaccugccuccccuacagccaugugggaccaggcagccucucugcagccaucggugacugcgagucaccagagcgugcauccgccgggugccugcacucagcgaaagcuccacagcuccaggacugggaucaucucuaccugaggcucugggagagaagagaaggaggccagcuccuaacugcucugcuccuaggcuggcuccaacauggauggagacaaacucagaaggaacugcagacagaggcaucccugcuggacucaagcaacagggccccccacuucaacuguacccaaccacgggugggauccagugccaaggacagugugucccagggucugugaccacacaaaugggaacugcuuaugaaaccccagcccgaccucaccgcggaauggcaguguggaaaggguggaggcucugcaggcagacacagaacacagaucuauggaguguguguuaaaggguccagagacacccagcaaaauaccaacugugucaguccacgucaacagagaacacaggugcaaaggggcgggggcuguuucacacucacucucuuuauuccuucuaccagccccaagagaaaaagcagcugggaaaaaggcucagaaucagugauuuccccaagaucacacagcacaagaccaaagucugggccagccagccuuaaaaccugugcgccagacugcucucaccuguucccgaaugcuaacaguggacacgucugagugaugggguuaccacguuuguuuuguuuuccaugcuuaccucaucuucuuuaaaaagcagacagaaacacagagacaaucccacaccugcccauggaaugaugaaugaaucacagcaugaccaggagcauggccccgucgggggugggugaggggcgacagcacgugggacucugacagacccagggugagauggcucgggugaggucugcauggcaggcauagccccugccaggccuggaauguuccacaucgcccccaggugagguuacaacgcaucagcugggcucucaagauucacagacaucgcagcguaaaaaacaagaaaaacugccagagccccucccagugguggccacgcugucccacgggagcacuccugugucccccucugggucggauuucacuugcugggugauuuucccagagggaaaucuccacguuguacagcacugcagagcugcggacugggaggcacccggggacgggaccucaugcccugugaaggacacacaggcaaagccucgaggggccgccgguggggccugggggacguacucacccuucccgaucuggacgaagcccagcaggaugaucagggccagggccaggagcuuggcggcggcaaaggcauccuggacccggguggcggccuucacgcuguagcaguucacggccgugagcagcacuguggagacagagggcagcggugaguuccacgggcagacagacgccagcucagggguaggcugggaggugacgaccccacccccaccccagggccagguccaccagaaaaacaagcuccuuaaacagcuccaguccccugccagcccuuagggcacguucugacuuucugagaccuguuuugauaaacuucgcaguccuuucaggucuaagggcuggaucccaggugccccuuaagaucugcaagggaccuuuccucaccccccaccacaccaggccauggagucccaccuguagucaggacuucaaguggggucacugccuccagagacccaggugagcaaggugacccugccacuuggaaggcgcccauuacaccuuuuuguaccuacucagcacccugaccugacugugagacccacgcacagcccgacugccggacuccaugagggcggggcccuuuccucaaagaggaucuucuguggauuccaacagaaguggggugucccgcuuucccggaacuaccuggccagucaccuggggacggcagccugggaggggccacaggggccuguggugagcagagcagacccugcugcccugcugcuuugggggcauacgaugaaacccaaaauagcaccgugugcuucagaagccugagugaccccacacagauggccagaacgccugccccaggaggcgcugagauguggggucaggcacgcucagacaggucuccagacaccagcacguccuccugggcccuguaaggcacccagcucugagccucuguguguguguguguguguguguguguguguguguguguguguguguguuggggguucuguugcaauauauaggcacgcugagccacugugugugugugcguguguguguguguuuugggggguucuguugcaauaugugcgcacgcugagccacuauucagggaucugugagcugguggggaaacagccacccccacaacuuaaaaugaaguaaaaucauauuaaucccgaggcacugacuccacgacaccccucacugccugcugcacuacccuucacuccucugcucacgagguuaucugucgcugucagcagcuugaaaucugccagugggaacgucuacaccccagaagugggcaaaggcccagcacgggccacccacacagcucagaucucacagcccucccggcaccgcaccacuaagacugcaggaaggugagagcaucagaaaggccgugggcuccucuucucucuuuccccuugggaguaacgcucagaaaggucuggccagccaaggccuugaggacuccaguggcuuuuccccagcugaacaaauccuguggaaucuuacaauguaagcaacagaccccgaggaaagacauccaugcuaauuaacuaaugacaccggaaacguccugaggugcgggacgggcugccgccugccuaucucucagaaauuaaccaccccgcuacaauucuguggaugccagagcggagacggcuacuacacaccaggaaagucugguugaaaaaugucugaaagucaguguuuucgcugcuauuccuaaaauaaaauacuugaaauuccggaacuuccacuccucacccaaacugaagaggugauucuucaccucuucccagggcucccagggacauggagauguuaccaguccagagcucuccaguccaacccucagggcucagcagggucaggucagugggucuaggcagcuccuuguccgcugcacagggcaaggggcagguccuggcuugccagucccauuuccuuaugguuggggggagcacgaccauaaaagaaacugagccucggggaccuagccggcuucuggagagcuuucuggauucgcaagaggccggcugauugcaucacucgcucauucaugcccggagggaggcggggaguggguguggccaagccgcacucgaggcugccucuccccaaaagggagagaggcacgcugccaccacugaacuccagacaccagacaggcgcugcggagacacugagcacugcccucgcggcugucacgucugcggcugucacgucugcuaggggguugggggguccaggaagggcagcgaguugcccagaauugcccaaccacgggcuguccugccacacugacguggugcuggguaaugacgccaucagggcugucacugugggugggacagaggccaggacccccccgcccccccccccaccgccagccugacccugccugcccaguuccaacccagccgcuccccaaccaaaaacagucuggaggggcugacgggugccaccgggaggguucaccagaucaucuccugacguuggaaauaaccacaggacagacaggcgggggccgggucuugaagucagguggggagcaaaauggccauagaacaaaggggaccuuauauuuauuccuuuuauaacaagaacauaaauuuucauguucacugacuuugggugaugaguaaacaaagguuucauuauucuccacaguguccuuuuuuuuacguuuuaagaugagauaaaaucuuaaacaaauacaugaauucaucuggguucaguaccuuucgaccuuaaggaggcgaggcagucacaggauaagucugggguuugaaccucagucccugcuggcacuugcccucucccaagccucaguguccacaccauggaggggcugcuggcugcccccacagcagggagaucgacagggcugugcccugagucagagugagggggcugagcacacagggccagccacccccagauaaguguggccgcgccagccugcggggacagcugggccaggagauaaaacccguccggggauaccccguggcguggcuuggcuugauuggcagauagccgggcaggcugagcugggggccccucccagucuggggugcugucuuccccguccucaccuggcugccucccaccuggcuggcuggcaggggcuccagaggagcuggggugccuugggggcagugcauuggaggaaccccugcccuccuccucccuucaccugugucuccaccacccuucagggccaucagccacagaaacauccucaucuucgggugggcauugacagcaaggcccacagcccggugaaggaaggacagcccuggccauacccagagccagcgccagggccuuggccaggacaccugucacagugaggcccaagcugugguccugguccugacucaaaagccacuucagauacccugaggcucacgcaggagggauuggggacgcggccagcccauuucuccucaggacccuggggugggcaccaaggccucccacugcucucgccacgugcccugcugcucagagcuggggcgucccggggagguugccaccacccagcaugaggugggggacacccccacccccuugugccuccccaucucugggguggggccggcagugauacugaccucagagaccaugcaagaaggcaccugaacagggagggcccacagacgggacaggugcauacugcuggcugggcccacagacgggacaggugcauaccgcuggcugaccccccaacucugcucaaucacacacgugcacacacacgcacagcacccccacaacuuguaaaccaggaggcugccuucuccuggccccuggccuuaccccucuccccucggggggaugacucucugaggugccucccugccugaugcccgugaacgcucaccucugcggcagccggcucugcucaccuccccugaugcuggcaucuuggucuccuggccccaacucuguccagcuccugauaaaaucccgcuacaagcaaagggaugaucccccaggguccaguguuggaggagaggggugggggaagggccaguaacagguguguucaauauggagagcaggugggaccugugggccccggcuggguggggaccccgcaggccccaugaacccaccccacacggacuaaugccugauucuuucagguaauaaacauguaccagguacaggagcauccguggauaggguucagggucagccacaaugaaaauccucucuguuggccacagaggcugcucccugggccgccgguccucaccugcccccgagccaggcacagcagugaguccugcagggcucagcaccuuggccugucuguaagugggaguacccagugaacaugauccucccgggccccuucgagcccaaacacagccacugugagugccccaggcaggcguccagcccaggcaggcauccugcagucccuucugucauuuucagacccaacagaaacagaagugcuccugccaggcccccgaggacugccuccaggagucaucuguaaugacaggcuguguuccgcgcacgguuucagagucuguccagagggccaaugcuggggcuggggcagagaugguccaaggccugugagcugugcagcuuuauaggcaaaugacgauuguuuacccagaacugccugcuggagacagcacagaggaaguggccggcagcuucaucaguuccaggaagcccaggcagccuggucccccagggugcaccgggcacagcaguucgcacggggccggagagcggcagcugaccacagcaacuacagcuggcccgacaccgggcacagguaccagcccagcccagucccgcccagugcagccuguggccccuagcggagccagcaccuggcaaaccugacacccagccuuggagcuugggccccccucugcagcuggcuggggcuccugagacagcuucuuugucggaauccacucgguacgcacagggccccgaacuugguggcugcccagugcacauggggcuuuaguagaaccaguaccuuccucccuggccccuucaagucuaaauauccccugcucugaguacaagccuccaccuucuccaccgacagacagcccccaccaucucccgugucaucccccgggggaacuuauaaaagcaguggugggggaggcggauggaaacccagagcuucugaucaggcagguccgggagauggagacaacacaucugcacagaacaaggucccagggaggcuggugcugccggccuggggagcgcccccagcacaggcgcgugcuucccugauggacacgucaccgccccgggcuccagaaaaugaaugugucugacccagugaccccuguccucacccaaggccaaccucaccccagaaugggcuggaaugccaagccugcccaugccggcuccagauccaccugccucccugccacugcuggccagagagagaggucaaagugguccggaaaccccaaggaaaaugaagcaguuccggggcagggaagcaaaggcagcguucacauuuuuuuuuuuuuugagacgaagucucgcucuugucgcccaggcuggagugcagugguacgaucuuggcucacugcaaccuccgccuccugaguucaagccauucucucacaucuaccucccgaguagcugcagccuccgccucuggggaucaagugauucuccugccucagccuccugccucaguagcugggauuacugacaccugccaccacaccggccuaauuuuuguauuuuuaguagagacaagcguucaccauguuggccgggcuggucucgaacuccugaccucaggcgauccgcccaccuuggccucccaaaguguugggauuacaggcgugagccaccgcgccuggccgggauggucugcuuauaauggcucaauuuugaugcccagucucugcagagcacaaggccccaccuuugggccggacauacagaugucccugggcaaacagagagaugaucccaaggcccuggccccaccugucugcucaguguugaaacagauuucugugaaaacaaauuacuaacaggcuggugucacauuuucaaauucugucaccagcccuugaacacaugucuuuguacuuuuuuccauuuuuaaccggggcugaguuacgcccaaccacacuguccuggcuggcacgggggaggaggugucagcugcuguccagaauggggcugacacauucauuuuaaacaggccaggaagaugcagauuuggcaagcucugaaauuugccaacaucccaaguccaggguaagcaggagaacuggaaaagggcagcuucucauguggucagguucuccugacacaagcguccugguggauuuggguuucccaaggguccugacuccaggagacccccagggcugacaggaagggccaccgcucccucugaaacucugaaaccaggccacccggugcugaaaugcugugugaacuccggcaaguuccuuugcagggacugagccucccuuuccuguuuccaacagacuggaacaacugccuccugcugcaugggcgaaauaccucgcggacgugucuuacggcgccccaugaaagcaucaccauuaaucugaccagucaccgcagcaugaguaucuucagggcacagaugaagccgugggcaccagugauaaggaguugccacugcuggcuaagugcggagccucacacaucugugguccggaaacccacgccccacuccaaacccucuacagcuccaacaguuaugcuaacaagaaaaaggagugaaaacccgcuccagucacgguauuguggagguggaaggacacuuguggcagccaauccaacaccuccauuuuauagccgggguaaacguaguucagagagguugucccacuuggugaaagucacacagcaguuccugggcggcaaagugaggacauccaggucuccuaaaucucacccucgugcucuggccacuugacugggauuuucaaucccggcugucaaagagaagcaccaaguccacuugggcuccuggccagcguccaagccaguccaacucaacagcaagcggaagcaaauaccacacaaugaacucguugaacagacucugcgcucaggcuuaaccagugcacagccuguacacccgacaggaggaugcagcuguuccaagcuaaggccagggccucuccccaaucccgaugggcucugcagaugcagugauggaagaaucccuggugacggggagcccuuagcucugagcaggaccugaagccaucucagggcuugcaccggcccagaugcugcugcacaagugcuccaggggcuccugcccugcccuccucaccugcccccucaccugucagggauguuugauuccuggcuggccccuccccuaccugaccccugccaaagacccacgucaccccaggcuuccagcucugaagcaaacgaccagagaagucaagcgccuggcuccgggccacacagcuugagggacucagagcuccagggacagugcccgggcccugcucaggccuucugcagaggcccugggcucuuccaguugacucagcucacaaggccccuacacgguagcaggugaagacagggccccaagaacccucaggcucugaagccacacaugagagccguggacagaauccugcauuggccuccagcagcucgagagcacagggacaaagcuggacuggccccggggucaccauggccuugguuuuguagcagcugcaguuugagcacguacaccaaaaauaaaauucuaagccccguaacugacuaaagggaccccuccuauugccaaagggauauuccaaaguuaaccugaaaaacgagcucaggucacgaugggaagagggggucacacaggccuuguuauacccccucccucuggaauucagguacagcggaccagcacuaacacucaaacacagaucuuggccuggcucaguggcucaugccuguaaucccagcacuuugggaggcugaggugggcagaucacgaggucaggaguucgagaccagcccgaccaacauggagaaaccccaucucuacuaaaaauacaaaauuagccaggcaugguggcggcaggcaccugcaaucccagcuacuugcgaggcugaggcaggagaaucgcuugaaccggguugcagugagcugagaucaugccacugcacuccagccugggugacaaaaacaaaacaaaacaaaacaaaacaaaacacaauauucgucuccacaaccuccugucuuacccagauacuccuuucuauugauaccaggucuuuagcuaauaacucuuucaaccaauugugaaucagaaaaucuuuugccaggcacgguggcucacaccuguaaucccagcacuuugggaagccaaggugggcggaucaccugagaucaagaguucgaaaccagccugaccaacauggugaaacccccgucucuacuaaaaacacaaaauuagcugggcaugguggugcaugccuguagucccagcuacucgggaagcuaaggcaggagaaucacuugaacccaggaggcggagguugcagugaacugagaucauaccacugcacuccagcccgaguaacaaaagcaucucaaaaaaaaaaaaaaauacacacacacacacacacacacacacacacacacacacacacacacacacacacacacauauauauauaaagaaaaaggaaaucuucgaacccaccugugaccaggaagcccauccccgccuuggaguugucccgccuuucucggcagaaccaacaaauaccuuucauguacugacugaugucugccuguaacuucuguccuuguaggagguaugaacuccagcuguggcccacccccuggggcacauguccucagggccuccaggccuugguccucacauuugacuccggauaaaucucuucaaacauuuuacagagucuggcuuucucguuaacaagcagcucacacauacagugucucaguagugacagaugcuggcccaccccgaggucaggaugacucagcagggaucgaguuugcgggcgucacgcuccaaggcccagaauaggaggucggugcucauuccucacguagugggcaaauccuagggcaggggaggggcgggcaaugccagagaacgguccccaccugggguggucugacggccagggaugcagggagagacgccucccacacucccggaggcacgcacgugcuguggccaccccggaggguccgccuuccagagggagaauucaggauucggccaguaucagggaaggagacgcuguggggggcccuccuguuggaaaagggcagcagcgggaagagggugcugccacagggccucuggggagcgugcgggcacacaguaccaaucugcaugcauacacguguccugucccugcagacgggccaggcaaggccugcccauggccagcuauccaggugaugcuccagggagggccaggccuacuggggggcagaacccuguggcuguccaggguaccuggaugugagucugggaaggauggagaaggguggaggagcgcaaagggccccuaggggaugcuggggaacacagaugagccucugacccaccuguguccuuaccugggccgacugggccacccagucuugcugacugacaccuccccagaccccuggcacccaccagacuccccaggcguggcuuugugcuccccuaugccugaugacaaaugguggccucaguguagaggugggcacuguggccccuggcuccuggcucgcuccugccucaguuuccccagcuguaaauuggggauuaucacuggcuucaaaggcuggagugcaaagugguggccaagagguggccaagaggugccaagaggugguccaagagugugcccuaccuuggacaccccucuccuggggguggcucucaaccuggccugggcccccgggggucugcgcaacccacccuucugugugaaggcggcugauacacauuucugggcaagauucugcacauucugcuggauuaugaaagaggucugugacccaagaaaaaagggucacaagugcccguuaggcucuccuguguggcucaggucaugugcuucugugagcucccccuacggccuugccccgaaucccgugaugcagcgugaccugccuaggugccggcggcacuuucaugugcggcugggaaagucagauuucagcacuaaucacuggcugccgccugcaaugagcccacggcuugagcucuggggcccacccagcuccuuaaacacgcagaaccuuugccagcugagccaggaucccagcugugggggguuggggguggaggggugcagggaucccaaaacccaacccggggccagguuuuacacaggccuggacugagaaguggggcuacaggcuacaggugcuugauaccccaggggggcccuggaacaggccuggacugagaagcggggcuacagguuacaggugcuggauaccccagcgguuggggggguggugcuggacacccagggggcagauagaggcagccaggcagccugaagacccuggggcaaaacacacacaggcccccucugcucucuggucacugcuaacuggccaacuggccuuugaguccacugaccacagcuaagcccacagccaucaaaacccaccccuuacacccuucacccuuuagggaggggcucagagacaguuguggcgauuccuacuuccacccauagccccccgacccugggccugugccgagcgugggugggugacaucaucucgcacccagagcuccagacuaaaggaaacccuggcuccugucucuggcucuucccucccucucuuuguucccuugcuccuuccuucuuuugccagaggagaagacagugaggcugagggcugcuccaugugcacagugagcaggagauacaggcacguggagggacggucacagcccgugcaacuggcaccuucacacgcagaggccugggauucccagacaccuggcgcuggggccaaucccauuccacagucagaaacaggcucggcggggccagguggauuucucaaagccuugguugcuuuuggccugaugcuagcuggacagugucucagcucacagguuccuaaacgcauacccgcccacaccaaucugcugaggagugacagccauggggaggagagccaccucacuccagggacccuggcaccgucucccaugaggccagguguccucagccacccgcagccagagucccgcgagaccgacggacggccugccccugcgugacggcacgccugggacugucucagcagccccccaugcuucacccaacugggacagggaaacaggagggggcuacuucugcuuucaaggcauggaggagcugucugcaggccacuucccgaacaccuaugcgcuuggagaagugacugagacugagccaggguaucuucuccacgaugcagugagcccaucgggcccuucuucugagagcaccucccuggagguggaagccccugaggcccacagcaucuucugaaccugugaguucccacuuacugagaacucgccuggaucagugccgggccacaguggaccgggacuuugaguggaugcuacccuacucgcuaugcagagccagcuggggcccagggaggucagauaaacugcccaaaccaaauccaggcccagccagaaucucagcuccagccuuugcgccuucugauaaaacccagcaucgcuugaauuuccaguacacgcugccaagucuucguuaagcaauaaauaaccacacaacccuacugucaugccaaguuccauauggccauccagaaagagacacauggagcugguuccucucaccuuuaugaccagugaaaagcgcaccaacacgaagacacgcgugaaaggaccucaucuccuacccagacugacaagcaagggauuuuuuucacucaccgucagugggaugguucuaagcaccgaggccaacccauuucacacgauuauuucacaaaaagaaaccuucugugggacgugccugggcgacugaaaagacagccagcaaaacugagaaccuuguucucaaaucuauacccucucccaaggcagccucagaggcccgagggcugaggauccagacccgaaagccacuguaccuucuguaggaucaggcucaaggaauaaggggguaaaaggugcccuuucccuuccuaagcagaaaauuccagaacccaaccuuaugugugaucauuuaaaaauauauauauauauauauauaucagccgaguaggcugacucacgccuguaaucccagcacuuugggaggccgaggugggcggaucaccugaggucaggaguucgagaccagccuggccaacguggagaaacccugucucuacuaaaaaauacaaaaucagccaggcaugguggugcaugccuguaaucccagcuacucgggaggcugaggcaggacagucgcuugaacccaggaggcagagguugcagugagccgagaucgugccauugcacuccagccuggacaaaaagagcgaaacuccaccucaaaauaaauaaauaaauaaauaauaaauaaguaaaauaaaucacuuucuauggcuuuucacugcuccaggagcaauguccacagaucaaacgcccggccucuccuucacacccuggagcgcccauccugcccacugguccgggcuccaggcugcccccugcaccugucagaagccccccuauaagggcagggucucccuucccgggacauccacugcccuucuccgagcugaagucagaaugaccugagaaucagcuuggaguucuaccagccucagcaaagcccaccucugcgacagcacuccuugcagaccccugacccggugacagaugaauaaaguacagacacacagauauucugcucugccaguccagcugagggucccagccgcuuauaggcucccugcugaguccuguaaacaguugcuacuuggcccugaucagcuagucagacgugcauuuauucaguaugauuaacuaacaaaagcuugagucaacaccauuagaauguaacagacauuguggacuucccaaguaaaaagcacuuaaacacccacggucuuaagauuaugcgaguaaacaagcuagcuagguaaacuacgcugccuuucuuuuaucacuauuuuuauuuguuuaauuaaagguaaagggaucaggccgccuucagccagagcuaauuaccgaaguuaugccaacuucucggccuuccaagauuugugucuauuucuauaacuaucucuaauaucuuucccaccagaaugauugaaccccaacacaccucccucucucagcagggucugccuguucagagaacacagcuucucuuucuugccuuacacacaggggcaagaauagauucacucuugcagagaguacaucccuuucuguuacugaaaaucacuuuccaaaaaaaaaagcaacacauacacacauacucaccacacacacaggugggucagagaaaaaaaacaaguacaaauggcuuagggacaugagaaguguggcccuaacuuucgcugaaagggacccuauuaacauuaacccucaccucugggucagagaggguuggcacucuagggccugccuugaagcuuuaccuacugggaccaaaaggacugcuuggaaagcuauuuuaggccaggugugguggcucaagccuguaaucccagcacuuugggaggcagaggcggguggaucaccugaggucaggaguucaagacaagccuggccaacauggugaagccccgucucugcuaaaaauacaaaaaauuagcugggcauggugggcaccuguagucccagcuacucgggaggcugaggcaggagagucgcuugaacccgggaugcggagguuguagugagccaagaucgugccauuguacuccagccuggguaagagcaaaacuccaucucaaagauaaaauaaaauaaaaauaaauuuaaaaaauacuuuuuaaagcccuauuaccacaaaauaaauccaggaacgcgugacuugguacagccucuuuggaaggcacauuagcuauuacauuagaauccacaccccgccgggugcgauggcucaugccuguaaucccagcaaauugggaggcugaggcacaugccuguaaucuaagcuccggagguugaggcaggagaaucguuuaaacccaggaagcagagguugcagugagcaacgagccugggcaacagacacagacucugucucaaaacaaaaucaaaaacaaaaagcaaaaaaccacauacccuuuucccauuugcacaaagcugggaaaccccaaaugcccuccacaggguucuaugggggggcgggggugcggugagcacacuuguuccugccgacacagggaagucuucuuagcagcuaaagagggcagccucugcguacugccugggaacauggcaaaaccauuuuaggcuuuaaaaaaaagguggagaacaaguuguacauuaugaucuuuuaaauaaauaggccagcgauauauuuguaacagaagcagcuccggaagcauacacugucagccgcagaaacucugggggucgggggugguaaaggaggagaaaugugucacccaggcaggagcucaguggcaccaugcuugguucaagcaguucuccugccucagccuccgaguagcugggacuacaggugugcgccaugacgcccagcugauuuuugcuuuuuuuuugagauggaguuucgccuuguugcccaggcuggagugcaguggugcgaucucagcucacugcaaccuccaccuccuggguucuagugauucuccugccucagccucccgaguagcugggauuacaggcaucugccaccacacccagcuaauuuuuuguauuuuuaguagagaugggguuucaccauguuggccaggcuggucucgaacuccugacuucaggugauccgccugccucggccucccaagugcugggauuacaggugugagccacagugccuggcugguuugaauuuuuaaaugaugaugaauucauguaugacugaugugauuuuuauuagaaagagaaaacuaggcagcgccccauccuacgucuccuuccugguggccaaugaagcauuucccacgacucacuccuggcaccagcaggaagucagagacucagcacccaggggcugcuuuuuuuuuuuugagacaggcuugcucugucacccagacuggagugcaguggcgggaucucaacucacugcaaccuccacaucccggagcaugccucagacucauaagcagcugggauuacaggcgugagccacucugcccggcuaauuuuuguauuuuuaguagagaugggguuucaccauguuggucaggcuggucucgaacuccugaccucgguagauccgcccgucucggccucccaaagugcugggauuauaggcgugggccaucacacccagccaaccagggguucauuuuuuaaagauaagagugcaggcugcguaagcuacuauccaugucguuacauaccgggccgacauguaccuaggcgggagggagacugaaccagugaaauucuaaugacaaaaaaagaaaucagagucauccccuacauucacaucuccaacgcccagcuggaaggcacaggcucuccccacugcuguccugcuacgauuuuucccggcuuugaccugcaugguggugcggcugcucgacucagagccucagagaaaccacacagagcccugcugagucuugcccucggggcauucucacauuuaugaagaaaugccucccccucccccucccccccaaaguacgguguggcagaaaacagcgccaacagguccugccagucagaagccacuccccugauuucauggcucaagaccccaacuauaaauuagcccuucccaccuugaauguguacacacacuauugagaugcaggccgauccaugccaugggaugaaucugagaauugccaagacccaccuucccacgccacccaaccaaaucauguggcaucugcuacaagugauuuucccccugaaaucccacaagaaaacuauuuugaggccgggcacgguggcucacgccuguaaucccagcacuuugggaggccgaggcgggcggaucacaaggucaggagaucgagaccauccuggcuaacacggugaaacgccgucucuacuaaaaauacaaaaaaaauuacccgggcguaguggcgggcaccuguagucccagcuacucgggaggcugagccaggagaauggcaugaaccugggaggcgggcuugcggugagccgagaucgugccacuguacuccagccugggcgacugagcgggacucagugucaaaaaaaaaaaaaaaaaagaaagaaaaagaaaaagaaaacuauuuugaaaagcaguuaucucuggccuggugaagaacacaccagcaccaugcccaccaaaacaggagccccauggcuguuucccagagaaaccugggacccgcacguccauucacugcaacacagacugaaucugcagccaagcuccgcucucucacuacugggaacccucaggggggaucccuuagccuaaaucagcaccagucacuacccgcacacgauguuauuacuacuguuuucuuaugagucagcccgugucacugauuccugacgagcugguguggagagcagaaaugaaugauuuuuuuuuuaacugcaauuuccuucucaccaaccagucagcaaucggagcucuaacaguaaaccgauugcucaguuacuccacgugggugccacgcaagaggcugggaguauugcucagcggggccaacgggaggguggcacuugccuaaaccgcuuaagugggggaauggaaugcccaccgaagggcagggcagggacccugcugucccgucacugaagauauucccagccuguggggagaaguguaaaagaaugaaugaaagaaacgcacgugguuucugggaccaaugaccuuagccuagaacugccgggaugguccaggaacguaaagauguagagaugugggagccaggggcguagugaugcaaggaugcagggacccagagacuacgaccucccaacccccggcccgcgccccguacucacgcacgcagaggcaggccacgagcuuggcugccuccucgggcaccgggcagguggggaagagcggcuugagcagguagguggcgaagaccagggccacgauguacugcgaugaaggccggaugaugagcagcucgauccagagcuugaggaaggcgggcagcgagccguagaccuccagcauguaggcguagucgccgcccgauuuggagaugguggugccgagcuccgcguagcagagcgcgcccacgauggagaagacgccgcacgcggcccacaccaccagcgccagccccggcgagccugccuccuugagcacgcccgugggcgucacgaagaugcccgagccgauaaugguccccacgaugauggccacgccguugagcagcgugauguuccgcugcagggucacgcccucgcccucgccugccggcgccgagccguccgcgcucuuggcggccagcaucuucucccgcgccucuuccuucuccucggccgccggcgccgcuagcgcgcgccgcuucgggcccgcacccgccaugcucugcgcaccggccgggccugggacacccgggagccgcggcccagcgagcagugugcgcgccgcccgccg

SEQ ID NO: 191986 - RNA, 61584 nt, Homo sapiens
ugcuuaucaaaauauuuuauuuuaggagaccccucaaaaaaagacccaccacauuagacagacgccccaacaacacccuuggccuuuuuuuggucuuuucuguauuuuuuccuuuuuaaaucaacuaaaacaauuugaugcuuaaaauaaaagacaggaaauauuuccugaugagacuuuagucgagaauauagauauauuucugauccgggggcgggugaucaggggcgggggaggagaaggaugugccaccagugguucgcgagguuccguuucucagcucaggagggagccuggcugccuggacccgggcuagggacccagagcuggggcuccacaggccugaccagggccagggaagaagacggaggaggaggaagagaaggcggggcuggcggcuggggcuuguaauuuacaugagaaccgugcuggucacuagcgcugucugugucugucuguccugcgggacuucugcucuggggagggaggcugggauucagcgucguugucauuuccuguguggcuucuuuuccagcugagaaacuuuuuuuucuuuuuuacuuuuuaaaaagaaucacagccaaaauaagacauuaacugcaaaauccaaaauggcugcgcuuacccuauguauaaaaaugcguccaguccggucggggcacggccuaugcuuucccggggaucuuggcccgcuugcgugcaauagcauccuccacggccuucagcuguuucagcagcuccucccgccgagacagcgugcuggccuucccugauuuggugcuggcggcgccgggauccgaggcuuugccgggcacgcucgugaccuugcuggagcucuuggacuggggugacagcuggcgcuuccuacaaggggguggggaagaccuugagcccccagaagccacgucugcagguggaaggggugaccuccccguaggggcgcuuccacuguguccucagcggccaccaggacaggcaaggggcucccuggauggccaggcucccacugccacaagcaggccugguccuagccacuggcucccgggcuuuguggagcagacugggaggguccugggcuggccccgcacaaccuccuguuauucuucccaccucugugcccagggaucuuuugcccaagggcaugcggagcagagggcacccuccagccucaaccagggcaggagcgugugugugugugugggggggggugggggguggggcugcaauucgcuguccaugccccucaccccgucagaccagcaggagcuguagugacgccuccagccuggcccagugcuagcccugcugcugcuggccucccuggggaagcgacuggggcuggcccccucggugugcccagggcacaugcugggugggacucaccugucagccggggcugcaggggcuuuggaguucuggccucucugccgcucuggcuucggggagcccagucucccaccugacuuccggucccgagaaccugggugauagguacagagugagaccacccuccugauguacagggaauggcuguguggguggccucaccgaugccagggacucacuucuaaagccugaggcugcuuaguucaccaccuucauuuuuauaaagaaauaaaaaggggagagccaaguaggagaagagagaugugggcaccaaggcaucuggaaaugaggcugaggccaaaccugggccccagguuccagcaagcagccaauaucucacgcagagagacaaaacuccuuccuagcuuugaagaaauuuaucacaugggucuucaaauacggaacaacaagaaagacauggcaguaaagaaauacaagcaaagccgagagacuaggaguguuucacucuggcaauguuaggagggaggcgcggcaaccgaggggggggccacugcccagcgcaggcccaaggcuggugcgagaacaaagguccgcaggaccccagaggcccugguuccaaccccaggcaagggcagcaaggcuguuccagaccagccacacagggcacaggcccugggcuuagggacaaaggugagcagcuuccucuuccuguguccgacaaacccagagaacugcuugggaaggggucuggaagcccccugccuguucucugugucugggagugucugugcggguggccaggcccccuuguccucuaucugguuugagcuccacccaucaaagccagccaggacaaucucccugucuuuccaucugggccccagcucuugggguguggucagcauggcuggggguccccgaggcccuuucaggucugugugguucaacaguaauauagacacuaucugccucgucacucaguccgcaggagccugggaggaucuccagaaggcacgaggcauguggguccagccgucuuccgucagccagacugaagagauuugcaaaaauggaaaaaccaaugccauuccugcucauuuguuuuggaaaauauauuuugcaaaaauggcacauguguaaaaaaaaauacaguugcucuuguugcccaagcugcagugcaauggugcaaucucagcucacugcaaccucugccucccagguucaagcgauucuccugccucagccucccaaguagcugggauuacagacgcacgccacuacgcccaacuaauuuuuuguauuuuuaguagaaacaggguuucaccauguuagccaggcuggucucaaacuccugaccucagaugaucugcccaccuuggccucccaaagugcugggauuacaggcaugagcuaccgcgcccggccuaauuuuuguauuuuuaguagagacaggguuuuaccagguuggccaggccggucuggaacuccugaccucaagugaucugccggccucagccucccaaagugcugggauuauaggcgugagccaccacgcccgguccuguuauuuuuaaacaaauauuuaaaaccuuuucuucguuuuaguuuucaacacccuaaauaccgacaggcaucaucugcaagucagauguucucuggacccuccuccuacuuguuaagagcaauggggucucagacccagcugcuccgcauccccaggcucccgucccucugcccugcccccuaggggcugggaggcucaccucggucuggggauguguugggccgcuuggcuggaggagggcucugccuguccuugucugaugguucauagcgcuuccugcuuccuuuaucagccgccugggacaagagagaggccagugaggacagcagggccaggagccagaagccguguccucgccccagaggacauggguuccuugccagcaaccugcucugcucccaaaggucccaccacacacccaugagaccccguagcccugagugaggccuccaggacccggaccaagggcacccccacugugcacuuggggcccuucacguuccaggggaagcacccugcaggccuuccugcuccccacgggggccacucuaggaggaccugggacccaugaagccaggccucuugcccuuccagcagaggacagggauguguccugcugaggacagaggacagggacggaggcuuccuguauuguguugagacugcauggcagggaauggcggccacaggcacgaagagaacgcccucucuguucagagagaggccagcagcacccaaaccuccccagaugcucacacuucccagcccaggccggaaagauggagucucgcuuuguuacccaggcugugcugacaccugcaaggccccacucgcccucacucaggcuccgucccccaggaggaagcugucucaggaagcagauggacccaggccuagacgcuggggcagccaccaggagggcccuugcccucaccuuauucaacagugucaacuugaucuccuugugggccacaaaugugcccugcuggggcugcccggggggugccugcuggggugucgagggcugcugggaggacuuccccccugcuggagguuuugcagauuugggugguuguguggacgaaucccuuuuccgcuuuuccucuuuaacaccgucuucuuucuuagauuuuccuaccaaugauaaauccgcagucauggggguacuggugauuuucccauggccacaccaacagccaggcaaagucugugcugaugccgcccuccucccccgggagcugcuccccaaagguaccagggcuccugaguaccuuucuccuuccuggucugggcuggggccggggaccgagagcuggcugaggacacggggcuagccaggucugcguacauguccuccgaguccacgcugugugcagagcugcugcucgacguagcacuggacacugaggagacgcugcucacgcucagggaccuggacacacaagcacaucucaccacaccccagccagacuggagggaggggccagcagggggugcuccaugguccacuuuuacgcaguguccauuuauggaucauguacccacggaaugugugauuuuggggggacacugggcaguuucaggguuacaaaguaagggacguccccauggcuaggccagggccccauuucacuaaucaaugucagguugcagccaggcacggcugcucacgccuguaaucccagcacucugggagacugagaugggcagaucucgucacgagcaauggggucugagacccagcugaacugaugucaggaguucgggaccagcuuggccaacaugguaaaaccccaucucuacuaaaaauacaaaaauuagccgggcguggucgcaggcgccuguaaucccagcuacuggggaggcugaggcaaaaaaaucgcuugaacccgggagguggagguugcagugagccgagaccaugccaucgcacuccagccugggcgacaagagugaaacuccgucucaaaacaaacaaaaaacaaaacgaaugucagguugcuuuuugggaagggaaacaggacugagcugacucaacagcggcaaggauggaauuuaagcagagucccuggcuuagacaaaagggagauagccucagcccacagggaaauuaaaaacacaaggagcaauuccgcagucucagggaaugccugaggaacacacggcagacagacuggaaacagcaggucuguagcuucacuggcgugcacucaacacggacacaaagcacacaggacuggcaccugagucugcccugcccauaugcugcucgagaaaacaccaaccacgucuuccagguacauuggguaccggagcaaggaacgggggaauguaagagaaccauuuuuuuuuuucaaaagucaggucuuuaaaacauuucagacuuauuaagaaacauuuaggccaggcgcgguggcucaugccuauaaucccacgaguuugggagaccacggugggaggaucacuugagcccaggaguuugagaccagccugggcaacacagcaagaccaugucucuccagaaacaaaacaaacaaaagaaacaaagaacugugacaaauauauaaacgaccugcugccuggaaaugaaagaguucuaugcaaggaaucuaaggacugauuuaauacuuucuuuuaaaacaacuaaauagcaaaaauccuuuuuuuuuguuuugagacaggaucucuguuguccaggcuggaaugcaaugucgugaucacagcucauucaaccuugaccucccaaguagcugggaucauaggcacacaccacuauacccagcuaauuaaaaaaaauuucugggcugggugcaguggcucacaccuguaaucccagcacuuugggaagccgaggcggauggaucaccugaggucaggaguucaagaucagaaacgugguaaaacccagucucuacuaaaaauacaaaauuaggcugcgugcggcggcucacgcauguaaucccagcacuuugggaggccaagguggguggaaugccugagcucaggaguuugagaccaaccugggcaacauggugaaaccccaucucuacuaaaauacagaaaauuagcugggcguggcagugugcgccuguagucucagcuacucagggggcugagguugaauccgggaggcggagguagcgagaucgcgccauugcacuccagccugggcaacaagaaugaaacugucucaaaaaaaaaaaaaaaaaaaaaaaucuuuuucuguggagauggggucuauguugcucaggcuggucaaguccugggcucaagcaauccuccugccuuggccucccacggugcugggaucacaggugugagccgccgcaccuggcccacaaagcuuuuccauguauucucuucucagauguuuuuaucggcuuccccacccccucaggccgguucccucgacaggugugauaggucacgcaggcccagccucugcccugcugggcuggaagcugccggcuccuccccaggugcaggugcucucucagggugcugggcaucaagucagcagggcagaggcaccuccuccugaccugagugcccccgaguuugugaaucuuuuuuugguggggggagggggucuuccuaucacgaguccuggcccauuuucuccugugucaaagcuucaaccgcagccuuccacagccccagggugacucagauccagaagggccccagcccaccugugggagacagcccaacccacacuggcugcuucugggacuuccuggccccgacggggagggagaaacagaggcacagggugauggggaugaccuggaucgggagcuggaaccacuauagcugcuaccacugccacugccgcugccgcuuagcguccgccuguaauacaagcaacagcggggcucagggggcguggccuccacagccccucgcggccuccccuccccaccagcagcccugugaggugagccuccagacuggccuugcuaccaccuuggaacagggccugggccugucuuccuuuaggcucaguguuuugucaagauaaaaaguacagucucucgggggcagcaccuuccagugcagacggggccauggcgggaaggccugugcuccgugccacgcugucccuuccccuucacgcuccagaaacacaggcucagggaggggacagggcagguucccggguaagggcucacugggugcugcucggcuagggggcgcuucccaccaccuggcucuggacccuggcacucuggauuuccagcagugccagcaucacaguggcaccaagaacacggaaagccugagggccccggacgccggagugcucaccuccugggggggguccuggcuggccgcuccuuccuccuggcuucccgagggucuccuggcuuggugggcucggggacaggagcagugguuuugguggccugugguggggcuggaggcggggccggcuucuucacugacuucucucugugagacagggaggcucgagcagggcagggcugguggacggggccccgcuggccuacauccccuuucaauggacccacagcucggggaacgacacugcaugccugugacgcucggugagcacgcucgugccuggacacggcuccccacccaucggugucagagugcuugggaacggcuucaaagcccccagcagcccuuccaggcuccccucuaacaggcaagagcuacaggcaccgccaggcaguggggagagcaggcuaauaggaagaccccuuaagaacacccggcugcugccguguccccagggcugugcucuguccccaggguucccgagggagugcugcuguguaaggguggcccgugagaacaggagcugugcccagugccucccagcccagucacccccuggggccagcccccugaggcauccucaccucuuuggucccaaacacaaaugagagauagagacggagggaggaggcugcagccuguggaggccuggccggccaggacuugcccacaggcugggcacucacccugcuuucccgggcggcggggccggcucucccuugguucugauggaaggucuauguggggaagguguuggggacggggacggggacgaagagaaggaccgggaccuaggggagugaacaaaggugucggaaggggccuggggguguuucuucaccagcccaagcccacugaggacccacccagacccauggagaaggccacgaauuuccauuuaugugccucaguuuuaacuucaguucuggacuguucugucaucugcuaaaaacacaggcccagaguagaccagagagcguggaaggugucagcauccacuggcggguccuccgggaggcgagugucacguucaugugugugcaggacaggaggagacaggcuccuuggcaguggggcagcagcacagcucccauagaaacacccacaggacagggcugggucuggccccuuccucggccugucugcggaggacuggagugccucaacucgaggaucucaggcuguggcccucagugacagcacgcaucuacacaaggacgagggcccgcaaggcugguguuuggugggggacacaggacacgacccccuggccauccuaguucagcugccagcagggaccuucaauaccccaaggggcuacuggcgccacaacuaaagccacauccgcaggugcccuugcucacugcaccugcugagggcccuucaugggcccuggggacauaccuggaccggcuuccugagaacgagcugugucuggaagagcggcuggaguaggagcuguaggaugaagaccgggaucgcgaccgggaggagccggagccagaguaggacgaugaccgcgaagacgaccuggggcgggcgggacggagcguggcgagaagugagaagggcccucccugccccacacgcccugacgcacacaugcacagcuacacacccacagacgcacagcuacacacaagcgcacagcugcgcacgcgcgcacagcugcagacgcgcgcacagacgcauacagccucccccagacacucuucagugccaucccuccuuggugcagaacggcauuuagaaaucaagaccugggcguggggugugccugcuguuaccggguggcgcugccugagugggcagacccagcucacguggguccgugugugugucuaucuguucaucugcauccacuuucagugaagccuggccucccacccacaccuccuguuccugccgagcaugauggggucuaccccggcccccugcuuuccaucaucccucacucgggagccgggcuccugugugcugagaccaggaccguagguggaggggcaacaguuucagguccagucuggaggaacagauggacucacugggccccaggucugugcguccucccgcauccaggugccccucccuccaguguggccugugacucccugggagcagucaggcucagucgccggggucugugccccauuuggggucacugcgucaguccuacuuggcauugaugcucuuugcugaagguauaaacgccggguuagucccacugacuggucugcagguaacgacgccacagcaaacaguggggcugggguguuccccaccugacccagugagguacauggugucagcugacggcuccaaggugcugacaccccagccgucccacgagcccuccuuaccuggaggaauuagaggcagaggcugacgaggcugauguuuuccgacgccuucgagcccggcucggggagaccgacaccccgaguuucuucuugggagacuuggaucggcgccaaggguccuuccacucaucugcucucuucaccugcggccccgugguggcagccuccuucuuugguggcucagcuuggcggcugaaauuacagaggcauuagcaacucucaggccaccuuccgcuucacagcaaugccaggugugacagcagcgggagagacuauggaucucauaccuggcuuauuuaaggaucaccugagaaacaaaggguccuaaggggaaaaaaggccacucacaaaacccaucaccccauggacuugggugauguccauggcccuuggcucagugucuguuacucaggggaacacccagauuucuccugaaccagaauggcaguuacuuucugugagugucauuacuuacuuaauuuccaucuuuccaacuacgcugucagcucuaggagggacagggauggugucugccgugucuaauacuaucucuagugcugauauacuaguagguucauaauaaauauuuaugaaauaagcccagguaugguggcacacgccugcaaucccagcacuuugcgaggacgaggcggguggauuacuugaggucgggaguuccagaucagccuggccaauauggugaaaccugucucuauuaaaaauacaaaaauuaggcugggcgcgauggcucaugccuguaaucccagcacuuugggaggcugaggugggcggaucaugaggucaggaguucgagaccagccuggccaacauggugaaacuccaugucuacuaagaauacaaaaauuaggccggcugcgguggcucaccuguaaucccagcacuuugggaggccgaggcgggcgaaucacgaggucaagagaucgagaccauccuggcuaacauggugaaaccccaucucuacuaaaaauauauaaaauuagccaggcgugguggcaggcgccuguagucccagcuacuuggggggcugaggcagaagaauggcgugaacccgggagguggagcuugcagugagccgagaucgcgccauugcacuccagccugggcgacagagcgagacucugucucaaaaaaaaaaaaauaaaaacaaaaacaaaaauuaguuggaugugguggcgggcgccuguaaucccagcuacuugggaagcugaggcaggagaauugcuugaaacugggaggcggagguuguagugagcugagacugcgccacugcccuccaaucugggcgacagagcaagacuucgucucaaaacaaaacaaaacaaaaaacaaaaaaauuagcugggugugguaacacgugccuguaaucccagcuacuggggagccugagggcaggagaaugguuugaacccaggaggcagagauugcagugagcugagacugcgccacugcacuccaaacugggcaacagagugagacuccauuauaaaaaacaaacaaaaaaacccaaacacaaaugauauuaaacugaccccuuauauauaaaucuuuaucugacuuuuuaaaggguaaacuccugagcaauggaauuaaugggucaaaggagauacacauuuuacagguucuugguggguuaucagauauuuuuuccucauucagccagcagugugcggugccgaaccugggcucggugucaccacuaagaaccacaaccaccacccagacacaaacuaacccaaaauccuggcaauuguauaagcagaacguggcuuuuuuuuuuuuuuucuuuuuuagagacagggucuugcucuguuacccaugugggcuggagugugguggcauaaucacugcagccuugagcuuccaggcugaagggauccucccaccucagccucuugaguagccaggacugcaggugugcaccaccacacccaggucauuaaacauugauuugaggucucccuauguugcccaggcuggucucgaauuucuggccucaagugauccucccacccuggccucccagagugcugggguuauaagcuugagccgccaugccuggccugcaaacacauuuuaaaaagcuguuuuaguuccuguguuacugugagugggauucucugcccuacgucuugcucaccucuggcucugcugugguagcaucugcuuacgucacacgacaacacaugaaaccaccaaaaccaucaauguuuauguuuucagagcuuguuuaaccaaccggcuggcaaacaugccugcuaucugcugagaaugcaggaugggggcagcuccccacuuaacacuguccuaaggacacggacacgcgacaucacagcuucagcuccuguacgucagcccaaaaccccaagagcuauugccacaucugggugucuccuggaaaaguaauccaggaaggaaguaaacaccugucugaugauccucccugucacaggcuacuagagagcuacuuucaccuuuauacuuccuguauaacucucauccuaacaccccaagaggaaagggagcaccaauaagucacagggacagcgcggcccuuccaacacagggagagggaacgggcagaagucaaggcguggucaggaccaccucuucuucgggugaagcuguaacagcauguggaguccuagcugcggugagggggaaggaaaaacagcgucugcuugcccccugccacggcauggaaauaaaaccagcugagguccagagaggcgggcagugcaggccuccacaaucucagggcagcuggugcuugccccccagaaagagcugcucauucccucuggagacaaugauaccgaauuucaaaaugaagauggccagaggcaggcccagcaggggucagugaggucucuccuucucugggccagggcuguggacgggccugcaccaucucgucacugcacagcgcgcccuccgcugccgccggccgcaccaccuuccuucugaagcagcugcuuccaggcccauggagcaaggagguccuauccagcaaguccauguuaccacgugugggacguggugguacugauuuuaaccaggaugcagauaaccauuuuuuuccuuuuuucuuuuuuuugagacagagccucgcucuguugcccaggcuggaguacgguggugcgaucuuggcucacugcaagcucugccucaugccauucuccugccucagccucccauuggacauuaucuccacugcacuuugauagcgagucuccgggcaccaagucugcggcagaaagcaaggcugagcacuggcuuucuacagcccagggaaccgaggcaugugcccuucucucagcaaagaaugucaccccaggggacauccugauuagacuuggaaaaaccaggcagauacaaaauaaacaaaaccaaaacacacaacaugggugccccaggacagcccaccgagugcggcucagcuccuucacaaguaggggccugcgcagagggagccagugugggcugagaacgcucgcaagggauggcccagucaggaaggcccaccuccaagcugggccaggacagaucuggaauuugcaugaacacuuccaaccgcaggggagaacccuccagaugaccucugacugaggaaguagccuuucccgcagcacaaggcccgcgcuaucaucuggcccccauuccccguugaaggccacaggagacucucuaaggggcaaaggucagcuccaccaccaaugcaaacaugccagaggcagacaaaaccaagggcccgaggcuggcacacucauagcucaugccucaccgaugccagcagccacacgaggcgccacagaugccaggcugcuacaggccacguguccagaaacuccaaccccagcagcugucaaguuuggggucaaaggugaaaaaggauaaaaacgcaugaagguucuuucuucaaucaaaagagcuaagcaucuacaucaacaagggaaaagggagaugggagccuaugggccuccccgggcugagccugcucagaggcagcucugggagcaccuccacagcaaagcuucucuccuggcuuguucugugagugccuguggagcauuuagcuacgggccacaugcucuccccaccucccuuaaaacguaacagaaaaagcccaaagcagaccuggagugcccgccccaugucuuuacacuuugcaaaaaaaaaaaaaaguggaguccaauggacgaccugaguggccgucaccuucucugugacuugugcagaaggccaggcggccucacucacaccugcaagagccagucucagcgcagagcagauacaaacaccagcaacugcgccuucugugcguucaacugcacaugaaaaucccuaacuccacuagucccuuacccagaaggcuggucuaaaauaggguuucuuaaccuuucuaggggagucacaaaucccucugaagaagacuguguagccuggcccacucccagcagagaucuugagacuccuggggugccucaaacuggcagaugagagggcucagcccaaaaaacugagcaugaagcgguggcccaggaagcaggcgcccacuggaugggccgccaaaggggugcggacucugcgguguccggaacuuaccagggaagagugagaaugaagagcccggggugaguaggugcuggggggcgagugcuuccagucucagggguccaccccacaaccccaccgcaggagccugccaagcucaagcccugaaggggcacccaaagcugcaaagguaaaccuggaaguugaauagcuuggagacagcaggcagcccagacagcuccugcgggaagguccccaaucaguguuuacauuucuaaugacaaugacuagccaaagagcaucguaaugacgugccucggcggugagcacacccaucggccuagcuauaaagauuagguuucacauaagggaccgcccccuuagcucuacagaugcauuugauagaauugauugaaagguucugcucuaaucauuuuaaaacagcccagguggaggaguggguaagccucaaaaggcaaacuaggacggagagagcggcacaacuccgucuccagccgcagguccaggggggagcuggucaagaagcccugccagagauaccgauggggaugagaucccgacggggacaagcuagccaguaacucccagagccaaacagcuuaggcaguaagagagaaccucaggaaagagggguauuagcuuagagauaaggaaaagaaauggcucccccauggacagagggcuggccaucagauagcucagggcaguguuuccuauuggggcucagcauuauccuucccgggggaggcccucaacucuacccaggacacccauggcacccaaacaguggccgacucucgcuccucccgcugcacgacugugcccccucucgugaagcuugggguggugaagugccugcuauaacgagccugggccgcgcuucagaccaaacaaaagugacugcgcuucacuaggguguagcccccaugcaaggccuagcccuggugcagccgugcuggacacugcagagccccucauucguguucugcuugguagcugaaggcagaaucuucccaaauggaucucccuggguaaaacugugucauuuucuuccaguuuaggugagaaaaguucuuucuauccaccuaaugauuacaaacucccaaccugccaaagacccacccauucaauacguguauuacugcaaagggaauucagcugcuccugaaaaggcagccaggccaguucuggcugauaagggagaaggaagcaggagcacuggcuggaaauucugcgcuggggaaacccuuguccuccaggcagguagcgggccuggcagggcucccgcaaaggugagugaagccaagaccggggacuccccagcacccggaagccggcugaaugaauccaggcaagcgacgcagagaacgucagcccugcugcuggcagcuccgagaaggggcugagggcagccccaggagcacaagcaagugcuucaggaaggaaagaaagggacgugagccucgcagaagggaaaugaaccaggucagaaacaggugggaagagcggcucggcccaguuuggugagagcagcuguguuugauuuuaagaaaaacucauuuaguacagaguuuccugaacccuagcugugagcccagaucaggccagacaacgucugagcaccucccagucccuuccugaauguaagacuccucugugaagcugagggcucaggggcuggcgauggcaaccugcugccugguggccaugcuggcagaguuacccucuccaagccuccugggauccgucacccgcuuuccucuggggaggcugagcacacaggagacgggcacagcagucgggaaucugcccucccauuccgcgggucacuaaagugcgggccacagcagaggaacacagcaaccuuaggcauggcggcccucuaacgcguacuccagaaguacauucuuguacacagaaaacaucccugaguuggaauuacagacuccugacugggaagagcccccggcugcuuagaaacaggcagaauacaugacuaggggcuggggaagggggucuguggccaggcacgugugcccauaagccaccaaaguggacaugcugacggacucauaaacccagagccacacagcacagugaccuuccacguggauaucacugccuuucuaugucucugcuucuaaaaccaaugaucuggguggcgugaaaaccccuauuuugugaaucuggaaagcagacucagcugguucuguuuguagaaaucaaugugcaauuuuagcaacccuguaacaaucaauuaugacaugcagguaaaaaugcaggcugauaccaaauccaaaacucacggacagcacccccaaauguggguaagcaccaaccugugcgggacucugggacaggcacagaggcugcaacggggagcagggcagacgguggugccccaggaccaucugcugcaagggcuccagaugggcacugagggccaugaggaacaagaaagcaggcuggcaagcaggaggggauggggagacuucccugugcagaggaaucugagcaaaacccuggaggagguagaggcagcccguccgggcagagggaacggaggaggugggggcagccugucaaaggcagagggaacggaggaggugggggcagccugucaaaggcagagggaauggaggaggugggggcagcccguccaggcagagggaacggagcaggugggggcagcccguccaggcagagggaacggagcaggugggggcagcccguccaggcagagggaacggagcaggugggggcagccugucaaacgcagagggaauggaggaggugggggcagcccaucugggcagagggaacaggagguggggcagcccguccaggcagacggaauggaggaaaugggggcagcccaucugggcagagggagcggcugggggugugugcacggggugcugggcugcaccuuugcaguggggucucaggggagaaggcagccuuaggcugagugcacacugaaaauacugugugugcuguaggggaagggcuucuauccaaaagggcuugaaaggcugaagaaggcggcacaaugucaaggucaaugacgguuuccccguuuggaugaccauguaaacuucaaaauaacuuagagauuacuguaacauaaaaggauuaaaaacaucugaaauaugucacuuauucugaauguucuuuaagaagauuacuuugccuaguguuaggaaaguaugacaaauacagcacauuuagggaaguccauucacugugagcuggagaaugaaaacagucaaaacuggcacuugccaccggcuaagcagcagcuacagccaugagugacccugaaacaaaggccugcgaaguccugccugagagcugacuuucagaaaagcguagaugacuuguguuccacuguacacaagagcgggugucguccagccacacggacaagaugaggaggacaaggggcuuguuuuugucccgugguggaaagcaaauccuuccagagccacagucgcagguccugauggcugccaggucucugaggggagcaugagaacuguggccccuccaaguguggccacuguguggcuccagccacgaagcugcccaugccugcaggucuagcggaguccaguguuacuggaagguguaggcccaaauguggauuuuuaugagagccaagucaaacaacaucccugaguuggaaguacagacuccugacugggaaguccugcaggccauggcccuggaaggaucucgggcuguuucccaauaaggaacugccuugaucccuccuugcauuucacccccacggggacggugacacaaaccaacccugagacggagcaacguucaugcucucaucgacacccccccuuuuuuugagacagggucucucucugucacccagccuggaucaaagaccuauguguaagagcuaaaacuaugaaacucuuagaagagaacacggcaguaaaucuuuaugacccuguauuagucaaugguaucuuacaugacaccaaaaccauaagcaacaaaauagaaaacauuaauuggaacugcacaucaugaaccugauaagggacuuguaucuggaauacauaaaggacucuuaccacucaauaauaaaaaacaaaaaaugagcaaaggaucugaauaggcguuucuccaaagaagauauacaaaugguugauaagcacagaagaagaugcucucauuaucauccaucaucagagaaauacaaaucgcaacggcagggagacgucacacccaccaagacggcugucaucaacaagacggaccgcagcaagugcagacaaggaugcagagagauggcgcccuccuaugcggcuagcgggaauguaaaaggugcagcugcucugcacaacaguuugaggguuucucaaacagcuaaacauagagugaccaugugaucuagcaauuccacacugagguauaugcucaagaaaaauggaaaccuauguccacacaaaaacuugcacacaaauucacaaccacaacagccaaaagcuggaaacaacccaacguccaucaacagacgaacagagaaaugcaaugcggugcauccauggaggaauaaagcacugacccacgcuacaacguggacaaauguuaaaaacgcucggaguagaagaggccaguuacaaaacgcuguguauugcacacuuccguuucuacaaaacguucugaaugggcagauaccuagagacacaaagcugcuaagagacugggaaguguggggaaaauggagagugacugcugauggguacaauguuucuucuuuuuauuuugagacagaaucuugcucuauuacccaggcuagagugcaguggugcaaucucagcucacugcaaccucaaccuucugggcuuaagugauccucccguauuagccucccgaguagcugggaccacaguggugcacuaccacgcccugcuaauauuuuguauuuuuuuguagagacgggauuuugccauguugcccaggcugaucucaauuccugagcucaagcaaucuguccaucccggccgcccaaagugcugagauuacaagagugagccaccgugcccagccuagauuuuuuuaaaacaauuuuuaauuuuuuuuuuuuuuuagauacagggucucacuuugucauccaggcuggagugcagccgugcgauuguagcucauggcagccuccaacaccugggcgauccuguaauccuccugccuuggccucccgaguagcugggaccacaggcucaugccaccucccccagcuaauuuuuaauuuuuuuuuuuuuuuuuuaaauagagauggagucuugcuuugcuacccaggcuggucucaaacuccuggcuucaagcaauccaccugccucagccucccaaagugcagggugcaagugugagccaccgcaagguuucacuuuagggggcaaaagugcucucauguugauugcgaugauggcugcacaacucugugaauauucuagaaaccacugauuguacacuuuaaauggguauguugcagcguccauuaauuauauuucaauaaaguuguaaaaaacacccaccaaaaacaucauccaguacucuaauguccacugacgcccauccauucugcucuaacagucaaguauauuugagagaaaaaaagggcuguccugagccccagcgccugccugucucaugggucuugacugugcccccagcaguuggcagcaaggaucauucugcacccaaggcacccacuccgcaaaggaaaaacagcagcccgcccggcccuccccugcaugcuggcugcuagagugccucacccuggccagcaacacggaugccccacagcaccugagcccagucccaagcucugggggccaggcaugcuuuggaauucagaacucuccugagaacaguaacauggugcccagggugugaguuacacaccgugcgugguauacaagggcagcgccuauuaaaacacaccgauguuugcacguggacuguaagcauuuucacaucagugagauccucuagaaugagaacagccucccaggagcucagggcagaugucacggccuugggaguuuuacagaaaggcccugcguuggagagcucuggguuuggaacuaugggcucgggcugugggccugcacugguccccugggcuccagagcugugggccacagaggggaagcgcaggccagggggacuagguacagagcugcaugccggaccucccccacaccccugggcuucaggaagcagggucuaccuuggcggcugcggggagcggggcuugggcuuccccuucuccuucucccgcuccuucucccggucgcggucacggugcugccgguccuucucgucccgcuuggcucgcucacgcucccacuccuccuuccuccgcugccgcuccuugucgcgcucgcgcucccgcucucgcucgcgcucccucugccggcgcucccgcucucggucccgcucccgcucccgcucgcgcucgcgcugucuguucucucucucucgcucccgcucccuuuccuuuguuaaaaagccaaacacauggggacaccgugcguuauuugggugacagaggcacugaaagccuuggcuccaacaccacgcgaucugucugugucacagaaucacaccuguaccccacaaaccuacacacaaaacgccaagugcucccgacuaugauugaacucucugcgguggaguacagaggagauggcaagagagaggcaggaucagggagcacccucaaguggggaucucaucucauucccagcucucuccuuaaaacacaauguuaaaaaccgggucagaugccaaauuagagcaaacacaaacuaggagugaaaucaucccaaccaccaauucuagacuaacucagggcagcaauucugcagucacagcccggugucguuggcacagauggccuuccgccguguggccugggcaaguccauuuguccauccagagacgggaguuccaggcuugucccagguaggugcagccacagcagagcacaugcccugccucuggagcagagcaggcacccaaaagacugcuccucuucuucuaguacaauccucggaugcccuuuccaacuuuuccucugcucuuacucauucauuugcucuaauauucaagguuaaaacugaauaaaguccaaucacaacgcaccugauggguuucaggcuugaggccucuguuggggagaugcagggugcaccccgagccucccugcugccccucccucggacacagcagagaggaacgcaguggaaagggaucccuggggcuuucucccaccuuccaggguacccugcccagggguaagcagcaggacccugcagcccaccugcaaugaggaagcugcuuuauggagagacggggcacaagagcaucgagcagggggacuuuucuggcacgauggggcccucuucccucugcaagcucacccugaugggcuccugaggagacagccgcaccugguccucaaagcucaugacugucccugcagucacagaacagaacuacacagcagcuucuaacugacccuucccuggggcaacuucgucaaaucacccuaacagcuaagaugaggaacucacagucugaagcacauaacucaucaauaugcuaaacucugaggcucagaccagggagauuuccagggcggaaaucucaguauagaccagucuuccaugagagcagugaggugcagcaggcccggaacagacuuaacaagcuggcugaaguggaccagaacaggcgccacauccuaaacgggaucacugagggguggggaagagugacacgcccgagcagggagacgcaggcaccccuggacacaggcaucaguaaguauacuggcaaaucucauuuucaaaaccaggccgagcugggcacagugacuuaugccuguaaucccagcacuuugggaggcugagauaggcagaucaccugagaucggaaguuugagaccagccugaccaacacggcaaaacccugucucuacuaaaaauacaaaaaauuagccaggugugauggugggcaccuguaaucccagcuacucaggaggcugaggcaggagaauugcuugaaucugggaggcagagguugcagugaggugagaucacgccacugaacuccagccugggugacagaguuaaacuccgucuccaaaacaaacaacccaggccgggcgcaguggcucaugucuuuaaucccagcacucugggaggcuaaagcaggcggauugcuugagcucaggaguucaaaaccagccuggacaacaugguaaaaccccgucucuacaaaaaaaauacaaaaaaauuagcugggcaugguggugcaugcguguggucccagcuacucgggaggcugaggauggagaaucauuugaacccaggagguagagguugcagugagccgagauugcaccgcugcacuccagccugggugacagagugggacccuaucucaaaaaacaaacaaacaaacaccacacaaaaaaacaaaaccauagcaagaaccaguuuucaggcaagucuuuguucaaaugaccauuaauguaaucgcugccucugaauucguucuccguaacaaucaauuugguuuucaaauugguacauugugcuggcucuauaagcucauauaaagcccuguauuuuuuacuguaaauaaaaagggauaacuugaaugaacagaucaugaaguucauauguggauauugaagucauacuuacucgguaauuaugauacggcucuguuucuguauacugcacccugaaauucucauacuguccgccacgccaaaaccgcucaauuucauagucauaauaagggucugcguaaggcucgagucugaaaagggccaaugaaaaagaacucucaucacuuaggagcacuggcguaaaaagaccacacgaaacauuagggacagaaaguaacagaccgugacgcagugggguuuacuccaggagcgcaagguuggcucaagguuaggaaaucuguucacaaacuacaucuaagagcaggccagaagucaaaggguucuauucacagaugauaaaaaugucuaacaaaaauucaauagccuuuuugauaaaaaauacucaagaaaauaggaagugagggccaggugugguggcucaugccuguaaucccagcaccgugggaggccgaggcagguggaucaccugaggucaggaguuugagagcagccugaccaacauggagaaaccccuucucuacuaaaaauacaaaauuaguugggcgugguggcacaugccuguaaucccagcuacucaggaggcugaggcaggagaaucacuugaacccaggagguggagguugccaugagccgagacugugccauugcacuccggccugggcaacaagagugaaacuccgucuugaaaauuaaauaagaaaaaaaaaaaaggaaagaaaauaggaagugauacuuuagcaugauaaaaauauacugacacacuuuggaacaaaagucagcaccuuacucacuggggaauaggaggagcucccccaggagucuccgcaaccaccugucccuguguggaggcacccccugacuggacaaggggagcccacuagaggcacaagaacacgaaaacaaggagcaaaacgagcucagauuugcaaaaugauaugauacuauacaugaaaaacccagagacuugauaaagccaauucaaacaaacaaugaagaaacuuggaaaggcagaggauaaaaaaauuaacauagaaaucagugucuucacagacacagauuauaaccaguuaggaggcagaguggagaaaaccgcauuuacaauagcaagaaagaagaaaaaaguacuuaggaauaaaauaucaacacauuucaccagaaaugugcagagcugauuccugagagacacaaagugugugugaauaaguggggagacgccugagagacaugaagcgugcgugaauaaauggggagacgccugacaugaagcaugugaauggggagaugccugagagacaugaagugugugugaauaaauggggagaugccugagagacaugaagugugugugaauaaauggggagacgccugagagacaugaagcgugugugaauaaauggggagacacgugacaugaagccugugaauaaauggggagacgccugagagacaugaagcgugugaauaaauggggagacgccugauacaaagugugcaugaauaaauggggguuuugaaaccugacacaaagcgugcaugaauaauggggagacgccucuugcacugggagagcgcagcucggaaucgcccacaagucaguccuuccuacacugacugauaaauuuaacacaaucccagcaaaaacaccaaugagcuucuuuaaggagccagacaagcugacacccaaguucacaugaaaaaucgcaccccaagaacagccaagaaaacccuggaaaugaaaagacacgccagacacgcccucugagacauuaaacauccuaaaaagccuguauaauuaagccagugccaucgcagcacaugaaaaccggcggccagaaggaggaggcaggagguccagaggcagacccaggcacgcccagagagguggcaucucagggacagaggggauucuucauugaacagggaggggacgacuguccagcugcugggaaggucaggcucucuuccccacugcgcacaggguuggggggggccugcucuaaacuccuggcggggcccacaacucugcaucuccuuuccuguggagcagaggaaacaaaguguacacuagcaauaggaggucccuggacgccccuccaggguaugucucagccacaagccaacccucugcuucggguagacugggugggaaccugaggcaucauggcuugagguggcuccagcgauggguggcuacgaacacccucgaggccuccucaacucuccacauggccuagaacuggcucucccaaaggacacagcuucaguccguucccaucagucggacaccguucaaucuaaugugcacacuacucaaaucacacugaauuauaacacucaggaaacauuuguagagaccuguggcaauaugacaucaggcuacauaaaaacgaagaggaagccuggacagcacgcgagacaccgucucuacaaaaaacacaucagcagccaggucugguggugcauggcuguggcccccaacuacucggugggcugaggcugauugcguaagcccaauaggguagaaaagccuuucccaaaaugugugaggcguguguucucugacaagaggacugugccggcaaauuuguuuuugggaaacuguacuuaagcaaaaugaaaaggccucuuuccugcaggcuuucuggaagucguggaugagcggauaggaaugaggcacacagcauuuccucagcguggcugccucggaaccaucugcuccgcagcaugcguucuagagaacgugucaacacaacacgccaccaggaacugcaaccaugccaacaacggacuccucagcaccauccugaaaaauucugaaacacucuugaaaugaauuuggaagguauuuaauucaauuuaaaaauaaaugcuacugggcaguaucaugguaugcacaaacucuuccccaacuguuuuagggaacccaaaauguuaaugggccuuuugagaaaaggguucuguggugaagcaagguugggcaaagcuggcucgcagcaacugggaggcucgcaccucguucugcagucaccacuuaaccagccaacaccaacaguguccugugcacacacguggaaucugcacuccagaggccccgcguccccagaggucugggcagcgucagacucagcacuggcacguggaguggaccuacuccucgcuggagaggagaacccgagguccuggcuaaggggaaccauuggacaugcccaucaggggcaggugguuucugcccacagccuugcccagggagaggcauggcaggugaaaagucgagcaauuagagaacguguaagacagaaguuuggagcuucgagaucacuuuguuuaaccauuucauuucagugacaaggaaacuggaucucaaaaaguacuaggaaaaaguucuaaaaugucuaacacuacucacuuuuaaucuaaggguuaugcaauauuacacaaugaaaugcaacuugcauuugcacaauucagguugaaaucgugcugaccucaacccagguggagggaggcugugcucugcaaagggugggagucagaugcucacgugucccugcuugcugcagagacccaaggugaaaaggagggucccaggcagcucacaaagggagcagcgacgcagcccccugcugccucuugcccucaccccaacccagcauggucgaccuggugcccaccugccuguugcccacguuccuguugcaacgcuggccacugaaagugcaggcaggggaggagguccccaaaggcaugcagaggccacaggcaaugccugggcacccauacauccaucugcccugagucugugggacugugggcuuacccauguggagcaggcccugucuuacucuccagguagcccaacccucccucccugcucacucagggggcuuccccacagggcaccagcaaaucccagguaaaagccacuugugcucucucaguuaagcaucugggacaaaggaggugcuggaccagcaucugguagaccuguuaccugaggaaagggagugugcuuuuugaaaauuacuguucuguuuccucuguaucccagccugacauccuacuccaaagaacagcagccugcaccuccgccucuaauacaccggcacugcacuacucucugugcugggggcguauggggaguuggcaggggcccaguccauggcccuggccauggccugacagccugacucugauuuaaucagaaacucuguucacgguggggcuacuacugaugaccgcauuucucacaggugacguccugugcgcacuagaggcccuugugucuuuugggucacaugucccuauuagacuuguagaauauucugggcacagcauccccaggagcccuaugcagagaugacauuucuuuuuuuuucuuugagauggagucuugcucugucgcccaggcuggagugcaguggcgccaucucggcucacuguaagcuccgccuccuggguucacgccauucuccugccucagccucccgaguagcugggacuacagguguccgccaccacgccuggcuaauuuuuuguauuuuuaguagagaugggguuucaccauguuagccagaacggucucaaucuccugacccugugaucugccugccucagccucccagagugcugggauuacaggcgugagccacugugcccggccgucauuucauuucuuaaugucuuacauaugugagaacuuuuuuuuuuuuuuuuggagaaagagucucacucagucacccaggcuggagugcaguggcacgaucucacuugcugcaaccuccaccucucgggcucaagagauucucccaccucagacucuugaguagcugggacuacaggugcgugccaccaugcccaacuaauuuuuguauauuuuguagagaugggguuuugccauguuguccagacuggucuucaacucccgagcucaacugaucugccaaccuugaccucccaaaacacuaggauuauagacauuacuagcuacuguauccagccaauaugugagguuuuauaagucagaugguaccugaacaaagugcuugaggugguagaaacggaauauuuaaagcugcgaaucagagugcgucugucuagcaaaguauuauuauuauuauuauuuuaagaaauggggcugggcacgguggcucacgccuguaaucccagcacuuugggaggccaaggccgguggaucacaaggucaggagaucgagaccaaccuggcuaacauggugaaaccccaucucuacuaaaaauacaaaaaaaaaaaaaaaaauuagccgggcaugguggcaggcaccuguagucccagcuacuugguaagcugaggcagaagaauggcgugaacccaggaggcagagcuugcagugagcccagauugcgccacugcacuccacgcugggcgacagagccagacuccgucucaaaaaaaaaaaaaaaaagagacggagucucgcucuguugcccaggcuggagugcaggggcaugaucuuggcucacuggcaaccuccgccucccagguucgagcaauucuccugccucagccucccaaguagcugggauuacaggugcaugcugccacgcccugcuaauuucuucuguauuuuaguagagaugggguuucaccguguugcccagccuggucucaaacucuugagcucaggcaauccguccgcuuuggccucccaaagugcugggauuacaggcgugagccaccgugcccggccacaaaguauuauguuuacuaagugauccugcuaggucaguuuuuaauuccaaaagagauauaaagaaaaaacaggccaggugcgguggcucacgccugucaucccagcacuuugggaggccgaggcaggcagaucacgaggucaagagauugaggccauuccuggcuaacauggugaaacccugucucuacuaaaaaauacaaaaaauuggcugagcgugguggcgggcgccuguagucccagcuacucgggaggcugaggcaggagaauggcgugaacccaggaggcggagcuuacagugagccaagauggcaccacuacacuccagccugggugacagagcgagacuccgucucaaaaaaaaaaaaaagaaggaacaacaauuuucuuguccuuuauguccucaagacuucucgaaaaguccucauauuccacugguucuacaaugaagugccuagagcuccauccuguaguaagcaaagccugccugcaugaaggugcuucuaugugacaauuauuugcaaaacucaacaucagguggcuaacgucuauauucccagcaacuuaggaggcucaggcgcgaggauugcuugaguccaggaguuggagaccagccugagcaacauagcaagaccucaucucaaaaaaccaacagaaaacucucgacauuaggaaauaaaauaacaugguaucuucagagaauuugugucccuggaauuacuuacaaucaaugguucucaaacuuuaauaugcaucagaauuaccuggagggcuuguuaaaaacaaaccacuggccugggcucucccuggaguuucagacucagucuuccuggggucgagcuaagaaucugaccucucacaugcugcugggggcagauguggcugagguuaaggcaccacaccaggaggucacagcuaucaauccagguugcacucuccucaccugugaggcagggacauggcccugaccucggccugcugugacccaaaacaggucaggagcacuggaugcgaagccugucaugcagcaggauugcaacacauaagugcugcuggcuuggccucuucugugccauuaaggcccuggagccugaccgccaacugggcugccagccacccuccugcacacccuacaagcugcgaccugcuuugccagcuguuccaggugaggcccugccugcagcgggcacagguaggaccgagaaggcugggugacaagaggacccacuccugccaacagcacgcaccaggacaucugcacuugcagugcagcuccuuccuucccuccgggucucagcagcccagcuguacuggcucccucuacucacuguuuuccucuguagcaaccuaccugguggacccacccuucccuuagaugcucuuugugacaaucauaggggggucuccacccuccuggcagaacccugacaguucuuuccacugugucuaucagaaacagccagggcaccucgccacugugacacaugcacccugacccuguucccagagguccugacucaccaggucucgggggaggcauggcacaaaaggccucagguuaacuguaacauacacagaggcuacucuauaaaaacaaacaaaauacaaacauacagaaauaccuggcuuucagacaccagugaaaaccuuucagcccugacugccgagacuuuaacauuuggggguccugcaguguagauaccggcuccugggagagaagcuagggagccaggagccagcuucugucaccuggugccaggaugggagacaccuguuucuguaaccaacacugauagguaaaacacacacagagggcacuccaaaaaaccucagagaccugccgaaccacuuccaagcaggcaguuuuccggucccugcuccagccagggaaacuggaaauagagugucaaggaucacgcccagguucuaaaauccauccuuccccacacauauuuauagagaccucugugcacacgagcucuggggaaggaaagacgauauccacaucuaacaaaaaaacacaaaggccuccagggcuucaggagacaccccuggugauccugcagaguucugacucaaaugcuccuuucugugaucugacauuccacacaaaacuuaauuagaaaauguacauguuaaccaagucuuuaaauaccuaucccuuuaaccucuaagcucucaccugcuggggcaggugugggccacuggggcuuccucccccaacuuccgcaggcggaaagcccaggguagccugcucgcggcaagaaggccuugagaagggccuugcagggccaagucgacaggaccaaauccuggagugcaagcccugcacgccuuccuuuuuugagcaccguuuauugucacuccagauagaaaucauagugauuaugauucccuaauagcaaccagaaauguacagggcugcuaaagccucagcaugauggagugccaauucagaucugcccgaauuauaauccaguucccugcccugaaccucaccgugccauccacaggcagaggaaaacagcacuuuauaugccaugcaaucccccaagaucugacuuccacccuucgacccaggcacuucuucuguuaagacaggauuuuuaaagaccaggcauaaaggggcugggugcagugguucacgccuguagucccagcacucugggaggcaggcguggguggaucacuugaggucaggaguucgagaccauccuggccaacauggugaaauccaucucuacuaaaaacacaaaacugaguugggugugguagcagacaccuguaguuccagcuacucaggaggcugaagcaggagaaucacuucaacccagggaggcggagguugcagugagccaagauugcgcaacugcacuccagcuugggcgacagagcaagacucugccucgggaaaaaaaaccaaaaaacaaaaaccagccaucaaugcccuggaggagaagcagugaaggcagaacagcccugacagcgaagaggccgcagcuguuguguuccuggcuuguggcaaccuccacacguuuccuggcuccuggguaaugugggcaggggugaggagccagaaacacagacuuguggggcucuagaggccucaaggacagcagcgaaaacucucagagcucaggaaccacaacggugugagugcugccagucaaggcccauggcacagagcccuaacgcuuccuuccuagaagcaaaaaacugagaugagcucugagaaccgugccugaaugcucucaggaacgucacugagacuccagugaguggggcugggucucagccgagcgcacccuggggcccugcacauggcugcucucuccggagcguggccgcaugcaggaaggaaacggaggggcaggcagggccauuccuuacacugugucucugacaucucucgggauccgagaauuccaaucucgaaaaacuucauuuucuuugucaaauucccguucgucuucgccaauggucaccguaaaccuuuucucuucaaaaucaggcuccuguucuuuucgaauaguugcuuuuuuuaaaaccuaccauuguaagaagaaagaagucaacauggaacagaauaccgggcgucgcuguuaggaaacacaaagggagccgucccacccgaccgcagcagcccugcaggagcaggagcugcacgcugcaagugcucaaggggugaggggcggacacagcacaguuguccuucuggggagggcagucugugcccgucucugcacaaacagcugcccccggccuccgugugcccacaugagguguucaucacuuccuucaacuacccuuggaacuagauccaggguucagucacucagugacaagcagcagguggaguggcuggagucucagagggaaggaagugacaugccgagggagugagaaggaacaucuuguccgucauuucccagcagggaggcugaccaggaaaaugaggaaguggggcugggugccagcagagugguccccagagcugaagcucacacacuggggccaacgugggccuagagggaggaagugugcagugauaggaccagaaagcuccaaguuuucuccaggaagagcagacacugagucucaggaguguggggugcagauccugggggugcggcucgggcagccucgccaggcuuucugugaguggcuggagacugcacccugugcuccugggcagugccagcugggguguggcccagugcugauccagccccaugaagacaguggguaugcccuggacugaacucccuggccuacugggcugcugccugagacaguuagauauaacucuccauccuuccgggccugguggcgcaugccuguaaucccagcuacuugggaggccgagcaggagaaucacaugaaccugggaggcggaggcugcagugagucgaguuugggccauugcacuccagccugggcaacaagagugaaacucugucuccaaaaaaauaaauaaauaaaaaauaaagaaagacaccacagaaacagacgccuaacuucagagauuucuggggcucucucuggaccgaggaaaucccaguuuugucaagaaccacuccuguaauagcaucuuucuugucgggauuucugcugaauuguguuuaccuccuuugcaugccggaguccucguucccaggcacucucuguugggggcucuggaggggguggaggcaaaauuucaucaacuaccggcccacccuauugaaaaacgagaagggagaaggugagaaaguaaaacuuucaaguguacagagaaaccagacaguaaaaacaucaacuacaacacaagccggccguguguggccgcucuccuuccaccaagccucacuccguccucggaaagccgaggccugcuuccacucgggacgacagaagcagccgaaagggggcacugagccugugcuaaggcacagugacuugucuuaagcuugagauucagacacagcucaguuggcugaugugcuaacaaugaaagaagaggcaucacgcacccaaggguuggcgggcaucagcgggugagguccgagaggcggggcaccauuaggcgggaaggggucggcuuuggugauuagggaguaguuccccuugucguucacuccaggguguauaaaccuacaauucauuccccagguacaguucccuauggaaacaaaagugagaucagaaaggguccacaagagccuaauugcacaagggcagcugcugggguggggggugggagggggcagaggccauguuuacccaggccugauggcgagccacacaguagugggaacugaacggggaggugggcgggaugagccuggagaggcugagccagacagcugcaccugcccaggcacggcaguuccccagaggcugccaggcaccucggucagagugaccacaaagucacuuuguggagaguucacgcguaucaacugucugaguauuaauuuuccccuuaaaccagaaaagccccagagcuuugcuuccagcccuggcccaggcucaucuagguacaacuggauguuaauuguauuugugccgaaacagacaucaaugagaagcauuaacaaugaucagaagccugcaggugugcucaggguccccuuggccaccucuguacgucugcauuucucucacagagaaaacucucacagggcauuucaagauauuucuggaacugaaacgggcuuuuacacuuugcucauaaauaacaaucacaaaccuucaucuucaacagaauauccggguuaguaaaggagaccucgacuuucaaguguagaauauaagacaucuaagugucuaacucaauuacugagugaaucacuuuuuuaaaauguacuuuuuugggaauagauaauguguacacauuguuuaaaaccaaauauggcauauaguaucuaagcgguuuaaaaauuuuuuucaauggguuaacaugcaguuagauuuuaaaucauuuaaaauuuuaaccuuaaacaucaggaacacuuaagccugcauuaaaaccaacucaauacaacauaauaacaauaucgauccaaauuaaacacgaaagaaaacuuaaaacugcuucucuggaaaugcaaaaaugacaaguaauuuuuaaaauuucuaaaagcauuucagagaucacacauaagucaaacgaaguugggaggccaggcgugguggcucacgacgucaagagaucaagaccauccuggcuaacauggugaaaccccgucucuacuaaaaaauacaaaaaauuagccggacgugguggcaggugccuguagucccagcuacuugggaggcugaagcaggagaauggcgugaacccaggagguggagcuugcagugagccgagaucgugccacugcacuccagccugggcaacagagcgagucucucucaaaaacaacaacaaaaaacaaaagagguugggaaauguuauucuauaggggguucaaaaauccagagccucagagagauuuaaagaaaaacugacuaugcagucauccaucugagacucaacacacuacagagcucuucaugguuugccucugaaaauacucaugcaguauucaaaaucacguguguaacuaaacaaguaacaaaagcucauuguaaaaaauguccaaguacagaaaagugcugacaauagaaaccacagcuuuucuguacuccuuuuccuuuuuuuuucagauggagucucacucugacugagugagacagucccaggcuggagugcaaugaugcaaucucggcucacugcaaccuccaccuccugggugucagugauucuccugccucagccuccugaguagcugggauuacaggcggguaccaccaugccaggcuaauuuuuguauuuuuaguagagacgggacuucaccaacuuggucaggcuggucucgaacuccugaccuugugaucugccagccucggccucccaaagugcugggauuacaggcgugaaccaccacacucggccucuguacuucuuuuucaucuaaaauauguaucugggugguggcuaaauguuaucguucuuuucuguauuuaugaaaauuuuuaggacaucaccuacgaaccuacuaucaaaaaagauccuuucucacugauauuggcauggggagaaaagaggaacaaggcagaagagaacaaaccagugagcgccaaagagcaagcugagaaggcgagcguggggcugccacuagagaccagacacuagugggugacaguguucagcucucgggagccaccugcccgggggugcugagcgcuguccugccccuggccagaguaaaggggaagauggcucuggaaagcagcacaguuggucugcacgucuagcugggacacacuuccagcagacgucaggcagaaagaacaccauugucccaucuaucuuuuuaaaaugugaacuuuuaucuguguaggaacacacccaacugucgggaaugugggaaggggcuuuagauuuuauuuucuugccuucugccagcccauauuacuuucuuuccuuuuuuuaauuuuuuuuuuuuugagauggagucucgcucuguugcccaggcuggagugcaguggagcgaccuaggcucauugcaaccucugccucacaguucaagcaacucuccugccucagccucccgaguagcugggauuacaggugugcaccaccaagcccggcuaauuuuuguauuuuuaguagugacaggguuucgccauguuagccaggcuggucucaaacuccugaagucaggugauccgcccaccucggccucccaaagagcugggauuacaggugucagcuaccguccccagccuuacuuucauaauuuaaaaagcaauuuguuaaaaaaaaaaaaaaaaaaaagaaagaaagaaauuauccagaaaauagaagcaacaauaaagaucuucugguuuacaaaugggacuucaaacccaaaauuuauguggauugugauucuaacaguauaaagauaguucugcggauacuguguacacagacauggccucaggccagaagaggacaaggagggacagaggccgcuggagcggggcggaggcggccccuccacugcugaaaugucuaaguacuauuucuggcuucaagacaggaugauggucuuuuucuuaacuggaaugucggcacagcagcaacugguuuuucuuuuguuuuguuuuuguuuuuuugagauggaguuuuguucuuguugcccaggcuggagugcaauggcacaaucucagcucacugcaaccuccgccucccagguucaagugauucuccugccucagccucccgaguagcuggaauuacaggcaugcaccaccacgccuggcuaauuuuguauuuuuaguagaaacgagguuucuccauguuggucaggcuagucuugagcuugcgaccucaggugauccgcccgccucggccucccaaagugcugggauuacaggcaugaaccaccacgcccagccaacuguuuuauucucuuauuaaucuuuacgcuuguguaaacacuguauuauuuuauauauaugaaauauuucauaaucaaaugaaauacuuguaaauaaaaaauacccacccacucuaaaagguacacugugaaguugaccaccuaucccaugccuccagggccauucccagaggcaguuaucaauauacuggggcuccauccaucaaucauugcccccuuuuaccugagcauauauauuaugcucugugcugaaccuugcuuuuuuucacuaaacaauguaacuacagaaagggaaccugcaugcucaguagcaaccaacccaaacuggaucagggaaacagacaggaaacagauaggaaacauggaaaauccggaaacuaaacacagagguggcaggaacugaggcucagcucaugcuccagcacagcccacacaugaaguaucuuuaaaugucucuucugauuuugaauacaguaaauaucaauucccuguguuuacuugguuuauaugugucauuucuauugauacguacgauauuagaaauuaagagacacuuaaagauaucucauuauuuaacaauaacaagauauccaauauauaguaacaaauauuuaugaaacuguuuuuaaaauauuuggugagaggaauagcauucuuugccuuuuugcgaaucucuugaaugcugacccuggaaaaccccuggccucccaucugcaugcgaucgaccaugaagggccgcuguggcucaagcaggagaggacauuacagccccaggaagagaugcagcuagagagggaggggcaucuaaaagccuuuucagugugcucagagcuucucccugacaccgcacucagcaagggaaggcuccuuacagcgagcugcaauugaacccuaucaccacacuuuuccaacuugguucuucugaaauccauuggucuaucuugaacuuugaaugggucuuuuacccaggcaugauucugugacauccugcaauggucaccugagaaaguccugacacacugagaagcuggugagcacacaaaaguccaauuuucaacugaaagcuccaauuuuaauacugcuaacacuguccguuguucuccuugaagccacaggcucacuuuguuccugccaggacccggaucugcauucccuggcaugucugccagucuuucucaucaaugugugcuccacggagagcgcacagggucagccgcagcuccagccuugcacgugcugccccuugaggccgcuggacuugggugccggcaggggcucuacccacgcugccacuccaccacgcugaguacugagacacacacagaagcucugcuuucuggcuuuccacaguuucaguuaccugcgucugaaaauacuaaaucgaaaauuccaaaaauaauuccuaaguuuuaaaugauguucugugcugagcagcgugaugaaaucuugugccgaccuccucugccccaccugggacacgaaucaucccuuuguccagcagaugcaagcuguccacgacgcuaacugcccacuagucacuuagcagcccucuuggccaacaaccguuggggguacggcggugcugugcucacuguggcucagugacccaggaucacugggggcaggugaccuuccuucugacgcauuggcaggaggucaaggggggcccaaugcuaaguggcagggccuccgugucaucaugcgagcauauuucaucccacgucaucagauggcugaguggcugagugcaguaaagugagcucuuuugagagaucacauucacauuuuuauuacaauugcucuauuuuaugauuggcuauuguuguuaaucucuuacugugcguaacuuauaaauuaaacuuuaucauagggauaugcuuauauaaucauggaacuguacacuuaaaaugggucaauuucauggcacauaaauauuacuuuaauaaaguuuuuuaaaaagaacuuacgaauaauaaaaauaaauaauacaucuguacacaaguguaagauuuaauuaaauuacaguucuuacuacuacagcacagacaugaaguaaaguggcauucgaaaugccagugcauggugaaugccuggcucagccuuacuguuauuauaaauauaguuucgauuugggaggccaaggcggucggaucauuugaggucaggaguucgagaccagccugaccaacugaaacacaaaauuuagccacuacuaaaauacaaaaauuagccaggcaugguggcaugcgccuguaaucucagcuacucgggaggcugaggcaggagaaucguuugaacccgggagguggagguugcaagugagcugagaucacgccauugcacuccagccugggcaacagagggagacuguaucucacaaaaguaaaauaaaaugaaagaaaaagaaaaauaaauaaauauaguuuugaccucaggguccccugaaagggucucaaggacucccagggguucacagaugacacucagaccugcugcuuuaaacacaguuuugcaaggauucaaaacugagcaaaagacauuucuccaagaagauacacaaaugaccuauuaagcacaugaaaaaagacaccccaccacccaucuucaggaaaggcagaucaaaacccaguaagauauuaccuccuacccacugaaauggcuacuaucaaaaaaaaacagagaacagaguaauggugaggacguggagaaacuggaagcccccacaccacuggugggaaaguaaaauggcacagccacuguggaagacagcuuggcggcuccucaaaacaugaaacauacaaccaccaggucaucagcaacuccacugccagcggcuccgcaaaagaugaaacacacaaccaccaggucaucagcaacuccgcugccagcgguuccucaaaagaugaaacauacaaccaccaggucaucagaaacuccgcugccagcgguuccucaaaagaugaaacacacaaccaccaggucaucagcaacuccacugccagcgguuccucaaaagaugaaacacacaaccaccacgucaucagaaacuccgcugccagcaguuccacaaaagaugaaacacacaaccaccaggucaucagcaacuccacugccaggcacaugcgaaagagcugaaagcagggucugaagagauuuuuacgcccacguucacagcagcucuauucacaauugccuagagguggaaaccacccaaguguccacccacagaugagggaaacacccaaugcagcugcuccacacuaacaaauauuggucaaucuuuuuuuuuuuuuuuggagacggagucucguucuguugcccaggcuggagugcaguggugugaucuuggcucacugcaaccuccaccuacuggguucaagcgauucuccugcuuuggccucccaaauagcuggaauuagaggugugcucuaccacccccagcuaauuuuguauuuuuaguagagacaggguuucaccauguugagcagucuggucucgaacuccuaaccuugagugauccacccaccucggccucccaaagugcuaugauuacaggcaucagccaccgcaccuauuauucagucuuaaaaagacagaaggccaggugcagugacucacgccuguaaucccagcacuuugggaggccgaggagggcagaucacgaggucaggagaucgggaccauccuggcuaacacagugaaacuccgucucuaccaaaaacuacaaaaauuaccugggcgugguggcgggcgccuguaguuccaacuacucaggaggcugaggcaggagaauggcgugaacccaggaggcagagcuugcagugagccgagauggugccacugcacuccagccugggugacagagcaagacuccaucucaaaaaaaaaaaaaaaaaguauuccaccacaauuuuaaaaaauuagggggagcacagccaaggagaucagacccaaaaaauggacugggaugcuuguucacugagggauaaaucagaagcccaaaguaggggccgggugugguggcucacaccuguaaucccagcacucugggaggcugaggugagcggaucaccugaggucagggguucgagaccagccuggccaacaugaugaaaccccaugucugcuaaaaauacaaaaaugaguugggggugguggcagaugccuguaaucgcagcuacucgggagucugagacagaagaauagcuugaacccagguggagguuccaacgagccgagaucucaccauugcacuccagcccgggugacagagcgagacacugucucaaaaaaaaaaaaaaaagaaauaaagaaacccaaagugggacacaguuuaaagaagaugcuacuuacuccucuguggacagaacuuuguguccugaugauccaacacaggcccacgagagauaaaaacaucccaugaagaaguacagcuccaguuguaguguaugugcuguggagccgggcaggcguacacaaagcacugaucucuaaaaugugagcaagguguguucccagugcauuuugcugucauuuggucacaaaucucaauguguccacuaagcgauuaaaugauuaaucucuauaucacaacgugucggagauaaagcuaagagaggccugagcaguggcucaugccugucauccccauacucugggaggcugagguggaaggauugcuugagccuaguauuugagaccagccugagcaauauagugagaucccaucucuacaaguaauuuaaaaaagaaagaugagcucuugcaauguugcccaggcuggucucuaacuccugggcucaagugauccuccccauucagcuucccaaagugcuaggauuccagguaugagcuaccaugcccagccaccgacuuuuuucuaagaaaagaauuuucuaauugugacacaauucacauaacauaaaauacucccauuuaauguguacaauucacugguuugcaguauauucacaaaguuguguaagcaucaccacuagcuaguucuagaacauuccaucaccccaaagaggaaauccuguacucacuagcuaucacucuccacccccaguccaggcaacgaggaaucaaucuacuuuccgucucuguggaucuguggccuucugugcucccuucugucacucagcacgucuuuaaggcucguccacauuguggcaugagucacaaucuacuuucugucucuguggaucuguggccuuccgugcucccuucugucacucagcacgucuucaaggcucguccacguugcggcgugagucacaaucugcuuucugucucuguggaccuguggccuucugugcucccuucugucacucagcacgucuucaaaguuuguccacauuguggcaugagccagugcuucauucccuuuauggccaaguagcauuccacugcauggacaggccacacuuguuuauccauuccucacuuuuuggguaccuggguuguuucucuuugguuacuggaaauuaugcugcugugaacauuaaugcacaagcuuucacauaaaugcacacguccguuucucuuggcugcauaccugcaguggaacugcugggucauacaguggguacccgggagcuucugaggaacuguuuccuaaagcagcugcaccguuuuacccucucacgagcagugaaugagggcuccaacaucuccauauccuugccaacacaacaaacuucauuuuguuuuuaaaauaacuuguuguuauuggagagaucauaaacugaagaauuucaauuucauauaaacugcagguaggcagaaacauuuaaguccaaauuucucauaacaaagcagcagcagaagacaugaucuagaaaacgguaagaaucagccacuuccucuguaccguaucaccucacucuacagaauaaaaacacuucugaaaugaguuauugauaacaccugauuaagccgcaaaaaugcugccuuaucuagcuucugacuuuuuuuuuuucaagagacugagucucacugucgcccaggcuggaguacaguggcacgaucauggcacaacugcagccucaacuucccaggcucaagugaucugccccugucagcccccaccccccacguagcugggacuacacaugcgugccaccaaacccugcuaaguuuucauuuuuuguagagacaaggucucacuauguugcccaggcuggucucaaacuccuuucuugacuguagaaacccuuccacauggucucacuugcugaaacccaaacucaguacuuagucuaacuuugggggcaccaccuuccaauucugaccaacccacgugaugugcaaggagacaggauccugucuguguucauccaggcaucucccaaugaagggaaugaagaguuccaguaaccaucucucugucuguuuugugcuucuguuguuaaauucuggaauuagcucagcagugagcccugggcuccugguccagagucucccugcccugguggaugcugcagccuccugcaguuggaaccaucaggccaacgccgacuggccggucaagcuucccagucacacugccacccagagaccagagcacugcacugugaugggugcugauucaaaaugacugcaaauguguacacguacauguguacagauuguucuccaucacuuucauacagaaauuugagacacugauguuguuaauucccacacuauuauggaaaagaggucuucugcuuaaauuccaauuucuuuaaauacugacacugugaauaccaaagcuuuuccaaaacguaccgcacauuucucugcauucuuaggugugucugugacaaucuacggcucuaagucugcugcccucacaggcucuccccaguaggggccccucacaugcacgugugacuugggcacgucaacuguuuuugcuuggcaaaaccaagcaagcacacacccacaggagcgagccuaacccgggguucccaugagccccacaucaucaggucaucucuugcacaggggcguucccggcugcucuaagagcacagccugccucugaaugaugggacuccgccacaccccaaggguguguccugccuguccccgaugcucgacuggcucacgugccucuaaggaggagguuccgaacagcucucugccccucaaagacccccuuuccuucuggcuucacagcuguguucuggauccaggagaaggaagucuggccucuggaguagggggacuuuaagguacugaagagagugaauauagcguauuuuguaccuuuaaccuggccucugaaugguauggaauuggauauugguggaagaagaguggauaauggugucacaacaucuggaaaagaaguacaggaagcucuugugagcuuuagauggcacacacaggcuggcagugacagucaucuaugggcuuacagcaaaauuaagagaaaagagaaaaacaccuuccuaccuuuccaaggggaacgcugaauuacaagaaauaugccaaaacuacugcugcacaucaaagauacccuuacaaguuggaaauucucauuuccauuuccgaaucccccaagacauuaagcagcgaaacaaaaagcccuaacaucaucaggcuagaguucugccacauuuuaaaaugggucagcccagacuuuucugacacuuucuuacacuguccccugcugcagcuccugaacucacaccauuccuucuacaggagagagcccugcugccuucagcggccaucucuggccauuucgaaauccauuccacacgaacaaacgcuucggacacaucuugcaggaaaagcggccaucucuacagagguggggaaaaugcuaauucuggugucuagaacauucggccuuaugaaaaggaccacuuugaaaaaugacugaugccaucugcauuauaguuaugggucugcugcgaucggaagggccugggaccaccagugugagaaugagaaugaccaggcugcucccaccaaggcagucauuaaagugauaaaagcaccaauaaaagggccuauuguuuaccaucaauauugccaccaccaccaccaccaccaccaccaccaccuagccaguaaugcccagagaacugccuugagcagagcagggccuggcaaggugagccagcaccacagccccagaagguggggccccagcuggcugcgagaaggccucacacgcagacaauuaccuuucaugaagaaccggcaggugggacgaggccucaccuuccugucacugggguccuucacuucaccuucuuccaggucaucauccugaaacagagaacaccgucuuagcgugggggaggcaucuaucaaucagcacugcuuucuccaaaccagaaggggcaggaagcugcguguggaaccuggauauugucacaggaauugaauucacgucaauuuuccaaaucuuaggucccagaucuacauagcagggaugaucagagcgugcccggcagcucuaagcaucccgccacagcaccagggagaagcacugugcagcacacagggcaauuuacagagugggcuuucgugacauuucucuuaacuaucaacucugggcaggaaauaguaacacuucgggguuuuaaaacuuuuaacauuuaaauaaaauauggagaacaaaauauuuuaugucccuuaaacacaaacauccucuaauuuacaauucuuggggaggggaggaguugggugccucagggcagugaugccagcaguugggaguggcccgccuugaggcucauccucaaccagcuccucacccugacugucaagucuuagaacaacccaggagcucuaagcugggccucacccacagggacucgggugcacagccaaaccugacccuugcuuggugcucuccccaagccacccacugucccagggccuguucccacggacgugcagcugagaccccuccuuacaccaccccagcccacgugggcaccagcugcccaccugacaucccugacacaggaccauccaagauggaaguacucgucagccugaucccggccucuuccagccagcccuagcguaaccaaucucaccggucccauguggccccucuugaucccccuccccaucuccugcaaucugcaccacugcccaucacacccagccugguaaaaccacuuucuaacugaccucucucauucccuccucaacuccuccagucucgcuucacagugugaagcgcccuuuuccaguuccaggccugaccgcguucuucccucuccucuuccugauuauucaacuuacuuucagauggaagcuugaguccccuuccuugggguggccuucccugagcucccccuacgacagguccuugcagccccaagcccugcagguguugcagccacaccugagcacccuuguguugacgacaccaccaccugccuggcugaacccugugccccaccagggcaggcccacgucugccagggcaggcccaucgccaaguugcugggcccaggcagcaucuggcucacaguaaacaguccguaauuaucuguugaaugaaaaaaugcugaaaccaaacccuggauuuacgacaaccuaaacuuucacagcuuaaauauuugcaucauuuuuugccucaaagauaucugguuauuaaaaaguauuuuauaaggaaaagaacagauuccugagaguuauaucccuuaaguaauccagcagaaucacuuuuuaaagaaaugaucaaacauaacaaauuaaaaaaagaaaugaucagagaaggcauguuuaauuuaugccaagugacaggaugucucucuucucuggucuuuuaguuugugucuucuuuuuacuacuauucuuacaguaaugagcaccacacuaaaaucucaacgugguauucuauguaagcucaaaucuaaguggagaacacauucuuuguucccaugagaaaaacaaaacucauuuggaaaguucgaauccauuccaaucuuccugccuuacuuggaagugagcguguaggagaugagguggugagaaggguuuuucccgcaucaggaugaauaggaaacaaacuagaucagauguagcauuguuucugcaaagauguaaccaccaacauucacagaagcaaaaaaggagaacaauguaaccaccuuaagauuggagggaggacccuguagcuacuaaaggugaucgguaaacagaccagaguugcauacugaaggugcgagacaucauuucaacccaaagaacacagacuagcaccuacacacugaccccagucacccagccucuacacccgcaaggaccaggggcuguacauauuggugugcugggcuuauggccccuuucaguuaaaaaaucaaacaaacaaaaauaauccaccaaucacucagcaauauaauauugugaauuuucaacuaaccaccauuuagcacaauggucuuuuaaauaauggaugauuaccaugcuuuuuuuuuuuuuuuggagacagaguccugcucugucgcccaggcuggagugcaguggcacgaucucgguucacugcaaccucugccucccggguucaagcaauucucuugccucagccuccugaguagcugggauuacaggugcccgacaucacgccuggcuaauuuuguuauuuuuaguagagacgggguuuugccauguuggccaggcuggucuugaacuccugaccucaggugaucugcccgccuuggccucccaaagugcuaggauuacaggugugagccaccacgcccagccuccgugcccaauuuuuauucuuacuuuauauguguaaauaacaaaauauuuaaccucccaaaauaaauaaacaaaucacuaaauaauggauaauuaaaacaaguucuuaaauuuuagaauaucaugcaaagacaacucaagacagggacccagagcugaagucaucugagauugucacacuaagugucugccacgcaggaacuccgggucuccugguuucccucacgccgauggccuucugcucaugugacccgagccacagagaguaggaagcagaggacaaggaggggccugaguggaccagcuagcuacaaauuggccuaaaaacggauggugcccguggggcucucaacacacaccaccugggacaggccaaguugacguggacacugagggugagugugaggagacacacaggccucagugcacccaucugaagccgggucuccacgcuggcacacuccugcuggugcuuucucaccacaggggaaauacacacguggauaaaggacaccaggcugagggcaucaucuacuccaauuuuaagagccuuuauaaaauucacaugcagugggggaaaaggcccagguucaaauccuggguccaggcugucaugacugugaguguggacaggucaccugaucugcaaaagucaccugaucugcaaagcucgccuuccccuuugcaccacggggcaagugccccagagcagggugaugugggcugaaggaaaaugcugcaccgugcuuaaaacaugagcagcaagugcucagcaagcgcgccugaguccuccauuucaaaggaaacgccucacugguaacgugcuaaacaggacuaacucagagcaaugacacaggggauuuucgcuuucuucuuugugcagccuuuucuuuuccuuucuuaaauagaaagaacacugugaacauguauuacuuacacaacaagaaaaaaguuauuucacacuggagcuucuguacaaaggcagaugcagauaaggaaagggggccacugcguggagcugcugugccagaggaagccgagcagccgggccccgggcccaaccuggcacggccacucaggccaaccacaaccuccugaauccugggcaucuugucugcaggaugugggugaaaauacgggucuaucauuccuuaacugaaaccuguggggccaggugucuugagaauucagaaauauucuggcuucagaaaggugacaacacagggucuaaaacgguagccugcgagguacacagcaauccugugcagaggucucggggacccucccacaagaggggaggcaggaggcuaugagcagccucacgccagcuugggccaggucugccaccaggugaggaaaagguuucaguucucagagcuucugaggccucagagcuguaaggacgguggccugcgcuuuuucauguggcuauguggaacacuaaccacgcuaaggggcacagaaggucucugagccuacuacugaugcuacggggcccuuuuuccaagugugguacaggccgcugcuuccugggcuuuggcaauagaaugggcgcacuuggcaccuuaucagugacacggaagagaaccccacuugaaguggaaacccacagccaugaggcucgcugaagaaucuucugcagaagagcucauggauccagacauaaaaggcggguggaucacgaggucaggaggucaagaccagccuggccaagauggugaaacccauuucuacuaaaaauacaaaaaucagcuggccgugguggcggaugccuguaaucccagcuaaucgggaggcuaaggcaggagaaucgcuugaacccgggaggcagagguugcagugagccaagaucgcaccacugcacucuggccugggcaacagagcaagacuccaucucaaaaaaaaaaaaaaaaaaaaaaagaaaagaaaaaggaaagguggauuuaaacaggagaaaauauuaaagaccaugugcaaagaaaauguuccaaaagguggacugagagcuaccaauuaugacaggagucauguggcccacccacucaggacagggcccacugcgcugcuggcugacuaggaggccacccuacaaauguaggagguccucaauaagaggagaauggaacaaaaugggaacccuauccuuuccaagggccagugugcuccaggugacggaaggccugcuaaucaaaugucaagucagauauaaacacggaacauggagugagcaaaagagcgggcagacagacccaggccaggccucucaacuguaacggcaaaucagagccucgccaggcuggaaggagcuugucaucucccagcaggaaaggugguucuggggagagacuagacgugcaggagaaaggagaggcugccacauggcaugagugggucagggugggcuccacgcacucuuuggacggcaggagcauaaaaacaaggccugcugcacccagcucucuuccaugccgcuuccugaacagguaagagaccggugacugaaggucagcuggugucagggacgcccucacccacaccacaaaugagccaggugcugcaaacugcuggucccagcccuguacggaaacuuuccaccccaccacgcaggccagcggcacuuccagaagauacuugcaucaggggguguucuggcagcauaccaaacacagauucaaggccuuaggcacaagcuaugugguuuaaacaauuucaagggcuuauuguacaaauugaugucccgaucaaggaaaguguaccccauaaucaguucaccugucccagugacccaaaaucuaaaagggacaugugcccugagagaagagaaagcgcuucugaaaaagaaugauaaaucaggccagggacaguggcuuggcacuuugggaggcccagguaggaggaucacuugaggccaagaguucaagaccagccugggcaacauagugagaccccaucuguuuuuuaaauuaaaagcaacaaaaauuaaaaaucaaaacuaagaaaaagagaaaagaaugccaaaucaaacggcucucuagacuuugccauucaauccuuccagguauccaguagaccagggugccaagggguaggccacgaggcugcaggcaugcagggaaagccucuaggcgaaucagucccucuccugacugggccgguaagacccugcugggaccuggaaugcuaugaggccucagaaacauccauuugcgaagguacaggccaaagagaguaauucuuccacagagaaacaucuggguaguagacgugacaccagggcucuacuugaaagcaacgagaaaaaugucuucuagaacggacacuuugcaccacacgcagaggcugcuuuccagggacugaaaggaaaggggaccgggcgaaaggccuggugggaagcugacugcucacggacccggcgcaccccagggcucccaguccaucagagaaacccagcuagagacagggagcagggcgcggggcaggaaugcagcagggccucugagaaagaggcaggcacaggaggugggcuugguggagauacggcagagaugcaagaguggacgacaggcuuggaacugggccugagaggaggaaaaagcuggaagcagccggagcggcagcucuucaugcacaggauggcguggcgcguaccucugcuggguccuucccacaaggguggagggcugaugcugcucacgugaacucccuuccaucugugacuggcucuugagcguggaccuuccacucacugccacuucacauuacaaagguucucaccuucaaugugccccgggcaaguaggauuccucuacugacuggcugcccacuaugugccaggccccagggagauaggggaaccagccagguagcccccagucuuaggaaacauguucuugggaauaggggaagcagcaggcagagacauauacauauacacacacacacacacacacacacacacacacacacacacacacacacacacagaugaaccugugucacgacagagaggcagaggcaacagagaaacagccuacgcaaaugcugagguugacacauaaaggauggaggagccugaaacgcugcugggcgugggaacaagaggagaccacgggggcuccuggggcaagcaacccaggggccugaagucaaaugugcucuuguagaggcugaacccaccauucacagcacugcccaccuugguuaaaggccugcugcccccacagcaggagcgggcucugcuccgcccugcccagucacacucagcauguggcacagcaagguccaccugugcugguguccaggagcacagaccuaugggggauguggggcgcuggaggcagucugugcgguggaagaaaccugccuccccguuugccaagggagcugugcugggguuuccacagcagcacuccguuuucaacuguggguccccucacaagacggugccaggcagggcaggcaaggucuagguaggcaaaaauggcaaaugggguuuuucuuccaugugcugugucuaggggaaaccagcauguccaggcccuuggcagccagggccauucuccagagcagcuggacccaucuaccgcaccgcccgcgcccauggugcggcacugagaacucacaguaugcuccacagacauggccuuucaggaccacuauggggacccuugauccgucugaugaaucucccccaagacuugagggucugcagccaguccucuuaagaggaacuagagcacgccagagcccugggugcaggaccugcugcacucccagugguggugcagacagggcuguuacccccaggacacaaaaacucagucucaugggcauccucaacccaaccagcucccccagcugaugaaccugaaucucaccgucucuccuuucccucugccagcccugggguaggucuccucuugcaaaaagcacuagcugaggagaccacuuccuacacuucgcugcggaaagaugaaacaucuaaaauucucagcuugcaggugcacacacgucccguaaagucacaugagcaauacuucaaacccuauaaauuacugagcagugccacagagagcagcgauggccggaaagucauauccaaacgugcauugagagcacgcacgccagcaugcuacuggagaagcauggcacccgccgggcguggugccucacgccugugaucccagcacugugggaggcugagacggccggaucaccugaggucaggaguuugaaacaagccuggccaacagggcgacaccucaucucuacgaaaaauacaaaaauuagccagugguggcgggcgccuguaaucccagcuacucaggaggcugaggcaggauaauugccugaaccuggggguagaggcuguagugagcugagauggcgccacugcacuccagccuggguuacaggguagacucucucucucaaaaaaaaggagcauggcauucaaggcaaaccggcgguuacacaucuaacuggcagccuuuaccugccucaacccagagcaugacaucagagagauacucucggcagacacucuucaccgcaaugacuccccauaagcacaauccccuuccccaggaucuuucaaaaaaaaaacaacaaaaacccaguucaguucaacugcucugucccuugcucaccuccuuugaguucaauagcuccggcaaguaucacucaggaggacuuugggguguuucucccgaaacacucauaguuuuuccaacggcaucaacugcuaagaaaaccccaccuacccauaccuaggaucauagauaguacuaccuuccccucaaccugaaggccacauuaauuuaauguacaaaaaagugugcuggcuuugucagaaguugaggugcccaccacagucuuuucagggauauguccaaagaggccuggcccagcuggugcccucuccagaggucaggcucuaggaccagcauaaaaaugccuaaaacauccaaaaccagauggaaaauuuccucauucuuuucaguccaaaaaccugacaagaguggaaacccacgugguuucugguugaguguuaacuugaguaucacuugaagacggcaaagacaaggacagacauuaacccuucauuccuagaaccuaaaaacacugggcgcuggaccuuucacuacaacccaaacaaucccaccagcuggccggccgagggccacggaaacccugcuggcagcuucuggagcugccucugcucauucucgauuucuggcucuuucucuccaaucacuaugggacugaacccaaaacaagccucucauucuccugcaccaucccuaguaacaaaucacuaagucagucccacacagagucccuccuuuccagcaccagucuaugucaggcugcugggcaggaugccccgcgacgcucugcuccaucauacucacgucuauuuccccaucaucgauuucuccaucaucguccucuuucuuuuucuccuuggcagccuccagggauuccuuuucucccacacucugaacaccagccuuccccuccucccugggagugccuucgccuuucuccucaucauccucagcccccgcuuucucagccucguccuccuggacggcgggagcuggcuccucaggaaccuccucaucguagucuagcucaugcucauccagcucccuggugacugaggaggccucaucccuaaggucgcuuguccggucuuccuccccuucgucccccuccuccucgcagggggagcuggucgggccccggcucagcucauucaccucugaguccuggucuugggauuuaggcucacuugcccgguccuccucgucggagugauuaucuuccuccuccuggcucggcccccuggcugcacuuuccucauccuccagaucagaagcccucacccccgccccguccaaauccugaucggacccgcugucccucagaaugucaucguccgagagucccuguggcugcucuucauccucuggagagugaggaucccguucagggcucucggccacauccaucgguacccacgguucugcaaaagagagaauacagauugacagccuuuagcaaaauggaaaacaaaccuugucccuacuuuccuggccugaagcagcaggacuuccauccugcuuggucccacacggcccugccccaaaucccacacuccacucugcagagaaagacaggccauaacuccacuccacaaggcuagacugcucagcuaagcuggguguuaagugccucccguuuuuggcaaucuggcaaaaugagauguggcagaaggagacgcagccuggccuagcccuuccccgcucaagggcagcccacacgaguuaacagaaagugaguaacgauacggaucgcaaaggacagcugugugaauucuuagaggaguauuuacuuuugaaauuaaagauaaacuguaucauggaacgaggaagcaaaacugcaggcccagaucucaccauuuuucuggagucauccugaagcaggaaccugggccagccuucggcaguguccaagucuggagccuuuucuguuacugaacacacuucucgaaggccagccucugagggccuccgagaaucccuuggcugcccuuuagcaaugcaggcucagagcccugccugcguguucacuggccccuccagcaggugucgagagggcuguguucacccgcucagcaacucacacuccuaaguugagaaccccucuucccauacagguagcugcugucgaaaagaacucuggcaggaaacuugacacacuuaaguaccgcgcguauguaaaagacgaggcuggccagguacgguggcucgcaucuacaaucucagcacuuugggagguugcaacgggaggaucauuugagcccagcaguucgagaccagccugggcaacauggugagacccugucucuguaaaaaaaaaauacuaaaauucaggccaggcgcgguggcucacaccuguaaucccagcacuuugggaggcccgaggcagguggaucaugaggucaggagaucgagaccauccuggcuaacacggugaaaccccgucucuaugaaaaauacaaaaacuuagcugcacgugguggcaggcgccuguagucccagcuauucaggaggcugaggcaggagaaaggcgugaacccaggagguagagcuugcagugagcugagaucgcgccaccgcacuccagccugggcgacagagugagacuccgucucaaaacaaaaacaaaaacaaacaaacaaacaaaaacuaagucacagagugugguggugcgugccuauauucccagcuacuugggagucugacgcaggaggaucgcuuaagcccaggagguggaggcugcaguaagccaagacugcaucaaugugcuucagccugggcaacagagugagaccaaucuccaaaaaaaacucaaaaaacaaaaaaagacggggucacuucagacuucauuccuauuuuuacuaauccagauuaaauuauaaaguuaauauuuucgaguuucccuccucaaaaacucauagaaaguacacugcuacccaugcuuuaaaaguggacgguguuaagacggguaggaagguguagaacggcaacaccugccuggcaaacacuugccacaccaccacuaccagggcagcuagucaccaccaagugaguguggagcagcagggacagugccaggucagcggucacuugacuguucagucugugaggcuguuaaaauaacguaugucacggucacacugcucggcaucucggcaaggucuggaaacagauuauucaucucaagauaacuacggacgcagcaagucauacacauacacauuuauaugucuuguaucucaaauaaccauacacacuaaagauaaaaauauucaucuuuuaaauuuauacuuuuaauacaaccuguuuaaagaugcacaguaucaagaauugguaucaaccuacaguuaaacauuuuuuuuuuuugcuguuaauggaaaucauuaagauuaaguacacauuagaggccgggcacgguggcucacgccuguaaucccagcacuuugggaggccgaggcggguggaucacgaggucaggagaucgagaccauccuggcuaacacggugaaaccccgucucuacuaaauauacaaaaaauuagucgggugugguggcgggugccuguguucccagcuacucgggaggcugaggcaggagaauggcgugaacccagggggcggggcuuggagugagccgagaucgcgccauugcacuccagccugggcgacagagcgagacuccgucucaaaaaaaaaaaaaaaagauacauuagaacaaauuggucaggugcggugguucaugccuguaaucccagcacuuugggaggcugaggugggcggaucacuugaguccaggaguucuagaccagcuugggcaacauagcaaaaccccaucucuaccaaaaaaaaaaaaaaaaaaaaaaaaaauuagcugggugugguagggcaccugucgucccagcuacuugggaggcugagauaggaggaucaccugauccuaggagguugaggcugcaguucagccugggugacagagugagacccugacucaaacaaaaaacaaaaaagccaaaaaaacccaaaucuggccaggcgugguggcucgcgucuguaauccuagcacuuugggaggccaaggcagguggaucauccgaagucaggaguucaagaccagccuggccaacauggugaaacccggucucuacuaaaauacaaaaauuagcugggcaugauagcaggugccuguuauccaagcuacuugggaggcugagacgagagaaucgcuugaaccugggagacagugguugcagugagccgagaucacaccacugcacuccagccuaggugguggcuaagcgagacuccgucucaaaagaaaauucaaaucauuuaaaauucaucacuuuauaaaaacuaaaugggccaagggugguggcucacgccuguaaucccagcacuuuggaagacugacgcggguggaucaccugaggucaggaguucaggacaagcccggucaaaauggugaaaccuugucucuacuaaauauacaaaacauuagcugggcaugguggugggcaucuguaaucccagcugcucgggaggcugaggcaggagaauugcuugaacucgggggggcggagguugcagugagccaagauugugucauugcucuccagcaugggcaaaaagagcaaaacuccgucucaaaaaaaaaaaccuaaaugguuagcaauaacauagauuuacaaaccaaccaauccauuccaagucacuuaaaagcagacaguucugaaaaugauucacuuuuugguuuucuaaguacacuauucgguuacuauccagagacaggacuacugggaggaauuauuaaaaagucaguccuaagccaggagugguggcauguaccuggaaucccggcuacuugugugguugaggugggagaaucacucgagcccaagaguucgaguccagccuagauaacaugguaagacccucgucuuuuuauuaaagguaguccuaaacugguauacacugcugaaaaugggaaagucaaggagcugauccccaaacaguaucacaggggcgcuugaugcacagagcauuucugcagcccaaggcaacaaaagcaaggaugaaaagcaccaaggcugcuaaggccucuacgcacugacuguucaagacugggagucugcgugggguuguggcaguaagucaccgguggcaaacuggcaauucucucucuugccuagcuaucgacauuaguaacacccuauacuaucuucguacacuuuuuauuacaauguauaaacaucuuccucauagaagggcagguaguucacaucuccccagcugccuaagcggagcgccuggugcccaguaggaugccccaagcugaacccagaccugaaauaugacaaauucugauucucauguuuuauaguuuaaugucaaccuuggaaacaaagugaucucuuaaauaaaccaacuuuuaugcaaaacuaaaugucuccucaaacuaguuuuaaaaaucacacaauuggcugggugugguggcucaugccuguaaucccagcacuuugggaggcugaagcgggaggaucacgagguugggaguucgagaucaccuuggccaacacagugaaaccccugucucuacuaaaaauacaaaaauuagcugggcaugguggcacgugccuguagucccagcuacucaggaggcugaggcaggagaaucacuugaacccaggaggaggagguugcagugagccgagaucaugccacugcacuccagccuggguagcagagugagacuccguuucaaaaaauaguaauaaggugcuacgaagggaaacguggccucuuaaguguagacaaugaaaugagaaguguagacaggggugucaguagaagagucucaacugauacccacguuugcaauuugugcucaguuuggucuucuuacacuaucuauaacugaagauuuucagcacaauuuagaacuaaauccuuaguccucugauccaccagaugggugaacuugccuaaggaaugaaauaacaagugcccaucgucccgucuccguugcuuucugcauuuggcagaugauacuugauagauauuuguugaauacaugacaaaaaacucguuaauugaggaacuaccuguugccuaccagaaaggaauuuaaaauaagugcccaggaggaggagguugcggugagccgagauccugccacugcacuccagccugggcaacagagugagacuccgucucaaaaaauaauaguaauaauaaagagcaggugcuaccucccuuccgagcagccccucugggaggaugcacagacuccaacggcacugcugaaaugcagagcguuuggggaccuucucauugcgaaugaccuuccaagccuaaagaagucuucugguauucuuagugguggcaaaucuuccuccucucaagcuagucacuuugauaaagugcugcaagucagagucucaccugauaaggugagcuaccaaccacguaaguaaacuuuuggucaaaccuggagggugacuauugaauaagacugauuuucccauaugacuacauuuuuacuaccacaacaggaguucuaaagagauucuggcaaagaagcaccgaugaaauacaagcacauuuugggacaauuacuuucaacagagcaguaccuauuugaaugccuaaguucugguacaucugguuaaaauucugacucauaaccucauggacuuaaaauaucuaaaugaacguuaucaagguuggugacagaccccacgugcaaagugaccaagcgugaccacuaaacuccuugauaaagagguacucaccuugagaugcucuguagcugugacaaaauacaaaucucuguaaacacgauguaggccauagguuaacuuaccuguuugcuuucuggagugacuccacaaagcuuucuuacaauauuucagcaugucccaccuacaacgggagaggaguuuccggcuuugggacacauuugacugguuccagggcuggcugggcuccauacugcccuuagauaguaaaauuaucaggaaaagacucuccucccaaagcugggaagcgggauucagccgaggucaaaccucacccggauaaucccaacuacugaacgggaaaggacuacucuacagacaacaggcuggaggugagucuaacaggagacaugaugagcaccuugcuacaccccaaacgguacuucagaugccaaacacucucuucuuccauuuucccaaaugggucugaagaaugaccuacucuugcaaaugaguuagcguuguucgaacaaagcucauuuaaaacggccacucuacccggcaaacucaguugucauaaaguauucaggaaaaauguuuggcaggaguaaggcuguuaaguuucaguucuuccagcauuauagcugcaguuggucuauauaaaggacccagcaccucugaucuccuaauccaaggggcaaggaaguuacauacuccuaagagaccggcgcgcgucuuggggcaaucacugcgcccaaccugugcacacuuugaagcugcggagcaaguuccaggagguucauaaagagcucaaaguucuccgaagagcccagcagcagcccgggaugaccuacucuggaggugaaucugggcgccucucaccgccccuuagccggcggcacacaugugccacgcgaguggcccggaagagaaaugacagcuucaggaaaauaaacucugccgcggggcgcggaggcagcgcgcgaggagcucgggcgcccagggcgccccaggaccgcggggccggcuuacggacggaacucgggguggugccugucucaagguccccuucccugggcccgagggccacgcuucggccgguggguccgcacggccggaggcgcgccgggcucccgggccucccucccgcggccgccgccgccgccucggcggccuccuccucccgccgccgccggcccggccucccgccgcccucccggccccagcuaaccucagcgcuagggcggagaggaggccacggcuccccuggagucggagcggcguggagaagacgucccuuggcccuuccgcucuucacagguucuggcuccaggcucgacacgggcggaacaaacgggcuccacuacccgcgggggccggccauugugcgacgucaucaggccgcgacgguaguccu

SEQ ID NO: 191987 - RNA, 1882 nt, Homo sapiens
gccaggugugcaggccgcuccaagcccagccugccccgcugccgccaccaugacggugagccucuccacaugccgcucggauggaugcugcuuggaugugcagccuggcauggaagggcugggguucucugagccugggaggaggguguugggauggggucugggaaaccccucagucuggggguaggggaggcagcugcagauccucggagcgcuggcaugcugggugucuugggcugaagggcuagccucucugggcuucaguuuccccaucuauagagggagggcuguacuccaucuuuccgcugggaacaaggaaagcugagguggaagugaggugcccccugcccugggcaccuccuaaccacccaccugccuguuucaccagcuccuccccggccuccuguuucugaccuggcugcacacaugccuggcccaccaugaccccucccucagggggcacccccacagucacgguaccccacacugcuacucggcugaggaacugccccucggccaggcccccccacaccugcuggcucgaggugccaagugggggcaggcuuugccuguagcccugguguccagccuggaggcagcaagccacagggggaggcacgagaggcccucagcuacgacccagugcccggugcugcggccggaggagguguuggaggcagacacccaccagcgcuccaucucacccuggagauaccggugaggaccuggggauuccgcuguggcguggggcugccccuccccuggcggggcccugacugcccggagagcucucugggccuuggugguucucaccugucaagugggcguggccaccugagcucccucccuccggcccuccugaccuggacggcugagcugcugcuugcggcuggccgugcccugccucccacuguccuagguggccaggguccccuggggaaauucugggcccgucaccugagcuccugcagaaguggggcugggugaugaaguggaagggaggcuccuagaggccuccggacccugcucugugcucuuggagggcccuggggagacguggauuaccaccacaugugagcccgacugcaccccaagcccguguggcucagcccucgcugccucagguccuauccugaguacacggagaggggcccugaggggagaggggccuccaggaggacaggguagggccagagacucacugugcaccccgucccgcaguguggacacggaugaggaccgcuauccacagaagcuggccuucgccgagugccugugcagaggcuguaucgaugcacggacgggccgcgagacagcugcgcucaacuccgugcggcugcuccagagccugcuggugcugcgccgccggcccugcucccgcgacggcucggggcuccccacaccuggggccuuugccuuccacaccgaguucauccacguccccgucggcugcaccugcgugcugccccguucagugugaccgccgaggccguggggccccuagacuggacacgugugcuccccagagggcacccccuauuuauguguauuuauuguuauuuauaugccucccccaacacuacccuuggggucugggcauuccccgugucuggaggacagccccccacuguucuccucaucuccagccucaguaguuggggguagaaggagcucagcaccucuuccagcccuuaaagcugcagaaaaggugucacacggcugccuguaccuuggcucccuguccugcucccggcuucccuuacccuaucacuggccucaggcccccgcaggcugccucuucccaaccuccuuggaaguaccccuguuucuuaaacaauuauuuaaguguacguguauuauuaaacugaugaacacaucccca

SEQ ID NO: 191988 - RNA, 1882 nt, Homo sapiens
uggggauguguucaucaguuuaauaauacacguacacuuaaauaauuguuuaagaaacagggguacuuccaaggagguugggaagaggcagccugcgggggccugaggccagugauaggguaagggaagccgggagcaggacagggagccaagguacaggcagccgugugacaccuuuucugcagcuuuaagggcuggaagaggugcugagcuccuucuacccccaacuacugaggcuggagaugaggagaacaguggggggcuguccuccagacacggggaaugcccagaccccaaggguaguguugggggaggcauauaaauaacaauaaauacacauaaauagggggugcccucuggggagcacacguguccagucuaggggccccacggccucggcggucacacugaacggggcagcacgcaggugcagccgacggggacguggaugaacucgguguggaaggcaaaggccccagguguggggagccccgagccgucgcgggagcagggccggcggcgcagcaccagcaggcucuggagcagccgcacggaguugagcgcagcugucucgcggcccguccgugcaucgauacagccucugcacaggcacucggcgaaggccagcuucuguggauagcgguccucauccguguccacacugcgggacggggugcacagugagucucuggcccuacccuguccuccuggaggccccucuccccucagggccccucuccguguacucaggauaggaccugaggcagcgagggcugagccacacgggcuuggggugcagucgggcucacauguggugguaauccacgucuccccagggcccuccaagagcacagagcaggguccggaggccucuaggagccucccuuccacuucaucacccagccccacuucugcaggagcucaggugacgggcccagaauuuccccaggggacccuggccaccuaggacagugggaggcagggcacggccagccgcaagcagcagcucagccguccaggucaggagggccggagggagggagcucagguggccacgcccacuugacaggugagaaccaccaaggcccagagagcucuccgggcagucagggccccgccaggggaggggcagccccacgccacagcggaauccccagguccucaccgguaucuccagggugagauggagcgcuggugggugucugccuccaacaccuccuccggccgcagcaccgggcacugggucguagcugagggccucucgugccucccccuguggcuugcugccuccaggcuggacaccagggcuacaggcaaagccugcccccacuuggcaccucgagccagcaggugugggggggccuggccgaggggcaguuccucagccgaguagcagugugggguaccgugacugugggggugcccccugagggaggggucauggugggccaggcaugugugcagccaggucagaaacaggaggccggggaggagcuggugaaacaggcaggugggugguuaggaggugcccagggcagggggcaccucacuuccaccucagcuuuccuuguucccagcggaaagauggaguacagcccucccucuauagauggggaaacugaagcccagagaggcuagcccuucagcccaagacacccagcaugccagcgcuccgaggaucugcagcugccuccccuacccccagacugagggguuucccagaccccaucccaacacccuccucccaggcucagagaaccccagcccuuccaugccaggcugcacauccaagcagcauccauccgagcggcauguggagaggcucaccgucaugguggcggcagcggggcaggcugggcuuggagcggccugcacaccuggc

SEQ ID NO: 191989 - RNA, 7761 nt, Homo sapiens
cgcgccuagcagugucccagccggguucgugucgccauggggcagaucgagugggccaugugggccaacgaacaggcgcuggcguccggccugagugagugcacgucagggacgguggaggcugcagccuggaggggugucccaagaccccagccgggaccucgggcuacuuacaggguggggaaguggggcgccaggcgggccaggccgggccggggucaggccaggagggugcggggaacgggggcgggacccucaggccgcgggcuggaaggaggaguucugagacccccaguaauucccuugcagacccugcggagcgcggcgccccucccccauucccuucucucggucccccgacuccgcgaaggaggaaguugcagcgcaggggaagaggcgguucagccccggugguuuccggggucaccgccccgaagcccccgagugggggcuccggccugggcaucgggagaagcuccccugccccucgguagccagcuggccuggaggucgcucucccugggcuugggguggggaaugggcucaugcccuggggcucagcccuucucaucuggagucugcgcuggaggcggucugagauuucacaaggcgccgaaaccacccagugacggcccugcccagcccagcugcacaggcacuuugcucuuggggugggauggcacagcccccagucacccuccugugcauuugcucagagguucuggugagggcagcggacuccauuuggaaauggacccucucgggaccagggccagggagugucuggcccagcacgggugaggcugggcucaggcgaggucugagggcagaggcaccacugcagcagcuccaggaaggaccugcaccgggggaggagugccugggaagggccugggggcugagggugaggaggaggggcccgcugccaccacuccccuggggcucugagcgcccucccuguugucuggagggugcguggcagcuggagugggagcagagaccucagggugggagggcuggaggacggggcccugcagccuguccugugcccaggaaagugaccgccugcuucgagucagcggccaagaagucggugggucaguucagacagcucuccccagagcugccccgugagacucacccugccugccccgcacucccuacaggaaguagacggacugagggcacccagcugggagccaggagaccugggcucuagucuggccuccugcugaaacccuccaggggcuccuggcccgaagaguuagagccagacuggacgcccugcacugcccgcccuggccucccggcucuccggcccccuccuccagcugccgugcuuccuuucuguuccuagaucuccugagcgugccccagggccucggcacaagcugcugcuucugcagagccucauggcugucucauuuauuucucaauucaaaugccaccugccuggggagguccuuccagaccgugcagccccaggaggcagcuggcccggagacagcagggccuugacaaagaguccccccuguacacagcaggugcucuguaaauguggcugggugccagaauacguccucagaccucccugguggcaccagcggcagcuuugcacccucuuucggauggcaggcucgggaccaggacgguccccaaagaugcauggacaauuggcugaguagacucaaggacacugcccuccccuccuccgacgcagacagacaaacccagagaguuaauguguagcugggcucaaaccaaggauaggaaaucuuccaacaagaccauguggagacaaaaacagaauggcuggcagggcaagguggcuacaccuguaauccuagcacuuugggaggccaaggcgggcggaucacgaggucaggagaucgagaccauccuggcuaacacagugaaaccccgucucuacuaaaaauacaaaaaauuagccggguaugguggcaggcgcgcauagucccagcuacucgggaggcugaggcaggagaaucgcuucaaccugggagguggagguuguagugagcugagaucacgccacggaacuccagccugggugacagggcaagacucugucuccaaaaaaaaaaaaaaaaagaaauaaaauaguaggaaggaccaggcgccguggcucaugccuguaaucccaacacucugggaggccaaggcgggcggauucccugaggucaggaguucgagaccagccuggccaauguggugaaaacccugucucuaauaaaaauguaaaaauuagcugggcaugguggcgggcgccuguagucccagcuacucaggaggcugaggcaggagaauugcuugaacccuggaggcggagguagcagugagucgagaucgcgccacugcacuccagccugggugacagagcaagacuccgucucgaaaaaaaaaaaaaacaguaagggggaauauuggacaauacccccccaaaaaugugcagaaauagccauaucagacgaaaccgaaauuaaggcaaaaccgcugacggguuaagaggaacuccguaucggggggaaaaagacacucccccaagaagaugcagaaaccacacucggccuguuagcuuucagugcaucaaacaaagacucauggugacaaggggguccauuugggggucccagagcccacuggggccugcaggucgggcuguccuuggccacuccugggacccagagcccgggcauguccagcacccccuccgccagcccgugcgccacaggcucugcucuucaccagugcagaggggugccuccuggggguguccccgacccugucacugugcuguggggauggguagggggcagcucuggguggccugguggcccacaguagguagagaagggggguggcccaggcccccgggacgggagccccacagugccugacccacuucuccccgcaguccucaucaccgggggcaucguggccacagcugggcgcuucacccagugguacuuuggugccuacuccauguauccuuccaccugaggcuggggugggcggggaacgcccagggcagagcuggggagccacuucacagugagcuguuugccuccgcuccccaccaccgcagccaggcugggacacagggugggcugugcacggguugggcagcccaggccccagcagccaggccccucgccaggaccauguggcgaucagcggcagacccgccagucuaaguccuggugaguggugggcagggggugucaccagagggccagggccagcacugaggccucccuguuggacugcugggauccccucugcccgcuccugucagucaucccccuugaccggccccucuaccuccucugccccaucucagcccugccgcccagccggaccuugcgacaaggagcacugggcaggguggugggagggagggcgugggcagccccgagugccagaccuguuggaaccucccguggcugccuccuggcucugugaccucaggcaguggcugcccccgaccuuuuuugagacagggucucgcucugucccccaggcugcagugcaguggugcagcugugacucauggcagccuccaccugggcucaggccacccucuuaccucagccucuggaguagcugggaccacaggcacacaccacugcaccuggcuuuuaaauuuuuuguagagaugagggucucacuauguugcccaggcuggucucaaacuccugggcuccagugauccucccgccucagccucccaaaaugcugggauuccaggcaugagccaccgugcucgggccccucucuguguugucuucaguaaagggaguucccuguggccccucaggcugagcugggcuguuccuuaaccacauggcuucaguguggcgggcguguuugugugccugcuggaguacccccgggggaagaggaagaagggcuccaccauggagcgcuggugagucuccuccugcucuggggucucuccgggggcugcggggcccaggcagggcucacaggguuggguggagcuugguuucucacuuggaggcuccggaaccaacccuuuggugcuuguggguaaaccaaggccggugccugcccgguguguuuugugggaggaaagaggccugggugcccugggguggucagcagggcagcaaaggagucccgagugggagaggcccagccgcgccgucucgccuuccucccucccccaggggacagaaguacaugaccgccguggugaagcuguucgggcccuuuaccaggaauuacuauguucgggccguccugcaucuccugugaguccccgucccgcacccccucuagggcucaggagggcuuggagccgacccuccccacugucccaccggccgggcugccuggacaggagccacccccacuuaccucaguguuuuuccaaacaaaaauucgggucccuggcucuggcagggccugugucugcugucuagugugcaggauuuguaaggauccacuccaaauccgaggagcuccgauccgucgccagggucuggggucagcaugcacugcuggggggucuugccugggcuuccugguaggguggaggguuccgugcugugugucugcugguuacugccggcugaggccaggacacccacacguggcugcuuccuccgagcaagugcaccagagccgcuaguguccacaucaaggcugagaacacccaggaccgaaacaagccccgguccgcgcacguccccugggucugcagucugccuuguccugagacuuuguggccuuggcccccagaccuggggcuccguuccccuuucugagugcccuucugugucccugccucucacccgcugucccccaggcucucggugcccgccggcuuccugcuggccaccauccuugggaccgccugccuggccauugcgagcggcaucuaccuacuggugaguggcgcccucugaggucggccccggccacccccauccccagccccugcccugacacccucggacacgcauggcccuugaagccggcucuguaggcugagccaaggcugggagcaagugugagccugggcgugugcucacagcacggcggggacgcagcgguugcugcugccauuuuuggcgugucuagugugucgggucauuuccuugcauuuccucauuaacccgcaccacagcccugggagggguacugggguccccacuuuacagacaaagaugcggaggcucagggaggugcugugacuggccuggggucacgcagccggccgaagaccgugccugcgcuugggucccauuaucaggcuuuucucaccuaaacccuauucgcgcugauucaugggcggugccaggacgcagacauuuucuuaaacugccgacaccugcguuugguuuaugacugcugcacccuguuagaaggcugcccaucccaugggauacagugaucucucugagaggccagggaugggugggaggacagggcgcagccuggccaggccuugggugaaaugcccucugccugcccugggcuccggaacagacggcugcaggccaccucucacugcgggggucucuggguggacagagcccucagacuuugcuuauuuaaauccuuuuguccauagagccaagucccuccugcccgcagaggcaacugcccuccccuugcugugcgucuucuagugugugugcgugggaaaggugcagcacuuucuguguacgccuuccgcguauggaaguggaguucuguuucaagccucacugaccugccaccggcagaacucuccuuuagaaccccuuccuguugccaagugcucaucugggcuguugcuuuguuuuccgggggccacccgcaucccccccgucucccugcugccacgcacagcuaguggcuccuggagaccucgggaggaauuccuugugcuaaacccagagaggaauugcugggucaggcaucagccucugcaccguucacccugccgggcucagcugcuccucagcagacaacccaccaccagccauguggccccaucucucccaccaugcacuaggcuuucucccacgcuugccaguuucacagcacgagcuggccguguggagcuuggacucgcccuucucugacuguggauuugagcuguuggaguuucuucucccuugaguugccuguucaaauccuuugcccauuuuucuauugugguuuuuguauuuuucuuuuucuucuuuuuuuuuugagauggagucucgcgccaucgcccaggcuggagugcaguggcgugaucucggcucacugcaaccuucgccuccuggguucaagcaauucuccugccucagccucccgaguagcugggacuacaggcacgugccaccaugccuggcuaauuuuugguauuuuuaguagagacgggguuucaccgcguuagccaggauggucuggaucuccuugaccuugugauccgcccgccucggccucccaaagugcugggauuacaggcgugagccaccgcgcccggccugauugucuuuuucuuaaguugcaggaaguccacauauauuuuagcuauuuagccuuuguaaccuuuaaacacuggggaugccuucaugcuuucuggugagggucuguuaacuuggcgcguggaguccuucacugcacggaagagcagagguuucccuguucaccugcucuauggucugugcuuugugaaaacaccuuucccuggcccuggguccugccuucacguuccugccuuuucuucuaucagccuucuaguuuugcuuuucagaauggaauguuuccguuuuggagucagguaggaucacacauguccaguuucucuuucuguucaugacguauaugaugugacauauuuuuccaccagauauuaugggauagaagaugaaaagcacacacucccagguccacuugaccuguugcaguggaaccuccgggcaugggcccaggagucuguauuuuuaguaaaagccaguggaaucccguggucuucaagcucuccccccaccacccccaugugcagaaaugccugggcacccuuggggggcugccggccagcgugggugaauggcgcccaccagacggagcagggccugcuacucuccugggccaccccuccugcuggaccucgggccugccucccugccuucccugcccuuggcaccuugagaggagaauuugaguacuagaauuugcaucugggaguguccaccacgggaucuuccagaagcccagggguucgggccccacuccuggcaugaagaaauagcuugggcuggugucaggccgacccagguccuggcuguguggccucgggcgcgucacuuaaccucucugaguggcagucacaccauccugcgugggauucagacuugagccugucccagggccccuagcggggugggccuccggggagggagggagggagggagggcgggcgcuggggcgcggcucaacccuucagugccccgcaggcggcugugcguggcgagcaguggacgcccaucgagcccaagccccgggagcggccgcagaucggaggcaccaucaagcagccgcccagcaaccccccgccgcggcccccggccgaggcccgcaagaagcccagcgaggaggaggcugcgguggcggcggggggacccccgggagguccccaggucaaccccaucccggugaccgacgaggucgugugaccucgccccggaccugcccucccgccaggugcacccaccugcaauaaaugcagcgaagccggga

SEQ ID NO: 191990 - RNA, 9898 nt, Homo sapiens
uagagaugcucugagacauuuuauuuaaacuuuuuuuuuuaaaaaaaagacagcaauaauuaaugccaagaacagaaaagaauguugacguguugcccggcccgccaagcgggccccugcccaggcccccaagcucugccaccacuggggugccguccccucccgcagcggggcacagucagcuuugaaggugacagcgggccaaggccaggacucuggguggaggaggccccuucucugccggccccgccucugcugggagcagccacagccuguggcuggggugcugggauuucuuccuggucaucaaagagaaacguacaaaccucaaggacccagacacacaguggguggccagggcagaccccacagcagaccccauggcucgccugagcucuggcagcugccccacugcuccuuccauccuugccccaaucccccaaugcuuguuuugauuguuuucuuaaaaaauauaauuuuguaaauguuccauaaaaauacuauuauuccuagucaaacacagauauugcaauaugaagaguaacugcucugucuuugcucuauaaaacgugaaaagauuaucacacuggauaauauagaaaagaugccaggguuccuaaguaucacaaaagccaguaccaaaugcgcaagguggaaguggggccggggcagggucgggcugggcagggcagcagccuggguuccucccggcucgacugcggagcgcgacucgcgcgucggucccuucuucccacgaggggguaucauggcuuugaagagacggcggcagcuccaggucccagcguccagcccugcccaaguaggccgccugcucggccagaagcaccgaagaacccagcgacgccggugggaccaggcggcccugcucuggcggccucggcggcuggcccguauucaggcccggaggcucggccccggcuccccuucugcgcgggugcaggcuccuccugugagcucaguccggugaggugcgcucccgagcaggugccaggugcgacacaggagcggggacaucccugaccccagacgcaggcggguggcugcgcuucccuucaguucucagagagagacagggccagagcagccuggaaggcggccuccucgucaauacuguaguccuggagacaggaaggagagaugcaccgggcucgagggagacaggaaggagagguccccucugcccaucacccacacaggcguguccacccuuccugccucccuccagcaggacacaggaaggacccagcuccacuguccccacaggcucggggccugcacgguccucuggggggugagaaggugaagguguguccaucacccgcuggguacgggggcacucggaauggauggcugcugguucaggucggacucuaagcccgggguuuccgaggugagcaggccggccagggcucccugaccucuaacaauuuccauccugaggcaggcggagcgugggucccggacgacuggcagagggagugacagccaucgccaggacuguuagccagggccaggaaugaacagggcggcgcagggaggggccgcaccaggagugaggaguuugugcgagggucugcaggcccgggggccaggugugugccugacccgcggcgggugggaaaaggagacagggcuggaguguucgauguugaugaaaguccuucccgcgcucucuagaaagcuuccagaaggaagccuggcucacccucgagggguucuguggggugggcaggcagggaccugcccugugcgguccauguccccgagaggccugggcacccucuaguggccacucaaacucagcugccaucacuccccaccugcaggcagcccccacagaaccugggggaauguggccaccugaaacgaggcuucuguuucuggcuuccucugaacccugcggacccugaggcuggcgaggggcccgagcaggaggaggguggaugaggagggcgugggggaggacggugcuggcgggaugccuaccacaaaggugucguaggagaacuugugucggugaagcaggugcugcaggaaguuggcgcucuuguagcugggguccccccagggcauugccgagcagauggggcacaccuggaacaggcacuggggucaagccgagccggaccgcggagaggcgggguagccgcaguaggacugggggcccuccacugagccccgucagugcugccucagccugggaaggcaccccagaccuggaggcgcgugucccggugacaagcgaguuauucagugcgcgucacccugaaggacucauggacacuccccgguuuccgccaggugcugcucgggcagccaaguucccacccugggucccaggaggccuuuguggccugggcacccccggacucgccgcgagcaggcuccugggccuuguacugucccccacaggccuccccuggcgcaggcgucgcuuggggcaggcacugcucaccacgcgguuggggucgcugcgguggcuuuccacacagugcuucaccagcuccugcugguccagguugcgggcaccacaguacgggcaggcgaagguggaccuguuggggauguugcuggcggggcggggguagagugaguggcacggcuaggugucuaggggcucugccuccccgcuucucucaaacacaggcguggccccaggccugcccucuguaggcugcaagagcguggcaguggcugggugccccccgugccucugcacgccauggccuccugaggacacacccaggacccucguccaccccacacaacuaggccagccaaacggcagagacucugcuggcgcugcccuggcaggagccgucucucggcccauccaccugcugggaggcgaugugugggcccggccugcgcccuccuccugcuccccacagcugagcugucccuaccccagggggccugguggguaugccagggagggcagcacaggagccuuccugcaggguggcaaggaagguccacuuccccagaguggacccggccccgggugacucccccagccucucugggauggggcacugcgcuugcucccagaacgaggaaaccgccgaggacaguuccucucccuugcccggcagcgugccuaccuggggauaggcugugaugugggcaccacggggacgaacuuggggcaguuggccaucugcuccuggaccuucaggcaggacgaaaugugcacucucaucuuugccagggucaccuaggagacagggcagggagggcaaggcgguccugagaaucuggaagggccguccuggggaggccgagaccucagguguccaggaccagagaacuguaagcaagcgucuguguugccagcagcagggggacccggucccuucugcugcuaaaacaaucucaggcacugagcagccacuacuccauggccaaaagcaagucacugcaggacaaucuggccgagggcagaaaccuggcuggagaaggguagcgggaaacagguaaggagaucucuggcgccugcaggaguucaaauacuugcuccagaaaaaggaagaggccaaguggaggccacucagaaaugccccaggcuggggacagacgcuucgugugacugaggggcaagcuggggaugcuuccguggaggcagggcgccauccuccacccacagcacacccacuguccagggcaacaggcugcaagaucgcaggugucugaggcccuccuggacucaagcucggcacccagcucugccuaagggcugcuggacuccgagggaugcaccacauuccagcaaggugccgggagacacagccgcaucugaagacccagauuagagaacggagcugcugugggauacgggaggccgcucugcaugugaccgguucugauccuuucuggcugcccaggagagaagaacucugagcagggagagacgggaggugcccaagcacccaagaccacagccugcucagccgcaccacucuggaguccagggcagccccuggacaucuggaccuucgaccucgaggacaaaccaccgaggggccacguacuagugugagcgcuucauagaacuuauucaccugagauguggcaacgucgggaaacgcaaaugcaaaaucaccucuagcugcucaguccuccggaagccacugaaagaacggggcgcuggcuggggccucuccacccugaagcggaugugccagggagggccacggggcacgggccaggcaccaggacaggauggacaugggggccaaugaggcccaugacaagcugcaggcccuuacgcugcucugauguggguguggcagugcccaucagcccggcucuggcccuccuggcagcuggagggugcucggcccuuagauguccuugacugugcccgcggcccuugugaccuuggagcccccagcgccguccccgguaucggcuggcaggggaaggcugcauugggaagguuucagcucagcccccugguccuuacccuggccacaacccacguggguuccccuggcccgggcuaggcggcucugacagugcuacccccaccgggcuggcccccccgucagccgucaccacaggaagugagagaugaagacgggaggggagggaggcgccggggcuggcuuccuggugcaggagcagagaccgcgauuacucaacaggaaagagagagggccccggcccccacccucugcagaacccgugggcugaggcugcccaucaagugaccccggcuccagggcggcccaagcaggcggguaccuuuuuguugcagccucgacagggcgcuuuguaggaugagagcugcuucuccacguggguggccuuguccaccuucuuggggucgaagggcaggcggcagagugggcacagcggggauggcaccugcaggcagggcuggagacacuccccgcagaaccugcagggcacaggggccugagugccagcccgccccucgggucucccgaaccgcaggccuugcucggggcccuucuuaggacccagcauuugugggguccacaggggcagcucccccuaccgcugucgccgucucuggagauggucacuccuauguccggggcccaccagcuggaugggccccaucuggcuaaaggguggccccggucccuccugacaguaggccccugugguuucuggcuagcggcagagccgucacuauggcuguccccgcgagugggccagaggagcucccauaggcaggaggccccagcucgggcuaccagguucacguucacguggcgacaacaccugggugggcuguggggcgcagggacagcccggggacucuggaaacucucccggcuccacacucugggggauaaaaccucaaacaaucgugggaaaggaaacggccaggccccaggggcuccagaugcacuggacagggaagggccaaagcuagccaaguggcagcacauccugaggcuggguggcagucaccaggcuugggacagcuucgcaggcaggaggggguccugcuccaucugggcggaggcucggguccugggcacccaugggcccuggcucuuggcacugccccuggggacaccacaucgugaggacagacugagcgucccacagccccgugcgcacuccgggcuccagcagcaggggcuuccuugggcucgcacacccucccgcucugcagacgcacacagcccuuggaggggugcaccaccagccagugggagcaccaggcgcgagagcccccagugcaaacacagagaaggagcuuaauacuggggcagccacaucuggccuugugaggagcacuguggggacagcugagcugcggcgaggagcuggaacugaggcagagccccccagucccaggaaggcuacagcacccggggguguagcuucccuucucccuggcaaggccacagggcugguacaggagccccacuggacagaggggcugugggcaggcccuggguucacaaacgacucagcugaauucagggccagaguccucuuugcugucaagagauuuccacaucccucaagaaaaggcccuuucugcaaggaggaagucugagggccucaggcaaagguggccaagcaggcaucuuaagucccuccugcugucccccaggcccucuuugccaccacuggauucccacagagccaccaccuggcugguggcucccacaugaaacuucgugugagagaaagcgggacucagcuugagacccgucagaaagugaacaagccuuuuucugcagaguaaagaggucgcucacuuuacccaccucacccgaguucucaccaggcgccccagcagauauuuccagggucaucccuggcacugaccccuggauuugagccgggggggccgccuacuucacccguucacgggaggaaggugcuggcaagaugguccaccuggggaggccucaggggacccccauacucaggcacucauggcaggagaagcggaagcagcucaggugcccgucgguaaacggaugaagagacggcguggcgugcacacccauggaaagggcguucggccgggaagaggcgugcagccccaccacgcaccggaaggccuggaaaacagugcagggcagacagcaagcacgucccacccgugucguggggguccacucacgcucaacguccagcagagagaaacccagugaccagaaagcagacgggugggugccaggcgagggggagaguccuggguuucuuucuggagugggaagaaucuucuagaauugcaucgauuguugcauaauugcaaacacacuggaaacgacuggauggugcaccuccugagugaacccugagcugccagagaccaggccggggcucggcugcacagcacggccacgggcugaggggaaggaaaagggucccaggcagagcuugggaagagaggaaaggugcccagaagguuggcugggaggaagacagccucguccuccccggaaggacucaggaaagacacaagagggaacccagcccgacuggcagggcggcugggcccgaggagcaggaggcagaacgaggcacccacagggugggugcucuaucggccuaguuuccagugacugccagccugguguucagagagccagcagccgggaguagugcccgcuucccccacaggaaguuccugucugcgcccacccaggggcuggugcugagcagcuucucagcugaaggaaguggcugagggcgaugggugugggggcgucgacagccuuacaaagggaggggcgaucgcgcacuggcccucccagcaggcacccgggacugccaaugugucucccacacuggccgcugcacaagcugagaagcugggacggcccgugccucagggaucugccuggcuggcaggccagcacccucagcaagccccacagcuguccugcacgaguggaggcugcucacacagcccuuccaggcagguucgugaucacgcguguccuggcccacaggcuucugguuacagagguggcucacugcucagacuguccccuggcugagaacagcuccugcugggcccccagggggccuccugcgcgagggcuagagcagggugcaugcccccacacugggauacucuugccaugagagaucuacccuggaggaggaaguugcucugguuggggagcuugcggaggggacagaaccagaccagcaacaaacuuccgaagggaaccugaagagccuuuaaacuuucuguggucauuugcaugcaugccuuagcaacaccaacaagaaacaaaguuagaagcagagagagaacagccagaaaacaaaagccagcaggaaaagucggggagaaaaaucuuugaaaggcaaaggcugugugaaaagcucuugcaggacccgcggugagacuaggauggucgucauucuaccaagaaaagcauggcagaggggaguuuuauaggaaagaugcuccacaauuccaugugguucugcauucuguguuauggaaacuacauuuuaggaaaagacauauuugaaaaagaagggcaaagaccaauuugugcagguuaggaaaguggagaugcuguggccgaccacacggugaagguguuggcacccaaagccuacgggaggcuuuucuaaaacaaggccuaagucaagccucacagcgcucaguaacagaugagaaggugcggaacacaccuucaaacacccgcuaccugcucacaagaaggaaguccugccaggcgcgguggcucacgccugucaucccagcacuuugggaggcugagacgggcaggucaccggaggucaggaguucgagaccagccuggccaacauggugaaaccccuugucuacuaaaaauacagcaauuagccgggcgugguggcgggugccuguaaucccagcuacucuggaggcugaggcaggaggaucacuugaacccaggagauggagguugcggugagccgagauggcgccacugcacuccaggcugggugacaagagcaagacucugucucaaaaaaaaauauucccguucagaggcugcccccccaaaaugucacggcuaagugagauggaggagcaggggcagagccuguagcagccucacaagagaaguagguagagcugucccagcgugggcaggcgccugugcugccugacacagguaaugaaggcagcucugcauccugacacuggcccugccaccuccgugggugaccagcacacauccaccuagcagucccagcucccucuguaccaggagccccugaagucagcugacuuugcuugcaaaauguucuagagccuccuaccagucugggugcaccccccuccacuccaccaccucagcagcuuggaugucugcggggaagcccuccugcucucucucuccccugccacugcugauuuugcucaagagcuguauuauucagcacuuaggagggagcagacacugaucuaggcuuccucccaacggggcuggcagcuccagaauacuugagcacagcuccccgccaggagagccacguccuccaguuucuguuccugaaacacccuggaggagccggcugugagcccuggugcagcuggaaaccccagcaagguggucagugucugcuccucuguggaccagccugccuggcuacucagugaucggugugacucaaguucuccuucaaacaaaacuaagaacaucagacuccaaacaagccccucuaaacuuuagggaacuccuuuccucuguagucaaaacaggcagacagcggguccgaacaagaguugauagcaaaaacuacaaguuauuuauuuacaacugcccauuccagccgcacaagcccaaauccaccaccacuggcggagcgguggcaccugcugcccucugaguaccggagcgcccgccgcagccgccggggaccccgagcuugggcagggccgcaggucgcccggugaaccgaagcagcagucggaccgggcgccugcggcuggcgcgaaggaggcugggcgggggaugaacgcgcccagagggcagaggcggcgcggcacagggaaacccggaccccacgcgccccgaggccccggcgccccgaguccccgcgcgcccaguccggagcugcaccggggcggccgccggccucgcgaccccucccgcggcggggcacggcccccuccccgcggccccugggcgggcgcgcucacguguggccgcagcugccgauggccacgggccggugauagaccuccaggcagauggggcagguguacugcgccuccaggccgcugucgccgcccgccggcccggccggcggcugccgcugcugagccgaggccaccaggcugcggaacauagccaucccggggccaggcccgcgccgcccgccgcccgcuguccuggcccgggccggcccgcuagucacagcc

SEQ ID NO: 191991 - RNA, 9898 nt, Homo sapiens
ggcugugacuagcgggccggcccgggccaggacagcgggcggcgggcggcgcgggccuggccccgggauggcuauguuccgcagccugguggccucggcucagcagcggcagccgccggccgggccggcgggcggcgacagcggccuggaggcgcaguacaccugccccaucugccuggaggucuaucaccggcccguggccaucggcagcugcggccacacgugagcgcgcccgcccaggggccgcggggagggggccgugccccgccgcgggaggggucgcgaggccggcggccgccccggugcagcuccggacugggcgcgcggggacucggggcgccggggccucggggcgcgugggguccggguuucccugugccgcgccgccucugcccucugggcgcguucaucccccgcccagccuccuucgcgccagccgcaggcgcccgguccgacugcugcuucgguucaccgggcgaccugcggcccugcccaagcucgggguccccggcggcugcggcgggcgcuccgguacucagagggcagcaggugccaccgcuccgccaguggugguggauuugggcuugugcggcuggaaugggcaguuguaaauaaauaacuuguaguuuuugcuaucaacucuuguucggacccgcugucugccuguuuugacuacagaggaaaggaguucccuaaaguuuagaggggcuuguuuggagucugauguucuuaguuuuguuugaaggagaacuugagucacaccgaucacugaguagccaggcaggcugguccacagaggagcagacacugaccaccuugcugggguuuccagcugcaccagggcucacagccggcuccuccaggguguuucaggaacagaaacuggaggacguggcucuccuggcggggagcugugcucaaguauucuggagcugccagccccguugggaggaagccuagaucagugucugcucccuccuaagugcugaauaauacagcucuugagcaaaaucagcaguggcaggggagagagagagcaggagggcuuccccgcagacauccaagcugcugaggugguggaguggaggggggugcacccagacugguaggaggcucuagaacauuuugcaagcaaagucagcugacuucaggggcuccugguacagagggagcugggacugcuagguggaugugugcuggucacccacggagguggcagggccagugucaggaugcagagcugccuucauuaccugugucaggcagcacaggcgccugcccacgcugggacagcucuaccuacuucucuugugaggcugcuacaggcucugccccugcuccuccaucucacuuagccgugacauuuugggggggcagccucugaacgggaauauuuuuuuuugagacagagucuugcucuugucacccagccuggagugcaguggcgccaucucggcucaccgcaaccuccaucuccuggguucaagugauccuccugccucagccuccagaguagcugggauuacaggcacccgccaccacgcccggcuaauugcuguauuuuuaguagacaagggguuucaccauguuggccaggcuggucucgaacuccugaccuccggugaccugcccgucucagccucccaaagugcugggaugacaggcgugagccaccgcgccuggcaggacuuccuucuugugagcagguagcggguguuugaagguguguuccgcaccuucucaucuguuacugagcgcugugaggcuugacuuaggccuuguuuuagaaaagccucccguaggcuuugggugccaacaccuucaccguguggucggccacagcaucuccacuuuccuaaccugcacaaauuggucuuugcccuucuuuuucaaauaugucuuuuccuaaaauguaguuuccauaacacagaaugcagaaccacauggaauuguggagcaucuuuccuauaaaacuccccucugccaugcuuuucuugguagaaugacgaccauccuagucucaccgcggguccugcaagagcuuuucacacagccuuugccuuucaaagauuuuucuccccgacuuuuccugcuggcuuuuguuuucuggcuguucucucucugcuucuaacuuuguuucuuguugguguugcuaaggcaugcaugcaaaugaccacagaaaguuuaaaggcucuucagguucccuucggaaguuuguugcuggucugguucuguccccuccgcaagcuccccaaccagagcaacuuccuccuccaggguagaucucucauggcaagaguaucccagugugggggcaugcacccugcucuagcccucgcgcaggaggcccccugggggcccagcaggagcuguucucagccaggggacagucugagcagugagccaccucuguaaccagaagccugugggccaggacacgcgugaucacgaaccugccuggaagggcugugugagcagccuccacucgugcaggacagcuguggggcuugcugagggugcuggccugccagccaggcagaucccugaggcacgggccgucccagcuucucagcuugugcagcggccagugugggagacacauuggcagucccgggugccugcugggagggccagugcgcgaucgccccucccuuuguaaggcugucgacgcccccacacccaucgcccucagccacuuccuucagcugagaagcugcucagcaccagccccugggugggcgcagacaggaacuuccugugggggaagcgggcacuacucccggcugcuggcucucugaacaccaggcuggcagucacuggaaacuaggccgauagagcacccacccugugggugccucguucugccuccugcuccucgggcccagccgcccugccagucgggcuggguucccucuugugucuuuccugaguccuuccggggaggacgaggcugucuuccucccagccaaccuucugggcaccuuuccucucuucccaagcucugccugggacccuuuuccuuccccucagcccguggccgugcugugcagccgagccccggccuggucucuggcagcucaggguucacucaggaggugcaccauccagucguuuccaguguguuugcaauuaugcaacaaucgaugcaauucuagaagauucuucccacuccagaaagaaacccaggacucucccccucgccuggcacccacccgucugcuuucuggucacuggguuucucucugcuggacguugagcgugaguggacccccacgacacgggugggacgugcuugcugucugcccugcacuguuuuccaggccuuccggugcgugguggggcugcacgccucuucccggccgaacgcccuuuccaugggugugcacgccacgccgucucuucauccguuuaccgacgggcaccugagcugcuuccgcuucuccugccaugagugccugaguauggggguccccugaggccuccccagguggaccaucuugccagcaccuuccucccgugaacgggugaaguaggcggcccccccggcucaaauccaggggucagugccagggaugacccuggaaauaucugcuggggcgccuggugagaacucgggugagguggguaaagugagcgaccucuuuacucugcagaaaaaggcuuguucacuuucugacgggucucaagcugagucccgcuuucucucacacgaaguuucaugugggagccaccagccaggugguggcucugugggaauccagugguggcaaagagggccugggggacagcaggagggacuuaagaugccugcuuggccaccuuugccugaggcccucagacuuccuccuugcagaaagggccuuuucuugagggauguggaaaucucuugacagcaaagaggacucuggcccugaauucagcugagucguuugugaacccagggccugcccacagccccucuguccaguggggcuccuguaccagcccuguggccuugccagggagaagggaagcuacacccccgggugcuguagccuuccugggacuggggggcucugccucaguuccagcuccucgccgcagcucagcuguccccacagugcuccucacaaggccagauguggcugccccaguauuaagcuccuucucuguguuugcacugggggcucucgcgccuggugcucccacuggcugguggugcaccccuccaagggcugugugcgucugcagagcgggagggugugcgagcccaaggaagccccugcugcuggagcccggagugcgcacggggcugugggacgcucagucuguccucacgaugugguguccccaggggcagugccaagagccagggcccaugggugcccaggacccgagccuccgcccagauggagcaggacccccuccugccugcgaagcugucccaagccuggugacugccacccagccucaggaugugcugccacuuggcuagcuuuggcccuucccuguccagugcaucuggagccccuggggccuggccguuuccuuucccacgauuguuugagguuuuaucccccagaguguggagccgggagaguuuccagaguccccgggcugucccugcgccccacagcccacccagguguugucgccacgugaacgugaaccugguagcccgagcuggggccuccugccuaugggagcuccucuggcccacucgcggggacagccauagugacggcucugccgcuagccagaaaccacaggggccuacugucaggagggaccggggccacccuuuagccagauggggcccauccagcuggugggccccggacauaggagugaccaucuccagagacggcgacagcgguagggggagcugccccuguggaccccacaaaugcuggguccuaagaagggccccgagcaaggccugcgguucgggagacccgaggggcgggcuggcacucaggccccugugcccugcagguucugcggggagugucuccagcccugccugcaggugccauccccgcugugcccacucugccgccugcccuucgaccccaagaagguggacaaggccacccacguggagaagcagcucucauccuacaaagcgcccugucgaggcugcaacaaaaagguacccgccugcuugggccgcccuggagccggggucacuugaugggcagccucagcccacggguucugcagagggugggggccggggcccucucucuuuccuguugaguaaucgcggucucugcuccugcaccaggaagccagccccggcgccucccuccccucccgucuucaucucucacuuccuguggugacggcugacgggggggccagcccgguggggguagcacugucagagccgccuagcccgggccaggggaacccacguggguuguggccaggguaaggaccagggggcugagcugaaaccuucccaaugcagccuuccccugccagccgauaccggggacggcgcugggggcuccaaggucacaagggccgcgggcacagucaaggacaucuaagggccgagcacccuccagcugccaggagggccagagccgggcugaugggcacugccacacccacaucagagcagcguaagggccugcagcuugucaugggccucauuggcccccauguccauccuguccuggugccuggcccgugccccguggcccucccuggcacauccgcuucaggguggagaggccccagccagcgccccguucuuucaguggcuuccggaggacugagcagcuagaggugauuuugcauuugcguuucccgacguugccacaucucaggugaauaaguucuaugaagcgcucacacuaguacguggccccucggugguuuguccucgaggucgaagguccagauguccaggggcugcccuggacuccagaguggugcggcugagcaggcuguggucuugggugcuugggcaccucccgucucucccugcucagaguucuucucuccugggcagccagaaaggaucagaaccggucacaugcagagcggccucccguaucccacagcagcuccguucucuaaucugggucuucagaugcggcugugucucccggcaccuugcuggaauguggugcaucccucggaguccagcagcccuuaggcagagcugggugccgagcuugaguccaggagggccucagacaccugcgaucuugcagccuguugcccuggacagugggugugcuguggguggaggauggcgcccugccuccacggaagcauccccagcuugccccucagucacacgaagcgucuguccccagccuggggcauuucugaguggccuccacuuggccucuuccuuuuucuggagcaaguauuugaacuccugcaggcgccagagaucuccuuaccuguuucccgcuacccuucuccagccagguuucugcccucggccagauuguccugcagugacuugcuuuuggccauggaguaguggcugcucagugccugagauuguuuuagcagcagaagggaccgggucccccugcugcuggcaacacagacgcuugcuuacaguucucugguccuggacaccugaggucucggccuccccaggacggcccuuccagauucucaggaccgccuugcccucccugcccugucuccuaggugacccuggcaaagaugagagugcacauuucguccugccugaagguccaggagcagauggccaacugccccaaguucguccccguggugcccacaucacagccuauccccagguaggcacgcugccgggcaagggagaggaacuguccucggcgguuuccucguucugggagcaagcgcagugccccaucccagagaggcugggggagucacccggggccggguccacucuggggaaguggaccuuccuugccacccugcaggaaggcuccugugcugcccucccuggcauacccaccaggcccccugggguagggacagcucagcuguggggagcaggaggagggcgcaggccgggcccacacaucgccucccagcagguggaugggccgagagacggcuccugccagggcagcgccagcagagucucugccguuuggcuggccuaguugugugggguggacgaggguccuggguguguccucaggaggccauggcgugcagaggcacggggggcacccagccacugccacgcucuugcagccuacagagggcaggccuggggccacgccuguguuugagagaagcggggaggcagagccccuagacaccuagccgugccacucacucuacccccgccccgccagcaacauccccaacagguccaccuucgccugcccguacuguggugcccgcaaccuggaccagcaggagcuggugaagcacuguguggaaagccaccgcagcgaccccaaccgcguggugagcagugccugccccaagcgacgccugcgccaggggaggccugugggggacaguacaaggcccaggagccugcucgcggcgaguccgggggugcccaggccacaaaggccuccugggacccagggugggaacuuggcugcccgagcagcaccuggcggaaaccggggaguguccaugaguccuucagggugacgcgcacugaauaacucgcuugucaccgggacacgcgccuccaggucuggggugccuucccaggcugaggcagcacugacggggcucaguggagggcccccaguccuacugcggcuaccccgccucuccgcgguccggcucggcuugaccccagugccuguuccaggugugccccaucugcucggcaaugcccuggggggaccccagcuacaagagcgccaacuuccugcagcaccugcuucaccgacacaaguucuccuacgacaccuuugugguaggcaucccgccagcaccguccucccccacgcccuccucauccacccuccuccugcucgggccccucgccagccucaggguccgcaggguucagaggaagccagaaacagaagccucguuucagguggccacauucccccagguucugugggggcugccugcagguggggagugauggcagcugaguuugaguggccacuagagggugcccaggccucucggggacauggaccgcacagggcaggucccugccugcccaccccacagaaccccucgagggugagccaggcuuccuucuggaagcuuucuagagagcgcgggaaggacuuucaucaacaucgaacacuccagcccugucuccuuuucccacccgccgcgggucaggcacacaccuggcccccgggccugcagacccucgcacaaacuccucacuccuggugcggccccucccugcgccgcccuguucauuccuggcccuggcuaacaguccuggcgauggcugucacucccucugccagucguccgggacccacgcuccgccugccucaggauggaaauuguuagaggucagggagcccuggccggccugcucaccucggaaaccccgggcuuagaguccgaccugaaccagcagccauccauuccgagugcccccguacccagcgggugauggacacaccuucaccuucucaccccccagaggaccgugcaggccccgagccuguggggacaguggagcuggguccuuccuguguccugcuggagggaggcaggaaggguggacacgccugugugggugaugggcagaggggaccucuccuuccugucucccucgagcccggugcaucucuccuuccugucuccaggacuacaguauugacgaggaggccgccuuccaggcugcucuggcccugucucucucugagaacugaagggaagcgcagccacccgccugcgucuggggucagggauguccccgcuccugugucgcaccuggcaccugcucgggagcgcaccucaccggacugagcucacaggaggagccugcacccgcgcagaaggggagccggggccgagccuccgggccugaauacgggccagccgccgaggccgccagagcagggccgccuggucccaccggcgucgcuggguucuucggugcuucuggccgagcaggcggccuacuugggcagggcuggacgcugggaccuggagcugccgccgucucuucaaagccaugauacccccucgugggaagaagggaccgacgcgcgagucgcgcuccgcagucgagccgggaggaacccaggcugcugcccugcccagcccgacccugccccggccccacuuccaccuugcgcauuugguacuggcuuuugugauacuuaggaacccuggcaucuuuucuauauuauccagugugauaaucuuuucacguuuuauagagcaaagacagagcaguuacucuucauauugcaauaucuguguuugacuaggaauaauaguauuuuuauggaacauuuacaaaauuauauuuuuuaagaaaacaaucaaaacaagcauugggggauuggggcaaggauggaaggagcaguggggcagcugccagagcucaggcgagccauggggucugcuguggggucugcccuggccacccacugugugucuggguccuugagguuuguacguuucucuuugaugaccaggaagaaaucccagcaccccagccacaggcuguggcugcucccagcagaggcggggccggcagagaaggggccuccuccacccagaguccuggccuuggcccgcugucaccuucaaagcugacugugccccgcugcgggaggggacggcaccccagugguggcagagcuugggggccugggcaggggcccgcuuggcgggccgggcaacacgucaacauucuuuucuguucuuggcauuaauuauugcugucuuuuuuuuaaaaaaaaaaguuuaaauaaaaugucucagagcaucucua

SEQ ID NO: 191992 - RNA, 8896 nt, Homo sapiens
gcccucgcgcugucgccgccacagucugcgacgggacccggcgugcccaugugucaggugggcgaggacuacggggagccggcgccugaggagccgcccccggcgccgcggcccagguaagagcuggcggccggacccgccaggccgccccucgccuucccgccgcacuccugccccgaagggucccggccgggcuugcuccgggaagccccgcguggagagcgggaccucgcucccuagcacucggggaaugccugucaagcggugacggccaccuagaaggggacuuacuccacuggcucgcgccucucauccuagcagccacuggggacggcucugccgcugacagugcuguccuuauucggagagaacuggugccgugaagcugucucgccuccccgugucagccuugggagacugaaaagcggccuuuaugugcccccugagccggcuuuucuaggcuaaacauccccccagagccuuuguuuuucuugaaguuuggacagaacacaagccuggguuuguguguguaccgaggugccuuucucugacccaacucagggugagaaacaggagcugucuccccaaagcccacuaggcguggggaagaugugaucuguguuucucucuucuccccccucccaucuccaaagccgugagcagaagugugugaagugcaaggaagcgcagcccguuguggugauacgagccggagaugccuucugcaggugaggccuggagguggcugagacccuggcaaacauggccucgcuagcagacaggauagccgcaacuugugaugcuuuguuaauucuuuuuaaaaacauguacuuacuuuauuccugcuccugauggggucccucgugccccugguguugaaguggaggcgaaagcauugguuuccugcuugggaaaguuucccaugagcuagccacagauccccugaugagguuucugauggaacuuauggggacaguuggaaguggggccguggugucuagacugggauaagcuguaggaggaccaggcguuugggggcagcuggaauacaucuaggggcggaucagagcaucuugggaacuuggcagauggucugggugaaaguuuuuaaucucgugugagaugcuuguuucaucuguggcaggauagaggcuuggaagaccucuagcuuucccccaggcgcuugucaugucuuucuuggcuuguagccauuguauuguucaguuguuuccacuagacucauagcucccugaagggaggaccaggucucucuccuuuuagcccucuuaauucccagugguggugcgugguuuuuuuguuguuguuguuguuuuuuuugagauggagucucccucugucacccaggcuggagugcaacagcuggagugcaugaucccagcucacugcaaccuuuaccuccuggguucaagugauucuccugccucagccuccugaguagcugggauuacaggugccugccaucaugcccggccaauuguuuuuguauuuuuaguagagacaggguuucaccauguuggccaggcugguuucgaacuccugaccucaagugauccaccugccucggccucccaaagugcugggauuacaggcaugagccaccacaccuggccaagauagguacuucuuuaaccacccaggagcaucugaaauugccaagaacaccaggcugccggcagaauucacugaggagaggcugcuguggcuguaugcuaggcccuuguggccagaagggcuuuugcugugcuugcuggucccaaggaacaguggggagccggcucucuaggggaaggccuuaggaaucuacaucgagcugggauccccagggaucauucaggucagcacgugggagaaaccuuggccuucccugacccacaggggacagcgugguuucaggagcccagacgcagcauguacacguggacccaccacgcuugaaucccagcuggugguguagggcgcagaggcucuccugguccacagugcggaggugaagcccagcaccugugucuccuuguaugagacuccccacgcccaaagcuggguccugggggucacuucccaugucccagccuugauacuugccaguuaccugcagucccucaccuggcaucuugcuguuaaacacagacuugcuuuacugucuguaaaggaaccacaggggggucauucggccucuuguacgugguauccauucaacguagggagggacugcugugcacaucaagugugucugacaggaaggaagagacuuagagccccaggugcagggugacucuugcaguggcauuguccgcucuguaccgggugcugcucuucacccugccugccaggauugcaggagagcuuuaaaaugcagacuccuaggccucaccccuagacaauuugacuuaauugguuugugcaauucuaacauacagccagggccaagaaccccugacguagugagccagagucagauggcuggaaaguuuauuaugaacaaagauuacagcugggcgcaguggcucauaccuggaaucucagcacucugggaggcccaggcaggagggucacuuaaggccaggaguuugagaccagucugggcaacaaagugagaccuugucucuacaaaaaauacaacaauuagcuaggcaugguggcauauaucuguaaccuguaguccuaucuaccuggguggcugaggcagaaggaucacaugaaucgaggaguuugaggcugcagugagcuauaacuguggcacugcacuccaaccugggugacacaucgagacccugucucuuaaaaaugcaguucccaggccuggaaguucugauucugugggguuaggggaggagcccaggccacucugugagugagccucuuagccauuccuggcccaguugagcccagcacacuaaagaugccagcucuggggccccaggauacugagcccucgcuguggcccaccccauuuccgcacuucaccccaaagagguggugucucugcaugguggguccucgcuguggcccgcuccauuuccacguuucaccuccaagagguggugucuguauguggugggucuuuuuuuauggggucuggguuggccuugcccuguacgugccuaagucuguccacuccaccagcugggcccuucugagcgccuguggggaggggugccggggcucugcccucguuugcuggaugcagccuccguggcugugcaguuuguaccuggucgugggaggggccggugagccucguguucacccugaggaagccacugccagaggggccaaccccgccccuuucaccagucucuggacagagccuggaugugaagaugcugcuuuuaaagauggagauuggcaaaggacgucgucaccuggcagcgccucaggacgcugcucacugugcggguagcaggcgguucccucaucucaggucuguguugcagggacuguuucaaggccuucuacguccacaaguucagagccaugcugggcaagaaccggcucaucuuuccaggcgagaagguagcgucuggguccugggggucugacugagcagccuggccccucgaggucccugcuugucccucccacaggcagccuggccugcugcagcccgccagcuccuccuuggccuuugaggacagacucgauguccuagauguccacgagguggggugucugccuguguuggaggugcggugcccugagugauguuuuuucucccccaggugcucuuggcguggucuggggggccuucguccagcuccauggucuggcagguucuugaggugcguguucaccaccccgugggcccgggcugcugggcugagcuucaggcugggggccucccuucucagccugcugaggggcucuugguuggggcuagagagcaguccacccugcggccuggacacuugggggguucucagauguguucacaacaggugcaccaaucaggagcugaguccacagugugugugugcggcccacucucagauguguuuacagcaggugcacaaaucagaagcuggguccacagcgcgugugugcggcccacucucagauguguuuacagcaggugcacaaaucagaagcuggguccacagugcgugugugcggcccacucucagauguguuuacagcaggugcaccaaucagaagcuggguccagagugcgugugugcggcccacuugacuucuguccauuugcucaaccugcguagaaacacagucaguggaaagcugcaucuuggcucagccaugugugacccgagggaagauugggaaaggggcggggguuugccaggagaagcaaagggagcagcguuugagguggaggcggcggcccgcgcagggagguggaggcgggcuuaggcugcacacagggcucggcugggggugguggggcugugcccguggccugucaagggucagcucaggaagucugaggcaggucgggcuucucaggagggcacaggagcgggaugugcuugguuucucugcacucucaugagaggugcagaccggaggaggcuguuucugugggcugggugguugagaggagaggggucggcuuugccggguugaggagugggguguuggucucaggaugggcgcauggcacaacacugcugaaauuaguuuucuguuuucugagguccccugaaccugccaggaggguguugugagggaacuggcccagcccucuguguaacgcuggugcugcccuuccugugcccagcggcgccccugccucuugcaggcuguugguuucugcuugugagagcaagugcuuccuuaguggucagaagcgugugggaugguggcacaguggccccguaacccagcccccucuccuggggcguuguugggacauccaggaccagcuggugaggggcauguuuuaccagggggaugaagacccccaggcuacccuuuaaaauaagucgggcgugcggccucgccuacugggccugcccggcaccugagucugaauggcuuuguccaauaaacgcaauggcaggggaagaccacuucaccuuccaagauggcauuaaauccagaugaagaauguucugagcuggaaaaguguccuguggcuuauggcugggggcugagucccugcugcuucucccucuagggccugagccaagauucugccaaaagacugcgcuuuguggcaggagucaucuuuguugacgguauguggggccauugcuccuccuagucccuggccacuugggguaagcccugcggauccucccucugguguggacccucccucuggugccgguccucccucugguaggauguguugagcuacuggugcugccccugcacugagggccugguggggacaucucccugaaggaggcagcagauguauccaucguuagguggcaucacuguuccuggaaucuaagaacauccuuagaaagucgggggugggagcaggaguggcggcugcccagcccccaucacggggucuggggacaaagaagggcaaguuaagugcugauggugagcgggggcccaggggccgacuccccgacccuugcuccugcagaacgaacuccugggguguugacuguagcgcugaggucagccgcaagagagaaaccccugcccaaaggaaaauggccgacaccccacagcuccgccaggaagcaccgcccugcggagcgaggccucgaaggguuuucccagguggagguggcccugcagccugcccugccuggcuccucucugagcccugacucuuucugccuggguuuuucagagggagcagccuguggccagagccuagaggagagaucaaagacccuggccgaagugaagcccauucugcaagcaacuggguucccauggcaugugguggccuuagaggaggugggagggcugucccuggaaaggggucccggaggugaccccuggggggcaccugcccgugucccagccucacuggccucucccucaucccagaaggcggggcugucgguggggggugggaggcaccugcccgugccccagccucacugccgucucccgcaucccggaagguggggcugucuguggggggcaccugcccgugucccgggccucacuggcgucucccucaucccggaagguguucagccugccaccgucggugcuuuggugcucugcccaggagcuggugggauccgagggggccuacaaggcggccguggacagcuuccuccagcagcagcaugugcugggggccgggggugguccuggcccgacucaaggggaggaacagccaccccagcccccgcuggacccccagaaccuggcaagaccgccugccccugcccagacugaggcucuuucccaacuguucugcucagugaggacacugacugccaaggaggagcuucugcagacccugcggugaggccccgagagccccccuuccccgggcccugacccccacucaugccccugagagcccccuuccccgggcccugacccccacucaugccccugagagccccccuuccccgggcccugacccccacucaugccccugagagccccccuuccccgggcccugacccccacucaugcccgagagcccccuuccccgggcccugacccccacucaugccccugagagccccccuuccccgggcccugacccccacucauaccugagagccccccuuccccgggcccugacccccacucauaccccugagagccccccuuccccgggcccugacccccacucauacccgagagccccccuuccccggguccugcaccccccaggccccugagacgcucugugcuuuaggacccaccugauccuccacauggcccgagcccacggcuacuccaaggucaugacuggggacagcugcacacgcuuggcuaucaagcucaugaccaaccuggcgcugggucgaggggccuuccuggccugggauacgguaggcaggggccuggguguucaggaggcccauccucaccuucaccccuucggccaccuuuacuggagaguagccucucgcguaucaguccugcggccucggauggugguggggucugugaccuccccuaccuggcaggggaggaggggcaagcacauucgggccuugaccuggaccacacagccccugccucccgcagggcuucucggaugagcggcacggggacguggugguggugcggcccaugcgggaccacacccugaaggaggucgcuuucuacaaccgccuguucuccguuccuucugucuucacaccagccgucgacaccaaggugggccuugugggcugggcaaccucucucaccauugacaccggggugggccaugugggcugggcagccucucacaggcucaggucaccagcacaccuucagugacuccugcuguggcccccagcagugcugcauccucugagcccacccugugccgugagggugugggggugacaggaggaccccacagugggugcacugcugaagcggguucucuggcugccuugagcagucgcagcaaagccagacccaugugggccagcagcguggaacccacggcaccuguccuggggacucugccccagccuggggcuggccucugggcuuucccauagccuccaaucugauugucccuaggccccugaaaaggccagcauccaccggcugauggaggccuucauccucaggcugcagacccaguuccccuccacugucagcacuguguacaggugugggugugugugggugugugcggggggugcgcgggugugugcugugcgcgggugugugcggguggugagcucaccacucgugcucaggccagggcuuaggguggagccccagcccgugugauucaccugcuccucccacaauccggccacaggacaagugagaagcuggugaagggcccccgggauggcccugcugcuggcgacuccggcccccgcugccuccucugcaugugugcccuggacgucgacgccgcuggucuguguuucaugcucuuggggugaugcggggagggagccagggagugggugugggggcucagcagccccaggcuccgucacccccucucugcuugcagacagugccacggcuuuuggggcucagaccuccucgcgucucucccagaugcagucacccaucccccugacugagacccggacacccccggggcccugcuguucuccaggggugggcugggcccagcgcuguggccagggggccugcaggaggugagucccugucccugccacccauggccagcugcauggggcgggagggggaccuguccuuaccccacacugcacggcauugaggugccaaggugggcacacagccagcucugcucccgcagggaggacccccaagccugcauugaggagcagcugugcuacagcugccgcgugaacaugaaggacuuggugaguacgugcccaccuguccugggccgggcuuggggacgcgggaaggccgucaccucguggguggcuugagggggugcuggcagguuucuuggccccucgacaccggccucuguugcagcccucacuggacccccugccgccguacauccuggcugaggcccagcuccgcacacagagguacuggggcccacacugccguggcgcguggguaaggggccucggggcuggugcccacugcagcuuucucucuagggccuggggcuugcaggagauccgggacugucugauugaggacagugacgacgaggcgggccagagcugagcgugaggacgugcuugccgggacagcaggcaguggccaccugguacaccacacuggagccggaaggcaaggacgggggacuggccucugauuguccauuuguauaaauaaaacauuuuuuaauuaa

SEQ ID NO: 191993 - RNA, 8896 nt, Homo sapiens
uuaauuaaaaaauguuuuauuuauacaaauggacaaucagaggccagucccccguccuugccuuccggcuccagugugguguaccagguggccacugccugcugucccggcaagcacguccucacgcucagcucuggcccgccucgucgucacuguccucaaucagacagucccggaucuccugcaagccccaggcccuagagagaaagcugcagugggcaccagccccgaggccccuuacccacgcgccacggcagugugggccccaguaccucugugugcggagcugggccucagccaggauguacggcggcaggggguccagugagggcugcaacagaggccggugucgaggggccaagaaaccugccagcacccccucaagccacccacgaggugacggccuucccgcguccccaagcccggcccaggacaggugggcacguacucaccaaguccuucauguucacgcggcagcuguagcacagcugcuccucaaugcaggcuuggggguccucccugcgggagcagagcuggcugugugcccaccuuggcaccucaaugccgugcagugugggguaaggacaggucccccucccgccccaugcagcuggccauggguggcagggacagggacucaccuccugcaggcccccuggccacagcgcugggcccagcccaccccuggagaacagcagggccccggggguguccgggucucagucagggggaugggugacugcaucugggagagacgcgaggaggucugagccccaaaagccguggcacugucugcaagcagagagggggugacggagccuggggcugcugagcccccacacccacucccuggcucccuccccgcaucaccccaagagcaugaaacacagaccagcggcgucgacguccagggcacacaugcagaggaggcagcgggggccggagucgccagcagcagggccaucccgggggcccuucaccagcuucucacuuguccuguggccggauugugggaggagcaggugaaucacacgggcuggggcuccacccuaagcccuggccugagcacgaguggugagcucaccacccgcacacacccgcgcacagcacacacccgcgcaccccccgcacacacccacacacacccacaccuguacacagugcugacaguggaggggaacugggucugcagccugaggaugaaggccuccaucagccgguggaugcuggccuuuucaggggccuagggacaaucagauuggaggcuaugggaaagcccagaggccagccccaggcuggggcagaguccccaggacaggugccguggguuccacgcugcuggcccacaugggucuggcuuugcugcgacugcucaaggcagccagagaacccgcuucagcagugcacccacugugggguccuccugucacccccacacccucacggcacagggugggcucagaggaugcagcacugcugggggccacagcaggagucacugaaggugugcuggugaccugagccugugagaggcugcccagcccacauggcccaccccggugucaauggugagagagguugcccagcccacaaggcccaccuuggugucgacggcuggugugaagacagaaggaacggagaacaggcgguuguagaaagcgaccuccuucaggguguggucccgcaugggccgcaccaccaccacguccccgugccgcucauccgagaagcccugcgggaggcaggggcugugugguccaggucaaggcccgaaugugcuugccccuccuccccugccagguaggggaggucacagaccccaccaccauccgaggccgcaggacugauacgcgagaggcuacucuccaguaaagguggccgaaggggugaaggugaggaugggccuccugaacacccaggccccugccuaccguaucccaggccaggaaggccccucgacccagcgccagguuggucaugagcuugauagccaagcgugugcagcuguccccagucaugaccuuggaguagccgugggcucgggccauguggaggaucagguggguccuaaagcacagagcgucucaggggccuggggggugcaggacccggggaaggggggcucucggguaugagugggggucagggcccggggaaggggggcucucagggguaugagugggggucagggcccggggaaggggggcucucagguaugagugggggucagggcccggggaaggggggcucucaggggcaugagugggggucagggcccggggaagggggcucucgggcaugagugggggucagggcccggggaaggggggcucucaggggcaugagugggggucagggcccggggaaggggggcucucaggggcaugagugggggucagggcccggggaagggggcucucaggggcaugagugggggucagggcccggggaaggggggcucucggggccucaccgcagggucugcagaagcuccuccuuggcagucaguguccucacugagcagaacaguugggaaagagccucagucugggcaggggcaggcggucuugccagguucuggggguccagcgggggcugggguggcuguuccuccccuugagucgggccaggaccacccccggcccccagcacaugcugcugcuggaggaagcuguccacggccgccuuguaggcccccucggaucccaccagcuccugggcagagcaccaaagcaccgacgguggcaggcugaacaccuuccgggaugagggagacgccagugaggcccgggacacgggcaggugccccccacagacagccccaccuuccgggaugcgggagacggcagugaggcuggggcacgggcaggugccucccaccccccaccgacagccccgccuucugggaugagggagaggccagugaggcugggacacgggcaggugccccccaggggucaccuccgggaccccuuuccagggacagcccucccaccuccucuaaggccaccacaugccaugggaacccaguugcuugcagaaugggcuucacuucggccagggucuuugaucucuccucuaggcucuggccacaggcugcucccucugaaaaacccaggcagaaagagucagggcucagagaggagccaggcagggcaggcugcagggccaccuccaccugggaaaacccuucgaggccucgcuccgcagggcggugcuuccuggcggagcuguggggugucggccauuuuccuuugggcagggguuucucucuugcggcugaccucagcgcuacagucaacaccccaggaguucguucugcaggagcaagggucggggagucggccccugggcccccgcucaccaucagcacuuaacuugcccuucuuuguccccagaccccgugaugggggcugggcagccgccacuccugcucccacccccgacuuucuaaggauguucuuagauuccaggaacagugaugccaccuaacgauggauacaucugcugccuccuucagggagauguccccaccaggcccucagugcaggggcagcaccaguagcucaacacauccuaccagagggaggaccggcaccagagggaggguccacaccagagggaggauccgcagggcuuaccccaaguggccagggacuaggaggagcaauggccccacauaccgucaacaaagaugacuccugccacaaagcgcagucuuuuggcagaaucuuggcucaggcccuagagggagaagcagcagggacucagcccccagccauaagccacaggacacuuuuccagcucagaacauucuucaucuggauuuaaugccaucuuggaaggugaaguggucuuccccugccauugcguuuauuggacaaagccauucagacucaggugccgggcaggcccaguaggcgaggccgcacgcccgacuuauuuuaaaggguagccugggggucuucaucccccugguaaaacaugccccucaccagcugguccuggaugucccaacaacgccccaggagagggggcuggguuacggggccacugugccaccaucccacacgcuucugaccacuaaggaagcacuugcucucacaagcagaaaccaacagccugcaagaggcaggggcgccgcugggcacaggaagggcagcaccagcguuacacagagggcugggccaguucccucacaacacccuccuggcagguucaggggaccucagaaaacagaaaacuaauuucagcaguguugugccaugcgcccauccugagaccaacaccccacuccucaacccggcaaagccgaccccucuccucucaaccacccagcccacagaaacagccuccuccggucugcaccucucaugagagugcagagaaaccaagcacaucccgcuccugugcccuccugagaagcccgaccugccucagacuuccugagcugacccuugacaggccacgggcacagccccaccacccccagccgagcccugugugcagccuaagcccgccuccaccucccugcgcgggccgccgccuccaccucaaacgcugcucccuuugcuucuccuggcaaacccccgccccuuucccaaucuucccucgggucacacauggcugagccaagaugcagcuuuccacugacuguguuucuacgcagguugagcaaauggacagaagucaagugggccgcacacacgcacucuggacccagcuucugauuggugcaccugcuguaaacacaucugagagugggccgcacacacgcacuguggacccagcuucugauuugugcaccugcuguaaacacaucugagagugggccgcacacacgcgcuguggacccagcuucugauuugugcaccugcuguaaacacaucugagagugggccgcacacacacacuguggacucagcuccugauuggugcaccuguugugaacacaucugagaaccccccaaguguccaggccgcaggguggacugcucucuagccccaaccaagagccccucagcaggcugagaagggaggcccccagccugaagcucagcccagcagcccgggcccacgggguggugaacacgcaccucaagaaccugccagaccauggagcuggacgaaggccccccagaccacgccaagagcaccugggggagaaaaaacaucacucagggcaccgcaccuccaacacaggcagacaccccaccucguggacaucuaggacaucgagucuguccucaaaggccaaggaggagcuggcgggcugcagcaggccaggcugccugugggagggacaagcagggaccucgaggggccaggcugcucagucagacccccaggacccagacgcuaccuucucgccuggaaagaugagccgguucuugcccagcauggcucugaacuuguggacguagaaggccuugaaacagucccugcaacacagaccugagaugagggaaccgccugcuacccgcacagugagcagcguccugaggcgcugccaggugacgacguccuuugccaaucuccaucuuuaaaagcagcaucuucacauccaggcucuguccagagacuggugaaaggggcgggguuggccccucuggcaguggcuuccucagggugaacacgaggcucaccggccccucccacgaccagguacaaacugcacagccacggaggcugcauccagcaaacgagggcagagccccggcaccccuccccacaggcgcucagaagggcccagcugguggaguggacagacuuaggcacguacagggcaaggccaacccagaccccauaaaaaaagacccaccacauacagacaccaccucuuggaggugaaacguggaaauggagcgggccacagcgaggacccaccaugcagagacaccaccucuuuggggugaagugcggaaauggggugggccacagcgagggcucaguauccuggggccccagagcuggcaucuuuagugugcugggcucaacugggccaggaauggcuaagaggcucacucacagaguggccugggcuccuccccuaaccccacagaaucagaacuuccaggccugggaacugcauuuuuaagagacagggucucgaugugucacccagguuggagugcagugccacaguuauagcucacugcagccucaaacuccucgauucaugugauccuucugccucagccacccagguagauaggacuacagguuacagauauaugccaccaugccuagcuaauuguuguauuuuuuguagagacaaggucucacuuuguugcccagacuggucucaaacuccuggccuuaagugacccuccugccugggccucccagagugcugagauuccagguaugagccacugcgcccagcuguaaucuuuguucauaauaaacuuuccagccaucugacucuggcucacuacgucagggguucuuggcccuggcuguauguuagaauugcacaaaccaauuaagucaaauugucuaggggugaggccuaggagucugcauuuuaaagcucuccugcaauccuggcaggcagggugaagagcagcacccgguacagagcggacaaugccacugcaagagucacccugcaccuggggcucuaagucucuuccuuccugucagacacacuugaugugcacagcagucccucccuacguugaauggauaccacguacaagaggccgaaugaccccccugugguuccuuuacagacaguaaagcaagucuguguuuaacagcaagaugccaggugagggacugcagguaacuggcaaguaucaaggcugggacaugggaagugacccccaggacccagcuuugggcguggggagucucauacaaggagacacaggugcugggcuucaccuccgcacuguggaccaggagagccucugcgcccuacaccaccagcugggauucaagcgugguggguccacguguacaugcugcgucugggcuccugaaaccacgcuguccccugugggucagggaaggccaagguuucucccacgugcugaccugaaugaucccuggggaucccagcucgauguagauuccuaaggccuuccccuagagagccggcuccccacuguuccuugggaccagcaagcacagcaaaagcccuucuggccacaagggccuagcauacagccacagcagccucuccucagugaauucugccggcagccugguguucuuggcaauuucagaugcuccugggugguuaaagaaguaccuaucuuggccaggugugguggcucaugccuguaaucccagcacuuugggaggccgaggcagguggaucacuugaggucaggaguucgaaaccagccuggccaacauggugaaacccugucucuacuaaaaauacaaaaacaauuggccgggcaugauggcaggcaccuguaaucccagcuacucaggaggcugaggcaggagaaucacuugaacccaggagguaaagguugcagugagcugggaucaugcacuccagcuguugcacuccagccugggugacagagggagacuccaucucaaaaaaaacaacaacaacaacaaaaaaaccacgcaccaccacugggaauuaagagggcuaaaaggagagagaccugguccucccuucagggagcuaugagucuaguggaaacaacugaacaauacaauggcuacaagccaagaaagacaugacaagcgccugggggaaagcuagaggucuuccaagccucuauccugccacagaugaaacaagcaucucacacgagauuaaaaacuuucacccagaccaucugccaaguucccaagaugcucugauccgccccuagauguauuccagcugcccccaaacgccugguccuccuacagcuuaucccagucuagacaccacggccccacuuccaacuguccccauaaguuccaucagaaaccucaucaggggaucuguggcuagcucaugggaaacuuucccaagcaggaaaccaaugcuuucgccuccacuucaacaccaggggcacgagggaccccaucaggagcaggaauaaaguaaguacauguuuuuaaaaagaauuaacaaagcaucacaaguugcggcuauccugucugcuagcgaggccauguuugccagggucucagccaccuccaggccucaccugcagaaggcaucuccggcucguaucaccacaacgggcugcgcuuccuugcacuucacacacuucugcucacggcuuuggagaugggaggggggagaagagagaaacacagaucacaucuuccccacgccuagugggcuuuggggagacagcuccuguuucucacccugaguugggucagagaaaggcaccucgguacacacacaaacccaggcuuguguucuguccaaacuucaagaaaaacaaaggcucuggggggauguuuagccuagaaaagccggcucagggggcacauaaaggccgcuuuucagucucccaaggcugacacggggaggcgagacagcuucacggcaccaguucucuccgaauaaggacagcacugucagcggcagagccguccccaguggcugcuaggaugagaggcgcgagccaguggaguaaguccccuucuagguggccgucaccgcuugacaggcauuccccgagugcuagggagcgaggucccgcucuccacgcggggcuucccggagcaagcccggccgggacccuucggggcaggagugcggcgggaaggcgaggggcggccuggcggguccggccgccagcucuuaccugggccgcggcgccgggggcggcuccucaggcgccggcuccccguaguccucgcccaccugacacaugggcacgccgggucccgucgcagacuguggcggcgacagcgcgagggc

SEQ ID NO: 191994 - RNA, 222935 nt, Homo sapiens
gcauuuuaauuaauuuauuuauuucuuuacacauaacugaaagugauguuacaguacauaaguuauuuacaacugugcaguaauguguugcaaaauaaauuaucuagaaggcagcaaaaguacauugugaagguauauaaaacuguacagcguuuacggauacacuuuuuauaugauuauuggcucuguaguguuucaaguuacguucucagaaagagaaacaaaaugcccaagauuaaaggaaagaagauacaaaccacgcggauuugacuccauuucaauacggcugggaguccuggcucugugucccuccgccuggcuccgcaccaggucugaagcccagucugaggccgucgcagcucggcggcaacagaaccacggcugggauggggcuccugccccuccgaccugcaggucacuguuugugagagguggacaccuuaauuuucuuuaguugaucagaauggaacaaaaaauuuuaaaaauguacuccguucuccaacuccugaaaugccucugcaguugcuggagaaaagggcccgaaggucgccguuuucaaacagaagcugccgugugugcgcgcccggcauggucuccucaucccgccggggccagugaggcucugggggcuuugcccccgccgcggcagcugguagagaagagacguguuucaccuccccgacgucuggaccagucuggaagggauggaggcgcuguggccaagugcagucucucucggggucucuccccgcccggguggacagggcgcucccuccuccgccccuggggcucagcagcaguccugggcagccgugcggcccucgccugcguccugcggccgucccgcggugucaugccggcaacaauacaaagucgucguugacgucgaccaugggcacguagaaggagggcaccucguucacgcacagggacuugugcccggcgggguccaguuccugcaccuucagcugccacuccauccucugcacggcguucagggccgcggccucgugcugcugccgcaugaggaggcaagucugcgggacacacagcggggagaggagggaggaggagugaagggagagccccagacucugccgaccucagcugccagcagggccaagggcgugauacggccgugaaccuacccugguaugggccaggcccagcuguacccgcuccuggcaucuaguuacuacacguggcgguagcgccagcugugcuacaugucuguccccauaaccgcugucuaugccaccucuacccuggccuggggcucacccuggcccgggggcccugcccugcucugggugggccugggacucaccuccagcagccacugcagcuuauuagaaucgaacagcuuugcuuuugucauuuuacaauuacuuacggccagugauaguuucacuuguauuucuaguagaaacuaugccauuuaaaagugcacauaaggggacuggacugggguagcacauauuuuggaaacuaauggagaaauggaagcguggccagggaguacugguaugucacaagcaaccguguagagaaucuuuuuuagauaccgucucaaggcuggagugcaguggugcaaucaugacucacugcagccuugaccucuggggcucaagggauccucccuccucaaccucccgaguagcugggacuacaagugcuaccacgccuagcugauuuuuguagagaugggguuuugcgauguuggcgagcugcagugugaucaugucugucucuaaauuuuucucaacauauauauauguaugaaaucguuuucgaagcucaggauggauucacaauccuccucaaugggccucauagcuuuuacucggcagcucagacaucaccaguguaaauuguuacauggaaucauauaauacccuuuggauguuccaaacuccggugagucacugaauuacugaugggccucugagugaguuuccaguuuuguuccagugaauauuuuuauacauaucccuaagguuuuuuuuuaaauuuuguccccaggcuggagugcaguggugcaaucuuggcuuacugcaaccucugucucccggguucaaaugauucucaugccucagucucccggaauuacaggcacgcaccaccaugcccagcuaauuuuuguauuuuuacuagagacgagguuucaccauguuggccaggcuggucucgaacuccugaccucaggugaaccacccaccucagccucccgaagugcugggauuacaggugugagcaaccgcaccccgcccaaagucccauuuuaauguagucaaacauuuaucuucuuacaggaaagucuuccaugugucuuuaugaagcuuucaguuuuuucucacggcucugguuaggaagggccuaguggccuggggaggguguggugugagugacuuccugcaccaucaucuuagggcuggccagaaaugcacacucagcuacgccucagaccugaguuccucagcacaagcccccaggggccacgcuccccaaauacccacagcucccaccggguagggcuggugguucucaucugugcccacaucagcaccuuucugagagcugcaguaugacacacgggugcuugguucagggaccuggguggugcugagccugauacugcagguagccggggccgccugcucccaggccuggcuggugacuguacagggugacgcugacuguaaaguucuguaacuuuuggcaaguuuccgccuuccguugccuccugguggauccuccagggugucccggugagcagcccucgcgaccgggauaagggugugcugcccuucccggcaccucccccgccccugcccaccgcccuggccagcacuuccagagcaguggagggugaaugcugggaccuuagagggggcucacagggcagucccaggaguucugaccaucaagccuaggguccuguugagcuggcgacaggagccgcucccugcacaccgggacagaagggaagacugaggaggccacacgcagggacaggaccucaccuccccgaaagcaucggccagauuaagagaaucugaaauugucaccgcccaucacagaacugggcagcggccuccccccaggcagcgcaaaggggguugucaccacccaucacagaacugggcagcagccucccccaggcagaacugaggggacgcgcaacaccgaccuucaugcggucauacuugucauccacguccuggagccaggagaugaacuggcgggcguugaaacggucgcgcacugacuuguucucgucacccuguggaaaccaaacacgggaguuucaucaggagccccagagaccgcuacgggaaggcaugccagccugggcgaugcugcagugaccguucucaagggacaaccacagggggagccucauuccaccgcgcacacacugaaucauguucaaggcauggcaggcgcacccugcccaucucccuaaacagccucccuaaaaugcgcguggaggcagcugggccuuugucuccugggcaccgggugcccgcaggccccaccugugagccgguccccagcccugcccccaggggacagucagagcucagcccacugccaacuccugggagagacuuuuuuuuuuuuuuuuaagagacagaguuucgcuuguugcccaggcuggagugcaauggcgcgauccuggcucaccgcagccuccaccuccaggguucaagcgauucuccugcuucagccuuccugaguagcugggauuacaggcagccaccacgcccagcuaauuuuguauuuuuaguagagacgggguuucuccugggcgagacuuucuagauaugucaccguccuguguccugaaggguggacacggauaagauguccaggcuccuccccuuuuucacggguucauggugaagcugacaaugccgucuguuucucagaacauguggagcaccgacagaaacccacacaccugcagggaacucacuuuccacaaaggugccaagaacagaauaacgaucacagggaaaggacagucucuuccguaaacggugcugggaaaacuggcuacgcaucgcagaagagugaaacgagacccuagcucucgccacauacaaacaucaaaccaaaauggaucaaagucuggaauccaagaccuuaaacgaugaaaccacuacaagaaaacacuggggaaaaucuccaggacauuggccugggcaaacauuucucaagcaauaccccgaagcacaggcaaccaaagcaaaaauggacaaaugggaucacaucaaguucaaaagcuucuguccagcaaaggacacagucaacagggugaaaagacacgcacagaaugggaggaaacgccugcaaaccgcuccugucacacagauucucaagcagaacauagaaggcaugcaauuaacucgauaugaaaaaaucuaauaaucccaucaaaaaaacgggcaaaagaucugaauagacguuucucaaaggagacacacaaauggccaacaggcaucugaagaggagcucaacaucauugaucgucagagaaaugcaauucaaaacuaccgugagacaucacuucaccccgguuaaaauagccuuuauccaaaagacagacaaucacaauugcucgcgaggauguggggaaaagggaacccucguaccccguuggugggaauguaaauuaaaacagccgccguggagaacaguuuggcguuuccucaaaaaacuaaaaauugagcuaccauaggauccagcaaucccacugccggguauagacccaaaagaaagaaacugggggccaggcacgguggcucacgccuguaaucccagcacuuugggaggcugaggcgggcagaucaccugaggucaagaguuucagacuagccuugccaacauggugaaaccccaucucuacuaaaaauacaaaaauuagccaggugugguggugcgcgccugugaucccagcuacccgggaggcaguggcugcagugagcugagaucgugccacugcucuccagccugggugacagaggaagacucagaaucacaaaaaggaaaaggaaucaguauauugaaacgguguccacacucccauauuuaacgcaaccccauuuacuauagcuaaggcuuguguccaucaacagaugaauggauaaagaauaugugcuacauacacaacggaguacuauucagccacaaaaaagaaugagauccugucauuugcaaacacguggauggaacuggggucaugauguuaagugaaauaagcauacaaagacaaacaucacauguucucucucacuugugggaucuaaaaaucagaacaauugagcucauggacacagaguagaacgacgguuaccagaggcugggaaggguuguggggggcuggcagggagguagaagugguuaauggguaccaaaaaaaaaaaaaaaaaaaagaauggauaagaccuacuaucuaucugacagcacaauaggguaacuguagucaauaguaacugcauuguguauuuuaaaauaacauauaagagcguuaacuggauuguuuguaacucaagggcuaaaugcuugaggggauggacacccauuggagaaauaaagagggaaguaaugcuuccuuggaagguguuagaggcacgagcugguccuccucauuuuugcucuguacagagcuguccugacugccuguccaucacagccucucaccugcgguacaagaaugcaaacuuaucagcauccagcccccaaagcaccauuugguccaacucauguuuucuuuaaagaaaaucugucggcugggugcgguggcucacgccuguaacucccgcacuuugggaggcugaggcggguggaucauaaggucaagagaucgagaccauccuggacauggugacaccccgucuccacuaaaaauacaaaaaucagccgggcaugguagcgcaugccugugaucccagcuacucgggaggcugaggcaggagaaucgcuugaacccggaagccagagguugcagugagccaagaucacaccaccacacuccagccuggcaacagagcgagacuccgucacaaaaaaaaaaaggaaaauaaaauuugucauuguguauaugagagacauugauaaaauacauccccaaagaaaggaagaucuuuaaugcacaaagagauguuuucaacuaaacaucugggagccccuggcugucaccacacagcaaagccuagugcacugcucagagugcccagggcugggguggcgucaaggggggcacauauuacgagggcucucggugcgagaucuggacaccaaggcaggaauguguuccaggcacgucccacugcacaggauguggggccugggguccagggagcccacaaccugagcgcagugggcuccgaggaggagggaggggcugaugcaggcgaggcaacgggagagccaggggucccacauggacaggucagugguggcuggaggaugauuucugaggcaggagucccuggcacaugggcugcuugaaggcagacaggaagagcugccccagggagagccacggggcccuggccgcccacauccuaugucccaguggacagagcaggucaaaggcacgggagcugcaggggugggcgggagccccacagcagaugggcaggacagugacuguaguucuggaacccugaguccggcccgcccuggcccagaugagcggcacaccugggugcccguguucccuuagccacccagugucccugcuguccccguaugacagccccuggggccugugcugugaaagcccucgauguggcagcccuggggugccugagagcagcagguggagcccagcaguuuaaacagaaaauaaugccagcgcugacacccgugagagguagguaggggcaggugcuccaacugcauggacaaguguuacggagggacugagcugcugaggcccagcccaguggccugagggccuugcccgugcggggagcugucugcugucugcugcagccuucuuggcuccuuucugaggcucgcccaaggcuagaggcaugcaaaggacucuguagccccugcaaggugcugagcacccgggaagcuccuggucaaagugcagaaucuaucaaggggaggggaggcgggcagggugcaggcacuuggacucaugggccuggcaugcagacgggcccuaccuggcucuccaggggcauguuguagaccucggaguccagcagcaucgugcaggcgcugaauggcacugccugguuggcgaugguccuggccgcccggcagugaacccgcagaaucuccugcucacaggauacgaucagcuucuccugaaggaggagaggaguagagugagcugggacacagccacgcuccaggccccacugucaacacgacagccccuggggccugcgccgugaaaagcccuggccguggcgccccccugccugugccagcccacuuacccgcucgaugcugugcuguagacgcagcuuuccccggacggccuccugcugccugaacagcuccuucaggggcuccgccagggagggagggggugcgaucuacaggcaaaaggugaguguggggggucagcuggggcuguggaacugcacgaaggauauagucuggaguucacgggggucccgacucagccuccccacuccuaggagccugcccuggaggccuccuccagucccagcaacagacacaccaggaagcuucuagaaaccacuaugugcuggacgcgggagagcggacaccuccacggugccccguacagcaccacgcagugaggagauagugcagggagaggcgcgggacaguaucugugggccaucgugugccaaggagggccugaaacaccggcaugagcacccaacugugcagaggagauacagcgagacagcaggagggggcuggggguaggcugagcuuccuguguucacagggagggcccaugcaccccaaaucagccuuucaaccaggcuguaacgugcacaguggaauaugaaagcugacaaccgagccgguggucuugcaguggcucgggggagggaagcacgcacuggcccagguccccgugggggcugggggacugugggccggaagcgcaggcacugcacucccaccagcagaaggguucucacagaggugggucggccauucugaaacuacaugcaugcuggaagugaaugaggaaguaaagacagccgagaccaucaggaugaggccucacacucuuggagaaacaaggcccacacaggagcggggagccaggcugagccccgcagugcagcagagaccucaggcccacagggagucagguuuccaaagcagacccagaaagcauggccgugugcucggggccacagcagucguaccagggccaccacuccccacagguggacccacacgguaauggcaaggcggagccggguggccaagaccagcuggaacaucgaggggccagucagcaacaggagcgcacggggcagaugggcagguggacgcacaagagggagaccaggaagagcuccugacagccaaggcuggggcgacucauggcaugagaccaacgcuggcgaugccgggcaccugcaggcggaagggguggcuccugacagcacagcuccaguuagcggacacaggagagggagacaggcccagcgcacaggagugacugcugcagacgagagccguggacagcgaugcgcauggacaaugggcugagagaaacagccucacgcagucuccacgucucuuccaagacacacacacacaccacagagggagagacuucaacucaugguggacgggccugaccaggccuccaggucacgucaccuaugacaccaggagcagaaggccccgccucacgccuauaggcuccugccuaagaagcaucaucgcaggccaggccuggggccucugaccacacugcugaccgacacugcccagaagcucccagccaggagacagggcacgggagggccugccacagcguggacgcacggcagggucucgucaccuccacggcuccuaaggcacauucaggggaggcugggcgugcagcaggugcauaaaccuaucucugcuguuucugaacuuuucugcccaucuaaaaucaguucaaaauuaaugauuuaggccgagcgcaguggcucacaccuguaaucccagcacuuugggaggcugaggcaggcggaucacaaggucaggaguuugagaccagccugaccaacauggugaaacccugucucuacagaaaaugcaaaaauuagccggacgugguggugggcgccuguaaucccagcuacucaggaggcugaggcaggagaauugcuugaaccggggagguggagcuugcagugagccgacaucacgccacugcacuccagccugggugacagagugagacucugucuuaaaaaaaaaaaaaaauggauuaaaaaauguagcaaagucccucuaguccacagaccucacucuguucagcaccacauccacccugccucgacgagcccagccccccagugaggguucugcugagauggggcccgucgguggcagggauucugugggccaccuccaaggugggacugaugcgagcucaagcgaaugcacagcccaggacccggcaccaccccuuccucuggcucagccccagggccggcagcuacagcaggagcugugccuugggccucaggcagcaccuggcaccugggccugccugggucuaggucugggggguacucaaaagaccaggcgggaggugcacagaacauucccaggacuacucagauuggcaggauucuagugacuuuuuuccccuguauuuuccaaauuuucuacagcagucagacuaguguuaugauccauuaaacgagaaaacaaaacaacaaaaagcacagaaggucagaagaucagaaggucuuacugaggagagauccuggggcagguuuuucugaaugucaugacccaacugccgucucugucuucuguggaugagccuccccggggacggcuggggucaggcucgcggggaagggaaagaccgcagaggucaccgugggugcagugccccucgugcucccugggagcagagcucagagcuuggcaggguggggcccgagggcgcccgcuccuggauccugcacaacgucccugacaugucggccagcagcacagacccagccucacccucagggcaagcucagcagaccccgucauccucaccaggggggugcuggguagcugagccaggucagggccagcacggcgaggggccucaggcggccugggcccacagagccaacgcguguggagggccccuggcuguaccucacgccaccugcgaguuucagugcccaggaauccccagaaggaaauggccauuggugacggcaagccuguucugggcauaacacaacacacucaagcgagacggcugcaucaaccacacaguccgcuaggcacagugugaguggagucgcguggucugggaggagacuccagggaagagccagaacgccacacgcuggggcuggauggacccuggggggccugagaacaggagggcaggggaggccgugcacagcucaggccgucaccgaggacagacgggugggcucugccucccccaugaggaaucccugugccugcugggaaagaccccaguggguaggaggaggugggaacccagucaggccccgcggcccagggcagagagugcacagggcaggcagcccucaugggaaugugcucagagcagggccccauuuggagggaucuauuuugggcccagacguagcgcaaggagcugggggagugggggugauuccgagauguuucaccugagccugcagagguagggaugaugccuggggaacugggcugacagggucagguggaacaaggugaggcugggggccgaggaccaagcugccccaagggagcugcagcucugcugucccagaagcccaagggaggaggugggggaagggacucaucgugcagguauggaggcucagggaacccacgcggguccaagggagaagggggcggggcaggggcaggagacacaggggguggcucucgugaggccguccugguggacggggaguggagaggggagagugagcggcgugaagggggagccccacacgagugggaccggggugcacccagggugagggggaggucaggagaccgaggccuggcacggaccagcuggaggaaggaccucgggucugcagaacagcugggcagcuuccggcuuuugccuccacagcagaaguggggcugugucuccucagguggcagaaggucgagagaggucaagggccaugagugggacaagacgggcuggaggaagccgugacuaggggccccagacgcaucccagagagagaaggcaguggcucucccgggccccgcacucaccacggggauguggagcuugcugagcggcuugccguccaggagguaggagcccguguaggugacguacucggcguagcacuggggcgccugcggcgugauacagcacaggaucuugcgcuucuccucgaucuucuuccugaucugcagguauucgaaguagggguuggcccugucgcugugguagggcucgauggcauccagcuugauggcguccacgauggcggccagcgucugcuggaucaccucccgcgucugcugcguggacguguucagcugcugcugcagcugcuggguggagcgcugaaagcggcguuugcgcggaugcugggccugggcgucgucguccucggagccgcgggccuuggcccuggugaccggggcaggggugggggcgcacuccuucucggaggggggcgggcccugcuugcucugguucgcgagcaucugcgcccgguuccuggucaugcgcugagggaucuccuccacucggggggccuucggggcuucggccguggguuuugguucugcggcuuccggcuggaugccgccaggagggccuucggcuggggcggcggcacgggaggccucagugucguccucggggccggcaccgucugcggccugagcuugugccacaguguucggggcggggccgucaggggcacagagggacgcggcgggggggccuucagccucagcccccuggucuccgcuccccagugggcgcuguucugggggaacgggcgcgggcuccacgcuggaguccggauccccacgggcccucucuuccggcaccgucuccgccuccaccgcagcuucuagagccacguccagcuuuggcuccccugagggcucaggcucgagcucugcagggagccggguggaggccuggucaggaggcagugccggcggcuccucagccacuacgguggaaacauccccaccguuuaugaccccgggggccccuggaggcaucucuucuggaggagcaagacuuucuuccacggguuccgcuucaccaucugcggcaucuuuagucugcaggggaagcuccggcagggagaagggccccagguccaggucguccucggggccggcgaaggcguccgcccagggcaccggcuccaccuggccgaggugagacaggccgcggcugccguccaggaagcuauuuuccaggggccccagagccuccaccugagccacagcggcuacacaggcgggcucgggggccacguccagcggggcuuccggaagugacuugcaguugcugaagaaggacuccagcccggagggaggggcguagggagccgccucugagguggagauggcggcggggacggcguccacuccguccuugacguccuccagccccggcucagcgacgggcagagcguacggggcaggagaggcgggaggggcgggguacggcgccuccgaggcgcugaagggcccuggggcggcagaguggaggggguccgcggggcagaaacgcuuuggggacucggggaaucucuguggagacuucagcaggagguccgagcccacaggccagcucacaggguuuucagaggugcccccgaucaggcuagaggcaagcgccugcucggaggggugggcccacucaacgggcuccucggugaugacggcgcugaagggacccucguccagcggcuccagguagcugggcuccggggggaugauggcggccgucgccugcugguccucggagguguccagguccgggggaagggccccuucgagggaaggaaccagcagcucggcucugggggaaggggaagguuuugcuuguaaacuugagaagacgcccucuggagacggggugacagugacaacggcagccggugggcagugcaaagcgucgacuuugggcgacgggaggccauagucuggggaguaguacccuggcgacaagcaggcaaacuucuccgcgggaaccgggggcaggggcgcccugucuuccaucgaggguggcaugggagagucguagcuggaggcagcaggaacgcucugcugccugaagagcuugucuccgacgcugaauucuuccucggggguccuccuaaugucgacagagaccgagcgguaaagguuuguggagagaggccuggcaggagccuggcuggcguuuuccgaaagcccacuugaagccacggagaaccugucgaaaaaggagggggagcaggcgcuggugggagcggugggcacgggcguggagugcugcgagucggcgcagucgaacacgagguccgcguagucaucggcgcugcaggacgggguccugggcgugugcaucaccuccucguagcuggggcaggauagcaccgacguaggggugggcacgccagugggccggcucuggucaggccugggggacgcaggcaggaccucuuucaugugagggccugccagccagucuuuggagucugcaccugaugcuggguguagcuuauuuuccgcggcagguggaauaggagucgacucuuugagcuuuuugucuuuaaauggaggguccagccccggcgguuucuuagcaggaauguccagacccuucuuccgcccgucgucugccggcuucgccuucuccuugagcuuggggucuccggaccggugccucagcuucuccauuugcuucauccucuccuugugccgcuuguggcgcuccucgaucuccagguccuucugggacagcauccucucgaagcuggucaucaucaggucgccgucccccaggagcuucucccugggccuggcgucuuucuugccugggucuuuggauggcgcuaccuuaucauucccguugcucaucuucacugggucgcccuuuucuuucucugcaccguccuugaauuucuccuucaguuuggcaucgccgagccucgggcccucgucccuggacuugucuuugagcacgcggggcgggcuguccuugucccugguggcgggcuucugcucgucccugugaugccgcaggagcucgucccugugaugccgcagcagcccauccgcaugccugucccggugccucuccuucucgucucuccauuucucccuguguuucucucucuucuucuucucuuuuaggauguugauggcacuagauccauaaggcuuuaguuccuuuucuauuuucuuggaagguucucucucggaaucauuuuuaucuuucuuuucgguagaaaacaauucaaugguuuuaucuagcucaucuucuaugucagcuuucauguuguaagaaacuccguaagcauccgccuccaggaaguccuuuucguacuggccggaguccuuccugcuaccgcccuccuuguaaucuucgcccuucucuuucuucucggccuucucuuucuuggcucgcucucggucguggcucuucuuggaugaagaugaggagugucugugccucuccuucucuuucagcuucucagggaggcaggcgcucucccucggcuugucgucuccagguggcuccgugaaagagaccuccaggaaggcagucagccccggcuccugcccucgguccgugaagcugucagaggagaccucgcugauuuuaucguuggagucuucucuguacucauggagagccucuucuuccaacuuuucaagcaggcuuuuuuccgcgucggcacuucucgaggacuuccucuccuuggaauguucuuuguccgacuucucuuuguguuugcuuuuagccuugucuucggcagcgugcuucuuuucagccuucucggggagcuucuguuuauuuuucuuaucuugcguggaguccacugaggcucuguccuuccuguccuuguacuuuucuguggacucuuuauccuucuucuccuugugcuuuucaaagacuuucucuuuuuugucucuccccgcgucggcagccccucgguccuuucuccugucucugggcuccuuguccuucugccucucagggugcugcuugucagaagacuuccugugucugucggaggcauaggccucccguccuuccuccuucuccuggaggccguccguccucggcaagucgcuggccucucccaucuugaacccgcuccccaugcagcugucucugucguccucacucucaucugugaagaugucugcgauguaccagcuuuucucuuugccuuucuugucaucuuuuuuuucagagaagucuucugagaugaucccagggaaagccuucuccuucuucucuuucccuuggucgagagacgcuuuccuuucuuugucuuugccaugugugucuuuauguuuuuccuugguaucuuuuuucucuuuaaaacauuuaucaaauucuuuguccuucugacauuuuuccaggauugauuucucacuuuuguccuugucacuggauuucucuuuguaucuuucugguuuugucuucuccuuccuuuccuuaucggggccauccuucuucuccuucucucgugcuggguggugccguucccacggcuccaggcccuucccaaagucgccgucggacuuguccuugaagccacucucgcagccacacuccuucagcuccucccggugcgccuccucgggcuuggcccugccgucccugcgcuccuugcagcucuccagggcguccuuucugucccgcccggccucugcggacucucuccucuucuuguccuuuuccgaaagguagccagggacacuuuuaugcuuuucggucugcucuuuccucuucucagaguuuuuauccaaauagucccuguccuucuuucggaagaagggcucucuguagucucgcuucucccgggcccggcugucccgccuccucuccuugcuguccuccuucaccgucuccaagaugagcuuggccacagagucgcucuucaugucccuguagucugucacuggcgagucccagcuguccuccccuuugaaaucaaaggaugaaucggacaagucagaaaaccaccgaucucgcugaucgucagaaaggcuaaauuuggugucuucauucuccagaaacugauuuuuguuacaauauucgucaaaagcagaaucuucccuauaaaccuuuucuuuuuugaguuuuucuuuaucuucuuuaaaaaucuucuccuucucuuuugaaauuuuguccucuuuuaaaucauucuucuucucuaauuuugagggccggucuuuugauuucuucuuucucuccucuuuguacagucucaguuuuucuucuuucggagacuuuuccuucagcgaucucuccuuuucugcuuuauucgaacggucuuucucuucucggaaagaccugcugaugucuuuguuugugucuuugauucucuucagugauuuuucaucuuuaaagagccauucuuuuucuucuaauuucauuuugcuaaguuucucuucuuuuuuaaaguggucgcgaucgugcuuuaacacuuuuagcuuguuuucaguggaaagaucauucucuaacaguauagccuuaucugacuucugcuuggaguccucauauucguaaguaaaacuuuucaacuucagcucuuggcugauggaacacugucccuucuccuuguuuuuguguuuguguuuuguuuuauguuuuuugacaacuuuccccuccuuguccaguuuggggacagcgcccuccgcgcuggacaggaaggggcucuucuucuccgacagggaggcucgcuuccugugcuccugccucuuccucacuggcuucagcgauuccacacuggagcccucagaggaguagucagacucgcuugucagucucguccuuguggagucugauaaagaacugaccucugaccaagccggggaagaaaugguuuuccaauugucuguccgccagugcuuggugugcuggucuguguggcugggguucugcuucugggcggcagagcucccgugagacgagguggaggaggcagagagggagcugaacagggagggguccuucagcaccagcggggaccccuugaggcagccagagcuccccagagagucccugucauccuccccacucucugaggacucgcucuccgacuccgaggagcagaacuugucgcuccgcuuuccgaagcgaaccucucugccuuuuguuucuuucuuucgcuucuuuuucacuuuauuuuuuuccuucugcugcuuggcauuagaaggcucucgugucuuacuaccaggcaauaucguaugugccgagagucucagcuucucuccuguccccacggugacacucgcguccuccucguccgacgugucugacaggauacgaugggacgcuuucuuuggugcaaucguguuauuuuuaguguaacuuuuaaccuccauuuuggguauagagauaaaacuauuggauuucguuucuuuucuguaguccuuuuucaauaggugcuugucguccaccggaggaacccuguccugcucgucguccucaucaaacucauacucguccuugacgggggccguggccuucuguggcucuggguucuuggccuugugcuugaggccuuuuucgaacucggaguccguguuguugccgucgacugaacuggaaggugcgaaggauggugcgucuuccucuucugagcucucuguuggagguaggaagcgagaggucacaggcaggcucaaaacagcucuccccagaauggcagaggagggaggcucugcagaugugucugcgggaagguucccacccugccucugcagagacacuuugcucgacucauggaaaccagccacaggcaggaggaaaccagacagagcucagcugacagacagggcuggcaucuuagaaugaagacugcaggcuucucggcagugacacaccugggcggggucucccgcaguccagaagcuccuguaagcccccagcauccgaggaggagcugaucagaggggcaacacugugcaaacaccacagggcagcuccuaccaucccugcauaaaagaacaggcagcucagguggccgugacuuacccgucgagcucuccucgcuggaaguguaagugccuuugccuaacaggagguucaccaucgugggggaguuggccacuuucagcggcgucucgccuuuccuguugcucugcugcggguucccuccguaccgcagcagcagcuucaccaccuacaagacaguaacacccgcgucagggacugcuggagaagcacaacuccucuaccguuccgcauaacacggcagccccuuccgagaacccugggguucgacccgagagcagccccucacggucugagggugugggagccgagcgcccagggacugccuggcgaggcucuggguguggugggcgaggcuguggcuccucugugggaagggcugcagccgcgggggcucccgcaccccuccugugcucuccuucagaagggcucugccuccuuuggauuuuuuuccaccauuucuccguugccgcaaguagacgacuucccaggaaucuucucacgaaggcucuccccucccgccaacagugagcuccucagcagaguggugccggaguggucguggagggcucaggcaagagguuagggagaagaguguuauggaaaggguuggggggacagaauagaggaaacaaagaccaaguuucugcaagcugcuuuauuuuuuauuuucauuuacauuagaaaauaaucucucccuugcuugauuuuacaaggguaaggguggucacaugacugacagagacaaccauggugacacagcucuuuucagcuguucaucaccagcaaccuggauuuccuaugcccagaacagcaaugcacugaacucaaguacaaauuaaauuuaaucccaacuuuaguccagucugagauuagcgcauucaaagaaucugucauaacguuuacuauagacucuugucgcccacagaaucaguuuccaguucgugugugacauguucuauuguugaaucaguacagaguucuuaugugugugaguuuucuauggugacuacacaaaaccucaggcuuacaauuguggaggucagaggucaaggugcuggcagggcaggauccuuccuuuccuccaucaugggggcugcuggcagaauucaguuucuugcagggcugggacggagguccccagucccagcugcuuaggggccaccacacuccucggcccuccucuaaggccagcagcgcaggugcggcccuccucggguucuaaccucuccugcuucuggcaucucucagacucagcaggaaaggcucucaagcuuuaagggcccauggggcugcccugggccugcaagaugaccuaggacaaucuccccaugugaggcacucacaaggucugggggucacaacacgggcaucuugggggccauuauccugccuaccucaccguaauuccaggguccuugacauuuuucguaauaaaaaguuuaaaagugguaauuacagaacuauaaagcugcaucggaugccccagccccaucacccuccagggccauuccccucacaccugcccuccccugcagcacugagcgaaucccagacacugcagagccuuuuccaguucacgucucuggaagagcccauaaaacagaaacaguauaaaccauagugccauucauuaucuuacccagaaguuuaacggucauauuuuaacaucaaauagggacucaguguucugaguucccugcucgucucagagucuucaauccaccccccaccccaccggaacaagccguuucucaagugagcucuuuaaggccaaggcacugugggcuccaggaccuccagcaauggccaggcugggcuugcugcagaggagcacgacgggcaccagcagauguggccccgugugaccccucagccuugcuguccugccugcaaccaggggcucuccacggagcucugaugaagacaucagugagacccgccgcaucuccaggcagcaccccugcuuuccggcaggacggggcugucaggcacaccacgaccucucucgacccccacagaggcugagaccucucagugcccacugcuccugggccggccacaauggccacuuucuaaagcuugagucuaugguucugugcacuggccacaccucuugguguuaccucauuccagacgagggugggucugccuugcaggucuaacagucccacaguggugacggggaccggcagcaacuccugcaggccuccuuccacuugguguaauccuucaccugcucaaauccaaccagaccuacacggcuagcggauacgagccuuucauagauggcacuugcugggaaaccugugagaggccguccaggcugacccagaaggggaaagcugggggcagacagagggcacagcucggccuugagggugggcaaggcgaaaacucgcuuuccugugccccacaucauggaaccggcuagcuacggggaaacaaagcuacagaaccacccagaugccaggacaggccggaugugugaagaacggggggaugccaaccuuguagugcccguuguuggcagcgucgugcaaaggcgugucgucaucuaggcccuugguguucaccuccgcaccugcagccagcagcugcuucgcgacgucguaguagccccgguuacaggccucgugcagcgccguccagccuggaaacagacacucaggacguacguuauuuaauccucagaacuucccuccugucucuggaggcagcgcccugaggaugugcuacagugcggggacaagccagguggggagcugcccuguagugagggcugcaguuuagggaagcaggugcuggcccagagaaccccuaaauucucuuuacuguggcaccucguuagcacgauccauaucuagcuuauuaacccuacggacugacaaccugcagggcuaaucugcggcaaucacccuaaaaggguaggaaaucagugaacacacaguguaguaaacagcagccucauccucaccgaucuggaggcguaugugccuuugcaaaacacggaggggaaaccucccgugucggaaacggaaaccaaggcugagagccuccugaaggcugaagagcugcuacagcaggagcuccaggggcgcccaggcucgggcugcacgacgaaggccaccccgggcaggcagcuccuggcuggggagcuuggaguccaccaucggacgguguggccgcacgcauccguggaaacagagcucggccccacggaagcacacggcacugcucuagagaaguuucuuuuagaaaaaugcuuuaaaaaaaaaaggugcuaaauuagguuugggucagacagcuauaaaccagggcaguuggagaaaucuagaaggauucuacacacacgauuuugcucaucuguuccccuuacacuguggacagacaguccugggauauguggaccacucaugguuugauggggguauuuuauguaaagaaagggaauauuaaacucuaaucauggagcucuuaagccccugggccguaucaggucuggggaggcucgcucaguucucuccgggucccaggcaagccccaggacccagcccugugaagugagggaguccaguccagggugucgacccagccggccucccggcucagaggugcccucugcuggagaaugcagccaugugcuagacacaccagggacaggucccuccaggggccuggagugagguuuauggaacacagcagaguaaaauuuaaaauuccucaguucucuuacagauaggccaggcaugggggcucacagcuauaaucccagcacuuugggaagccaaggcgugaggacugcuugaggccaugaguucaaaccagccugggcaacuuaguaagaccccgucucuacaaaaaauaaaaaaauuagccaggcaugguggcgugcgccugcacccggaaggcugaguugggaacaucgcuugagcccaggaguucaaagcuucagugagucgugaucacgccacugcacuccagccugagcaacagagcgagacccuaucuaaaaauaaaaauaacaauaaaacccagcaaacaaguuuacuuugaaauacuuuccaagaaacacugauuucuucucagcaacagggaaccccacuggagugaguguggcugugaacaccccgagcccugcagagcagacgcgcaccccacgaggccacagcccauccaacccgaugggaggcucacggcuccaaugggggaggcucagggcuccagcgggggguaggcucagggcuccaauggggguaggcucagggcuccagccgggggaggcucagggcuccaauggggggaggcucagggcuccagcgggggaggcucagggcuccaauggggggaggcucagggcuccagcgggggaggcucagggcuccaauugggggaggcucagggcuccaauggggggaggcucagggcuccaauggggugaggcucagggcuccagcgggggaggcucagggcuccaauggggggaggcucagggcuccaauggggggaggcucagggcuccaauggggggaggcucaggacuccacugggggaggcucagggcuccaguggggcucucuggcccuugccaggcacagggugcccaccugcgaaguccuugacguugacgucugcccccucgcugaugagcucuuugaugcgccgggcguccccgcggauggcggcucggugcaggcgggucucuccacgcucguuucucuuguucacuuuaucuuugguuuuugaggcagaguugggcguucccuucugacacacuguagacugggaggggugcuuugguguuguguccacugcaggccaaggaggggacagaugggcauuacuguggggugguccugcuuuguccaaucuucaagagcccaggccaccaucacgaggucccuuugcacagggcuuguccucagcacagccaugaggcugcgaccaggcagagccccuucccugcgccagggaccacccacaggccgggcucaccugggcuguuggcagacuccucggccgucaucugcaugagaagggccaccugcuggcgcucggagaggggguagccggcucggauuccagacagccccaugccaaacagcagcccggccuuccgggugacaggcuccuucuuaauccucuuccgcucagggcccugcuucucugugaggcgggcgagggagagagggaggagagauuucaugccaugguguccuccaaagcuagguccuuaccuaauguuacggagcccccugcguccaccugacagcugacagagcagaaaggaaggucuguguauggggaaagcacagcggugcugggagcauuggugccgcccaccucaccucucagcagugacugugagaccauuuaaacaccucguuaccagccccucaagucugcuaagccugggccuccaccgagcauccacucacuccaggcaccucuccugggccuccccagaccucguaccacacaugaaugcggugggacagcuuagcaccggugaccuggcucacacaggacaggucucuguucaauacacgugucuguaauucaauuccaccuuccccgucccuccuccaaacagugcagauauaaaauggcagacacaguuuaaaacacaucaguaaaucaaggccaacuggucaguacuguaccuuucuucuugcuucuaggaaccuccaucucaugccauggugcuucgaggagcguaccagccuugcagcaccacaacagggacugggcuggaggcaucugaaggcaucaacacagagcacuaacaagacacggugugagagcucggcuguuuccaccucagccuccucguaacaagcacacccugcacucaucugacccguuacagaacacucggcuggcgucuaacgcaacucacgugcugugucuuuuaaaagaggcaggaggcaggggcggggaagagaagaccccaagcaccaagagucgggggcacagaagaugccuccuccucugccugaccagugcccuccuguggauggaaaucaggggccagacaccucugaauccuccuccagcugcccugcggguucugggguuuucuaggucauggggugaaacugcagaggugcagcgcagaggcaaggcucugccaaggccugacucggggaagaagggccaccaggaagacgugggccucugaagcucuccucugaggcaccucccuucccuuccauucagcacucccaagaagccucucuucaggacuucucccucggcugguguuugauccuacagaggugggagacaucucuaacaacggacuaacuggaucccacaccugcccggucacuggaacacagaacggucuuaacuagucucucagcucagcucccagggcccgacucucuugcuguucaccaccaugguccccgugaaugugcccgucgauuuccuaagaggacgcugcccacccacucuaguucuuuccaagguaucugaggcugauuucuuaggaauucggucuggggcaugcugagaauguggauucguauguccuaugggacaagccugcaggaaggcacacaccuggccacaucgaccugcgucacacucaugggcaaaaccccaaguacugcaggcugccaucgccaccaccagcuagucuguaaacaguccucaacgcacagaucugagaaagcacuugagcuuuggccccagccccucauagaaccuggcaaacacggugguuggggaggcagccucgccaccggccaaugagccccagccuacagccaucauuggcguagccacaccuuagcagugagcuugggucacaggcgcuuggcugugggucucugcgugcgccccaugcuuucccugcacccuccaugcugcccgggggccggcccuccccaggcuugcuucucauagccaccucuaaacaacagaagcaggccugcggcugccucccucuaggaaagaggcgacgaagcugcuggagaaaccccagcucccccaccgauagcccucaaguccuccucucuccaggaggggcccacacucaccgagcagcuggucugcccacagucgccuggagaagcagcugagaaccucugcagggcccugauccccaagaccuagccacgcacauucagaggccugcucccuccgucacccagagcagggggguuaauguuuuggagacacgaagcccccugagaacacgaggaaagcagaauccccgagauacacagacuuugcaaagcugcacacagcacaggagacuccugggagcagacggcaucuccuuauuccauugaccaucagaagugaaaagcgagugggccccacuucugugcugcauguggccacuagggguggacacagggaggagcuggggcagaguugggguugcggagggaggagcuggggcagaguugggguugcggagggaggagcuggggcagaguuguggcugcggagggaggagcuggggcagaguuggggcugcagagcgaggaggcggggugguguuggggcugcggagggaggagcuggggcgguauuggggcugcggagggaggagcuggggcagaguuggggcugcggagggaggagcuggggcgguguuggggcugcggaggggaggaggcggggugguauuggggcugcagagggaggagcuggggcagaguuggggcugcggagggaggagcuggggcagagguggggcugcggagggaggagcuggggcgguguugggaggagcuggggcgguguuggggcugcaguauguuuacaucccgaagugcaggcguugccaugcucuuaaguuaucaaaggacccuaggaggcgugugucagaggaacaggcagaggcaaaggcguuccuuagaagucagucuuuaggcuggcaggccaggagcccacgcugcguccccgcucugaggggcagcaaagagcugcuuuguggcaaacagaacaugucccacuccugcagggcggccaucucaggugcagcucacacccaacaugugcagaaugggcaggacucggugcccccagagacuuccugggugggcuccagggccugagccucagggucagggccacaucccucccgcuccccaccaggcccucccucugcuucugcucugagcuuuggugaagaaagccugaguuggcuucccuuacgcggccaggacagcuuuacagggcuggcucccagcaauucgcauggaaggugcugccaaccuccuggugaauucuggugccuggagccaccacagggaccuugcucugccccacacucaggaaaagcuugcucccaggaagcagcaacuuuucacccagcucucccuguccugaaacaggacuuuuuacuuguccugacaccaaaaaaguccaauaugaaaccagaucucccaggaugccaaucucuccacugugaaacaagcaccugcagcuacgagcaucuacaacgcccacaacacgcgccagacaccacccaagcuccggagcccagcaaacuugcacgucugucagcucugagacacuggccacuccaguggcuucugggguagagggaaagccccacccacggagcgagacccccaugugccacagcccauggcucaacaaugccugcucuccauuccaacccagcgacaccauggucugagagcagcugagcggguccuugacgugcacacacacagcccguaccuguaccugcacugucaggcaccacacaagugggucccgcacugccugccugccugccccuccuaccccaggccugggaugaccuggagccgugugccccugagaaacgcuccucugagaggagaggcugcaaaaccugcucccugcccuccacacagugcagagcgcaggaggcgcgggguguugucugcagguaagaaaagggugagagcaucuggagcuaccccuaggacagccagcaaguuccuguagcauucugcaaauuuccuguuucuaccguccaaauggaagccaaauacaauuucuaugaauuccaaaugguauucaccaaguugcaaaguggaaaacuggcaagucuagggacuaagugcggcuacagcaccacagacagauguggcccugggugccucugaccccggggugggggugggagccacuccacagcacucagaagcccccuuccaccccugcccugcagucggaacacggccugcaggcucugagggcuuugugggcucaggcagccuggggcugagggcagagguccagggagagcgguggagggugccaggagaggcugugucuucccaagucaagcauguuggcgguggcaccuguguccgcugaccugagccugggcggccacccaccucaucuuuaagaaacaaggcccguagggccuuucuucaaaccacauccaccucgccagcccucugaggcuggcagcacaccucacuacccagcuggccaguggaagauuccacggaacccucuccuccucagcacagagcugagaccccuccaugagccccaugccccuuccuggugcuggugcugcuggagcacggccuuggccuggggcagcaggggccacaguggacaaugcuuuugggagcuggagcccacuuccugccccugcauccagccauggccuuucugaggcagcagagacuggaggcgagcgucccgaggcaaacggcgguggcaccuggcucugugcaggugggaugggggggaugugacgcgccugggggugcccugugcuggugggaucggagcgggggcugugaccuucccgaggggugcucugugcaggugggaucggaggggggaugcgaccuuccuuggggugcucugugcaggugggaugugauguggggggccugcaaccuuccugggggugcucugugcaggugggauuggggggggcugugaaccgccugggggugcucugcagggagugucuucucuaucuggcugccuuuuuuuuuuuuuuuuuuuuugagacaaggucuugcucuguagccaaggauggagcacaguggcgcaaucucagcucaccgcagccuccaccucccaggcucaagcgacccucccacuucagccucaggaguagcugggaccacaggugggugugccucuggcugcuuuuaacauccucccuuugcuguucugaaaacuucacgucagagucauauuuaaauguguaauuacugcucuuucuccugcuuauaauucauuauacuuuuugaauuugaggcuuguguuuuuaugaaccuugaaaagcccucugcugccggccucuggagccaccgucucccugcccugcucucuccucugccgaggugccuguuaagcugcauucucuccuccacagcuccccgcuuccugcaggcuuccugucucacuuucuuucugugcuccagagucuaggcaaucucuuuuguuagaacuuccaauucaccaauacuuucuuauguugugucuaauaagcuacaucaucugcucacuggguuuuuuauuucagugauuauaguuuucauuuccagauauuccauaugccuuaaaaacaucugcaugauacuccaugguuuuaacuccccugaugaauacugugcauuuaaccaucccagcacgugaggucccuggggcugaccccugcugacccucucagaacagcuuucuuccucaacgucuuguaauuccaaccaggcucuucgucugucuacacucugggagccggaaggccgggaugaggaaggugugucucuccagggaggguuugcuuuugcuguggugggggccccagggaguguggggcacuuccagcagcauaaaacagcacaaauccaaaugccagccccaccagagggcaggaaugggucagaagucucauuggugaccucucaaagccccucaucccuccucagcaccugucccucuuagcuggggggacagugucuacccugauagcccaguguccaggaaguguggcccucucgaggggacaagcuuuccguggggucugggcccaaagccccuuccucuaccucccugggaggucugaagcugggcuccaaggcagagacccugagguugggccccagggacguggagguguguggccucagcugcucaucugaacaaaugccuuuuguaucaaucauuuagcaccucuaauuucuaggcuuuucuagcaagagucuuuuaggagacacaggccacgauacugucaacauaggaaaaugugcaacuccugcgucccaccguaaaacucgaagacgucaaaauacauucuugauucugcuccacaaagggauguuuccauggcgauauuuucaaacaacagaaaguucacggccgauggcgguuacagcucauggaacugaugggcagggccgggugcagcuuuguagcacggcugcugcucacagauucucuuccauuugacuaaaaaccaugcuguccacaccaaacaucuggccucauccggauguucaaagccaugaaauacagcacuucuggccaagaagucuaaaucacagccgaucuacacgaggcggaugguccacaacgccaaguuccuacccgggcacugagcucaacgcucgcacaacuccaaacgagggcgcaaccauauucccacugacauccuccuuggggcagcaagacaagcuccgaacagccuguccugggccaacaagagaagcuggcgggcgcccgcugagcacugugagccaucuuguggugagacuggcuucuccuuccaaucuccagguuucucucucuuucugccuucuuucugucaguuaccgucauugaucacuuaaagaaagacagggccuaccccugucugcugcgugaccucagcccucccgccugccgaugggagcugggucaucucuuacgccuuucagcuuuggcuucuuccgcaguguaugugaaggggucacacagagguaaggcugugcguccagcccuugccugcacaaccuccaugccuuccccaucuccaggccggggugggguagggguagggugggguggggcggaaggaccaguuccacaggaagccuguggaggcaaacaggguuauguggcaagggugggaaggagcagggccugagccccauggugguuucaccagcauccagcggucaccauggugaacaagaagccaggaaggaaggaagcaaugucggcaaaagggcucagaugacaaccaaacagaacgguuucccacccugggccuccuuuccacacacacagcaucguggguauuuuaaaauaaacaagaucaacguccaaaccugcgcugaggccugagcuguguccgucacuccugcagggcacaggccugccuggccgaaugcaugggcggugagagcacagggcuggggggaccccucugucgaggggccacagcuccucacacagcagagcuuuauggaugaaagggcugagaggcacagacaggcugagaaaugggcccaaagucccacagcauggagccaggagguagcagacggccccugcccgccccccucacuuggcugacugcucccacggcagccaccaccuuuauccugagucccgggguccuccaucaaaucgcugagccucggguggucuuguggaccccagcuugucuguguuguguugacaacaugggccuggcuaccggccuaagugcacuucugaggggugucagggaagccuuugcugcggcuuggggauuacagaauuuuaaacagcaagaaccuucccuuugcuaguccaagcuucccuuuguaugagaaacugcuuacgucuagagaggaaaaaugguugagaaauaggaggaccagagaccaaucacgcggaguucuuaaucaugugaaaauauuuuauuuugacgugcuuuuucuugagugccugaaugugguggcucuuaggguaaccccagaauccucacugcggcaacaagaccuggccaccacccucaccucgaccaccacggccuucgcugcagccccacucugacuccccgggggcugcucacgugccagcacccacuggccaagcauccuccggcaggacccaaguccucuguauucagaggccgacccugcuuuccagagacucacgagguggcagagagucaggcuguggcaggggccccuguguaucgaggagaggaggaagagucugcagagguuucuagggaaggagauaguguggaagugacuguggcucugguccugccugggaggagaucuacaggggaggggccuggccuugggcuggcccugcccugcgugggaucugugcccugcgugggaucccugcccuguguggggugcguggggucugugcccuguguggggugccugcccugugugggguguguggggucugugcccuguguggggugccugcccugugugggaugcauggggucugugcccugugugaggugccugcccugugugggguguguggggucugugcccuguguggggugcguggggucugugcccuguguggggugcuuggggucugugcccugugugagcugccugccccguguggggugcguggggucugugcccuguguggggugccugcccugugugggaugcauggggucugugcccugugugaggugccugcccuguguggggugcguggggucugugcccugugugggaugccugcccuguguggggugccugcccugugugggaugcguggggucugugccuuguguggggugccugcccuguguggggugcguggggucugugcccugugugggguaccugcccugugugggcugcguggggucugugcccuguguggggugccugcccugugugggguguguggggucuguacccuguguggggugcguggggucugugcccuguguggggugccugcccuguguguggugcauggggucugugcccugugugaggugccugcccugugugggguguguggggucugugcccuguguggggugccugcccugugugggaugcguggggucugugcccugugugaggugccugcccuguguggggugcguggggucugugcccuguguggggugccugcccuguguggggugcgugcggucugugcccuguguggggugccugcccuguguggggugcguggggucugugcccuguguggggugccugcccugugugggguguguggggucugugcccuguguggggugccugaccuguguggggugcguggggucugcuacacgcuuggugagaaacugcaucagggcuucccgccguguguugcuaacauccccacacacgugagugccuugggacccucgucaacacacugagcugaggccacugguccacggcacacugcagugcacaugcccuuccuggccagaggcucccaggggcgccaugcucuccaggcaccugccccgccugcgagcacagccuggccccugcugcacucugcucucucugcccgcucggguccacugcagcugagcgggugggagaagccucuucaacuucacacacuugucgccucuagcacugggcaaggucuggcauucagaguuccaagaagucccacagauaccaguggcuaagucugucuucccuccaggaauggggaagcaggagccgucagaacagccgucuccuaucugaggcaccaggaacaaacaugacgucaggaaaagacugaaggugccaagcaccuaacgcugaaggaaccagcaugugccuggcagcacugcagagagcacaccccaggcaccagagaccagggugucauucacaggucaaagcaaaauaagaaaaucauaauuuuuccccuuguuccaaagaaacauccacgugcagagggcaggcagcuucggcccauggcgcuccugacgagggcucccucguggcugccccaggacaagcaggaccccggcgguccuaggcagggagaagcgagacucagggucacagacgaaggcgcaggagaaacagcggggcaggaggcuccccagaaccccagggaggccaggcaaugaugcacagcaaccucaaaaacauucgcugguugacugauuauuuauuuaucuauuuuauuuuuuauggacagggucucacucugucgcccaggcuggagggcaguggcgcaaucacggcucacugcagccuugaccuccuagccucaagggauccucccgccaaagugcuggaagggugaagggugugagccacugugccuggcuacuuuuagauuuuuuaaguuuugggaaaccuuacacauauaaaaaaguagacaaaguaguaucauuugaagcaaaucccagauaucauauaauuuaauaugaaugcuuucagugauaaggcuuuuuaaacugagaccacccuugaggugguagaggacagacuucaaaagcagauacaagaggccccgggcagacagggcaggcagagcagggcaggcaagaugggcuagaagucccagggcaagcuggucugagagggcucggugggcagagcugucuuggggccgggacauggcaggugccuucccacuccuugcugcacccacagcccuuacagaggccugguccuaggacgggcucuugcccagcgcucuggaagacacagaggugaugcugucacaugcucacgucugccuggacagccuccaggcugcugugcagggaccacgcggaugcacagccucggggacugcuuuaaacugggcugauucacaacagacagaaucacauuguucuuggcaggcggcccccagcccugacuaagcaccgcagaggccacaucuccauggcacuggaccgcgggcagggccgacucaacccugcaucugggaggcgggaagccauccccacagcaacauggaggucucugagggagacgugccagccucugccacuuggacacagccaaggcauccggcacgguggugacccugcaucccucccaccauagcaaggggcacccacaccccuccagagaggccugacugcuggggaccagagaagagucucuugucugucacgugucaguuaacccugcaccaauguuucucuucucaucccugcuggugugcgccucucccuccaccccacucauuucugagcaagaacggcuccucugggggaaggaggggacgcggcgugugugagagccacagcgcccagcagccucccggcccaggguggggcugaacgcacuggaguuggacucgcuacuauuuauuuauuuagagacggagucuugcucuguugccaggcuggagugcaauggcgcaaucuuggcucacugcaaccuccaccuauuggguucacgcaauucuccugccucagccucccgaguagcugggauuacaggcacccgccgccacaccuggcuaauuuuuguauuuuuaguagcgacaggguuucuucauguuggucaggcuggucucgaacuccugaccuugugaucugcccgccucggccucccaaaguacugggauuacagccgugagccaccgcgccuggcuguggacuugcuacuuuaagaggguccugguuaaaaugcaagcuucuaggauaagcaacgcuccacacucauacaucagaacaaucuuccuaggaaaucuaguuuugcaacauuaaacaagaaguuauuaaaauuggccccgaaagggugauaaacacaggaggacaaauacuacguuucuuaggucuuuuuguuacaauccuugccuggaaaauucuauuuucaaaauguucuuuacuguuuucccaccucacagggauucucaccuacccuguccucaccuaggccugccccucacagaguaaggacaugguguucaacacgcaguuccaggagcacccagggcuguggcagaaaauaucccagagacccacagagagcgagaauggccucagugggccagcacggcuggcaccacgcaggcgcuaaccaucaacagacagaccccggaagcuucugacaacacaacagggcccugggugagagcuucucugcaccaugaugaaacggccaccacaaagagaccugagcagccagauggggugggcaccagguagcccugggaacgccaccuuaccaagugggaucauucucccaggaagcagaagcagaugcuugucucauuaacccuuucagcaacaccuccagagacaucacagaaacaccucaaaggucugaggccaacucccgcauggccacugugcaaagagcuaacagcuacguaucaacaugacggccuucuacaaccaaaaccagcauggggaccaaagacggcaaacacaggguuucaggccuggacugacuuucucuaggccuaaagcccgagaguacacagcaccgcugggagcuccagggagucacccaggcccucccuucugggggcugaggucccuuacacaacccauccacacauucuguccacucacuuccccgugucucccaguguucuuccucggagcuguccgcugcugggaagaggaguccuccugggccugugcuggugucccugcagccuuccuguccccagaugugcuggcccagagacaggagccaugugccuggcacugcaccugccccucacuucccaucugggaaaaccagcccucucugcuggccuuucacucagcagagucuccaccuggcuacugugagcacaucccuggagcaccccacauaggacaggaggggccacaggccugcggcagccacacaaucauaaaggcugaagcuugcugagcugugcugacaaaagcugggguguggauccucuuuacuggcugugccugcugccguuccucuucaacaaucuccuucguaucacgagcucuucucaccuggaccacuucccccaucugcucucaagcccgcauccuggcacagccucuacgccuugugcuauggcugcauucaagaagucucaggaagccagggacagagccgagggccugacucagcacucucccgguucacuccaggcuuuguggccagcuuagugcucuacugccuccaaccuuccccagcagggcuguagagaagcuggaugaccaggaggacaaggaggccucuggacacaagaaucaccaaagagcaagcacggccagcgcagaggccucugggcucccugcaagcagcucaagacagaauccacugggaaggugucacugcagaaggcgcugaccccaccaggagcgugugcacaugaacacacaugggcuugcacacgggcacacaggcaugcacacaugggcacacaggcacacacguacacaugggcacacacaggcaugcacacacacacgggcgcauacacaggcaugcacaugcacacacaugcaaacgcacacaugggcauacacacaugagcgcacauauauacaggcacacacaggcacacaaaagcauacacauacucaggcacacaugggcacacauacacgggcauagacgggcacgcauacacaggcacacauacaggcacacacauggguacacacaagcacauacacgggcacacacauacauggguacauacaaguacauacacacacgggcacacacacgggcauacauacaggcacacacaugagggcaugcacacagauacacgggcaugugcacaugggcacacauacacacaggcauacacacuugggcacacacucuggcacaggcacacagcacacacauuccugcucugcagccucagaccccgccugugcuugggaagaccucccugccuccugcucacuuuuagggcucccuuugguuuuuacuacaagcaauggaguuucuuccugugccuuuguggcccugaggggaaccacugucucccucccguguccagcugucagaagacccacaggugagcagccccauaccucgcccagggcuggacaugcaccgggugcaucuccacgugugugggacccaagagugaagcucuccaaucggccccaugggccugagccucgggugcaaaggagguggcaugugggggccugugcuccgccccugcugccucuugccuggacggcgugcagggugcuagagugcgucccagugcaaagccggaggugcgggggccagggacgcccugccugggcugcuccgggcugccuguggagggcugacugcaggaggggccgcgggcugguaccuguguccgaguccuucugcuccccauuggcgcccgcggugaagggcagcuuccgcuugcuggcucgcucccucaccuccuucccgccaucgccacgcuccaguuuuggggucuugguuagagaaacuuuaucuuuauccuagaaaagaaagggaugcuuucagucgugauguccaaauuacauucucaagcucucaagauuuuguuucauaugccaggagaagcgcaucucuuauuugggcaaugaacacccucccugcaccccagggcguggcugugugaggcuggucaccgaccgcagaaccuucacccagaagcccggggucgggcuguggcucagcccugacucuggcccauuucucauccugcgcaccggagggacgcucaggaaaucgcugguguguguggagaaagcagaggagacacacacgcgcuaccucucacuccgcagacacgcgcuaccucccacuccgcagacacgcgccaccucccacuccgcagacacgcgccaccucccacuccgcagacacgcgccaccuaccucccacuccgcagacacgcgccaccucccacuccgcagacacgcgccaccucccacuccgcagacaugcgccacuuaccucccacuccgcagacacgcaccaccucccacuccgcagacacgcaccacccaccucccacuccgcagacacgugccacccaccucccacuccgcagacacgcgccacccaccucccacuccgcagacacgcgccacccaccucccacuccgcagacacgcgccacccaccucccacuccgcagacacgcgccacccaccucccacuccgcagacacgcgccacccaccucccacuccgcagacacgcgccaucuaccucccacuccgcagacacgcgccaccucccacuccgcagacacgccacuuaccucccacuccgcagacacgcaccaccucccacuccgcagacacgcgccaccuaccucccacuccgcagacacgcgccaccuaccucccacuccgcagacacgcgccaccucccacuccgcagacacgcgccacuuaccucccccuccgcagacacacgccaccuaccucccccuccgcagacacgugccaccucccacuccgcagacacgcgccaccuaccucccacuccgcagacacgcgccacuuaccucccacuccgcagacacgcgccaccuaccucccacucugcagacacgcgccaccucccacuccgcagacacgcgccacccaccucccacuccgcagacacgcgccaccucccacuccgcagacacgcgccacccaccucccacuccgcagacacgcgccacuuaccucccacuccgcagacacgcgccaccucccacuccgcagacacgcgccaccucccacuccgcagacacgcgccaccuaccucccacuccgcagacacgcaccaccucccacugugcagacacgugccaccucccacuccgcagacacgugccaccucccacuccgcagacacgcgccacccaccucccacuccgcagacacgcgccacuuaccucccacuccgcagacacgcgccaccuaccucccacuccgcagacacgcgccaccucccauuccacagacacgcgccacuuaccucccacuccgcagacacgcgccaccucccacuccacagacacgcgccaccuaccucccacuccgcagacacgugcgcuaccucccaggagggagacggugcgacacacacagcgcuugggacguggggagggggacggugcgacacacacagcgcucgggacguggggagggggcagugugacacacacagcgcucgggacguggggagggggacagugcgacacacacagcacucgggacguggggagggggacggugcgacacacacacugccuuuccccaucaguaagccuucuuucuguaacuuucccuagguaagcugccggcaaauaccgugcaguggucagcgaagccuucagagcaccggaggccucagcugcuccagggcugagaugcccaacuguuccugggagaagcccaagcauccccagccacgguccugccuccugggacccugauacaucuuccagcucagucacucugcauccaccaaacgugcauccacccaaccugcauccaccaaaccugacaguuaaucugagacaucccugagugaccaugaaagagcuuuccagaacaugcugcaagcucagagugcaacuggagucaaagagaagcugccaagcagaccggagcccaccucuccagugagacacggggacaggaggagggugccagacgggucucuggggagacggggccucaggaacguaacacccaccccagcagugcaggucccucccgggccuccggaggguuaacacccaccccagcagugcagguccucccggcccucggccugggugcccagaugcagcucccccgccgccuggcugcagcuccacugagcuuuucuauggcccccucggagugcaguccccaccuggaaugagauaggcaucuuccuuggggucggggaacgccaggaaagaauggcacacaccagcaagaagcuccaaucuuaaacuccuuccuccaagaacacuccuggcccaggggguggguuccaccagacaucugaagagaggccaccaucacccuaaucucagaaccugaugagggaaaguuucuaccaaacaugugaagguucuaccaaacaugugaagaggccaccaucaccuucaucucagaaccugaugaggggaagguucuaccaaacaugugaagguucuacccaacaugugaagaggccaccaucaccuucaucucagaaccugaugaggggaagguucuaccaaacaugugaagaggccaccaucacccucaucucagaaccugaugagggcauucuaugaaaagaaaaugauaaaccaacauaccuuaugaacauagacaggauauauaaaaaaagacaacacaaaugauaggaauaagaauagauucgagaaugcaagacauuuaaaaagcaauguaauucaccacauuaagaaaauaaagaaaagaaaaccacgugcucaugucaacagcuacagaaaaggccugggauaaaauuccacacuguuugugaugugggaggaaagccccacacugaucaaggccuccagggagccuggacagaaggaacacuguccccagguccacggucaaggcaagacugccuacaggcaccacccaacaggcacuucacaaaagaaaauauccaaauaagacaacgaacaccugaaaaggugauucucaucaggaaaaugcaaaugacagccacgaggagaugcacaccagcacccccaccaggacaguugggagaagacaggcccugcagaccccagcaaacgcccgggaggcuuugagggagagcugcaggugcguuucccaugacguguucacaaacaagcacaaggauguucaaggcaguuuuguucguaauacaaaaaaaaugacacaacuaaacugcccguccaaaggcaaaugaacaauucuagaauacaaauggaauaccgcagggggugcgcgccgugagaaacgggugcacaccaugagaacggggacgugcagcaucaacacugagggugagcgccaugaaaauggggugcgcgcaguaaacacaggaggugcgcgcagccucguggaggagccccgugcaugcaguggcagaugcagcgggcaaccaaggugggaacaucuguaccccaaagaucagcccuccucuggaauaagacugggcucaaucccuuucuucacacauggaagcuucuagaagacagcacaggaggacauguucaccaccagaagacaagagaacacacaccacaccaccaugugacgccaccacacgcccaaccacacagacgucaggcccacacacugagcccuggcagggauguggauucccuggugguucuuggggcacacuggcucaucgacagaagagcccacaaaugcugggcauggccacagccacgaagggagagaaugccaacaggagcaaaauccugcaagucagacacuguggagcaacugaugucucccacggaaaucucaacagccaaaaccuaccaguggagacagaagucagggcagaggugacuuuucgaauggggaacauuacugaaggccccuagcacuccggaauguuguguauucucaucuggguggugauuaucccugguuuuacagaugaaaugccagcuauaaugucuaucuauaguucacuuuaaaaguucacaaauuucuuuuucgcuucccagcuccuuacaccucaacgagcugcgcaaggaaaagcacacaugggcaaggcgccugugugacacgaggcuugccccgagcugccuacaacagggagcguggcacagccaccaggaaggcggcucccauccaccugggcucagagccugcugggcagcuggggugggacaggcccuguuucggccccucuaaccuuuccucaccagcacaagaggacugucagcaggaaccacgugcacaugcuacagaauguucucauuuccuaaaugcaaauaucuccaacauuaaauccaauccuuaccaggcaccuccuguaaggccccacuaugccccaaggaccaccagauagugacagccauggcacaaugacccugccgggccccaccagccugccggccaccuggcuucuccuccuuaugacacgagguaggcucugcacaugucauaugcagauucccuaucacaucacgacuuccacucaugggaagcacacacagaggaaagagaaaguuguaguaacugaaaaauggccacguccaguugacacccucccccuggagcucaaucuuucugguaagaaugagagucguguuguccacugacugcagcacagaggugccauccgguccuuccaguuccaucaccagcucagcugccuugguauccaaacugucuaugugcgggguccgccuguguguggggugcgggguccgccuguauguggcaugcagggucugccugugagcucucuucuguuccacucacccaugggucuguccugcuaccaagaggaagcacacuaccucaugccuguagcuuuagaggaagcaaugaaacuacacugucugcauccuccaauucuguucuuucucaagguggcuuugguuauucuaggucuuuucaauuucccuauuaacuuuggaaucgucuuaugaauuucuacccaaaaaagcccacagggauuuuggcuggcauuacacugaaucuguacaucaauguggagagagauggcauccaguuuugaggguuuccugaucuaugaauauuguauaacucugcauuuagguguuucugaauuucucucaguucucaggaauauuuugcagcuuucaggguacagguuuugcagcacaucuucggucaaauuuaccccaaaauaauccguauuuuuuauacuacugcaaacauuuuuacaauuucagcccucuauuauuuacgaguauuuagaaauacacuucugcauaauggguuugcacuggaacaccaugcuacgcucacugauucuuguagcuuuugugcagaugucuugggcuuuccuccaucaaugucugugaauaaagacaguguuccucuuuccucuucagucugacuuucgugcugccuggagucugcaggacgaugcugacugcaguggagauggccaguguuucuuugucuguucucaauuuuagguggaaagaauucagucuuugacauuaaauaugaugucaguugcagguuuucacagaugcucucugucagguugaggaaauuccucucuauuccuaguuugcagaauuuuuuuuaaaauaaugaauguguguuaacuuuugucaaauguuuuugcugcauuaguugguaugaucacaugguguuuucagucuuauaacaacuugaacugauugauauuggagguucaaccuugaauucuuggaaucaacccuacuugguuggucaugguacauuauucauuuuauuuuauaagcugaugaauucaauuugcuaaaauucuuuuuaaaauuuguauguuuguguucaugagggccauuggucuguaguuuucuuauccuguaguaccuuugucuggcuuugguaucaguauaguacuaacacaacaacugucuaucuagauagaaaacaagaaccucuauguuuaccucacaccacauacaaaacaugaaccucuacgcuuaccucacaccauauacaaaacaugaaccucuaugcuuaccucacaccacauacaaaacaugaaaaucuaugcuuaccucacaccacauacaaaaauuaacuagaaauggaucauagaccuacaucuaagaacuaaaacuaucaaacuuacagaacacaggaaaaacuucugugaccuucguuugccaaagauaggauuuuaaaagagagcacgaguucuagaagaaaauauuaaauagaauggaccucuaucuugggaguugggcaagagugaagacauggaggcugcucagagcacccuauacaacacugucuaaggacccagagccaaggggauuuucuuggcuuuuucuuucuuaaagugggaaguuuuugcuuuauucuaauaaugaaaaucaggaacacagggaaggacuuccacuucuuuuuucuuccccgacacagauucucacucugucacccaggcuggagugcggugaugcgaucucagcucacugcagcccaugccucccggguucaagcaauucuccugccucagacuccugaguagcugggauuacaggcaugcaacaccaugcccagauaauuuuuguauuuuuaguagagaugggguuuugccauguuggccaggcuggucucgaacucccgaccucgggugauccucaugccucggccucccaaagugcugggaugacaggugugagccaccgcaccuggccaggaacuuccacuucuuaaacgugaugugagaaccugaggagcucggcguucacagcaucagguaagccucagugcagacggcauguggcagagcugagaaugcacagaaugcaaauucgcugcuucagagcuaaaccuccagugggaggagaugaggacaguguguucuacagagaggaaucacgcaggggaggggcggggcagggcggaggcagcaugcaggcaugugaacuggguggugggggaagcccaacugucagguaagcagaaaugguaggagcuggcgggccacaggccgugugcucugagcccuaagacugggaagagaagcggauccaaguccagcaagcccagcaagucuggcuuccucugugaugcugcucuauguccuuuucugccuuagugaaaagauggacagaaaucacccucuccacgagcccaugugggcccacagcggucucaggggugugugagcccagcuucgcccuccugugcucucgccaucagacacggccuccugcuccucccgaagcaugcgggggaguucugggcucuguucugaguacagaccccaugccagacuggcucgugaaaccacagccugaggugggacacgccgaggcccagccaugcgccucccagcuucucagcuaaggucacucuggaauacuuaucuugagggacguagcucccagcuccccaccugcagcacugacaaagcuaucuucggggaggggccucagaccagaugugagucuguaacuggcacagacuggggggguuucugcugagacucgcuggagggcucacaugcucaguucucaacugcagccuccaugcccauggacgccaucuccagccucucggccuccacacagcucgccaggucucaguggggcugugaauguggguuccuaacaagcuccagcagcucaggugacugcucgucggaggacacacuuugagaaccaccaagugaagcucagggggcugugaggcugccugugcucugaguggcgugcauggagcacaaugagacagggugacugugccaugggguggggacgacaggggacccaugggguggggacgacacuguucucuguagcccugcacaccuuuggaucagaacacacucaacgaugcagacaccugcugguucuucccgaggcagcucagcgguucugggauuccguggucggcaauggugagagaccgucugcagaaggggcccuuucucugacacgccugccacugugcucacuggugcagccaaagggacacgcacaagccgucaggucagcgcggcaucaggaugcacugcagaguugugggcuccauuuccaucuuccacguauaugucacugagaucacgauucuuuuggaaaaaucuaaaaauauauuguuuuugauaacauaaagcuauaucuggagaaaagggaguuuaugguagaagacugagcagaaaccauuucagccuguaccaggagaaggcaggucagaugugugcaccugaguucuggcacuuggggcucacuuccucccuaaggaauacagccucuucuaacagcagcugcaaccaggagugcgucuucccaggcauucuauuucaagcuacuguucaagcuaagaaagcuccaccaggccugagagcucccuacucccuguaaugcguuuaaaauuugucugccuccaugaggaaaaugccuggcuuuacugugaguaguuggaaaaacaaacaaacaaacaaaacaggacaggcugggugugguaguucacgccugugaugcggaagcugaaggaucacuugagcucagaagcuugagaccagccuuggcaacaugguaagaucucgucucuacaaaagauacaaaaaugagccggguguagcggucugcuccuguggucccagcugcaagggaggcugaaguaggaggacugcuugagccuggggcaguggggcagggugggggguuauggagggugcagaaguugcagugagcugagacucuaccacugcacuccacccugggugacagagucagacccugucucaaaacaaacaaacaaacaacaacaacaaaaaaccacacauacaacugaacccauaacacagcuaccuuacuggaaaagcccagagugaaauccacacaucccucacagcacacgugugaacagagcucgcaucgacauuaucaggccaguucaucaagucucucuucuccuuaaacaagagaacaacucaaagcagcugagcgcacacaucagcgcuggggcugccggcaaaucaggacacccugccuccugcgccaacacgaccugcucucuguggcucuuccggccuuucucgucucgugcuacccugccgagacugccuucccugcaaguccacugacacagggcuccaccacgcccagccugcuggugugucaagcggcucagagaaccaccuccucaauaagcauaucugagaccugagccaggagagcucccucuuuccuccacugcuuacugaucuucaucagaccaggcacagagaacaggagugacaggugccaccucgccaucaaugccagggccaggaucuccuuuccccacauuccuucugcauccuacccaggccaccacuaccacccuuacccuaaaaccugcgggcacagaggcugggauccucugugaagcgcaggccagguucacucagcagucuguucacacagcugcuccagaacuccagcaucagacccucaagggcacaacccaaaucucuuuguuccuagagcacaccccaggugcagaagccaagcagcccuuucacagacguucugagguccugggacccccacccacaucacccgugugaacaugacagguuuuugauccaaacacacagcucacgccuccacacucucggggugaaaccacaccauacacgaccucuuugggagccaaugcucaguggaggcauggagcaugcugaagccgaagcuugguggcaguggcaggagcucaagaggaugggggcgaggccugagcuguaugcaaaguauucugcacccuugcagagcuggcugcuccccgugaaugcugagucccaggacccaaccccacgagaugaggaagaugaggccagggcggcgacgugaagcuaucccaacacucugacugcuuagccacagaagagcagggaccaccgggaagcgugaccugcccuugcgccuuucugccucacugcugaaggccgcacaucagcacccugaccacccaccuccucaggagcucagcaggacacgcccaucacgaccaccaaacccugacucuccguaggcuucacacacacguguguccccgccugugagcucggcgguguggugcugaccaagcacuggcuucagcucauccuucgcugguggcugcaagccauggaacccacccagcccugcacacggcacgaggagcuugggacagagcaagugggagcagacacuuggaugcugcccagacaucaagggucucagagcugcugucguuuagcaccugcacguguccguauucacaaaaugcuucacgauucaccaaaaagaaguggacugagucgccaucauguugcugcugaggggaaggccgucuugcugguuauguucgcguguggaaccccugcugagcucacaccacaccaaacccacaacaugagcagagaggcugcagcacagcagcacaggaagcagcaagaggccucacagguagugaccuggggaccagaaggcggcccagagcaaccggcaaccaggaacacacugaggggacccugcccaccagggaccaccgagggucagacaggucacagaugaacggccugccacacuggccaagaaguuaggaggagcaaggaggcacgaggaucaaaggacgacagcgacaggauggcaggagcugacacacauccugcacagcaaggcccugccucaccauucacuccaccagacacgauacugugccugcugcagagacaggaagcugacucaggagacaccugacuuguugacggucacaaagauaacacauggcaaagccugaacuugaaccuggaucuguccaaguucacauucgcugggcacaccccagaacucggcgucuccccucacagugcaggacaggaagucuguacuuccuaacaccccagaacccagcagcacccgccaauacugcaggacaggaagucugcaccccaggaaacugcaucaccccccacacugcaaggcaggaagucugcacaccaggaaucagcguuaaccgcacauuaauaaaaugcagugguuuugauuggcaucccauuuuccuauucacauuuagaauaaaccacaguuggaaguaacguggcccagcauugcuugcagucaggauaucugaaugccugacaggccuaacaggagccaggacagaaauccuggacuucuggggguagaaacgugcagccacauugaggcucaggccaacuucuguacauaaagcuauuauuuaacgcuugacuucgguccccaaauaacaaauacaaaaaaagcaaggccacuuugggaaagaucacuccucaccacccucuccacuccuggcugcagacagaggcacgaggaaagggccggagggcggagaacaggccacaggcgggcagcaccccauucccaccucauccccaucugggugcggugagcaugcagggcugggagggggcagcauuaccuuuuucccagucugcuucuccaccaugucgcugcugaggggaagcucuuccugcuguggugcuuuagggcacccacccuugggcaucguccugcuccucacccgaucuucauuuacacggccggcgcuucaucaucaaccgucugcuucaaaagagaagacacacaauucacugaauucagaggcagcucaaaacucauccacucucacaccgcacucaacagacucaguaacuagucaaggcaggcagcugcucugaucagggcuggggcccgggccaggcccaggaagggacuucucaggauacgccucccauaaaggggucaccagcaacaggaauggcagcuuugagcaggaaggagaacagagaagggucaagcacuuuguaguggcagaaagggacgcauggccuaggguguggcuguguucuggguggcagucagcagcaccuggauccugggucccaccugguacaggcuacacccaaaacggucaggcaccacaaggcagucccuuccccgcauuacaggcaaggucacaacacgcagcgcaguaccccagcccucaggucuggcaggucauguccacagccccagccucacgccccacucaccaccugggaaggagcuccuguccccaccaggccugugcuuuuugcacacccaguucccuaacuugguaggcaaggggugucucugagcgagucccagcagcuccgaggucccaacuccacgcccauggaagcagacgcccccucgggccucaggcuccagcuccuggguuucccaggaaauccgaggacacauacuguauuaauuguauauuauuuuuauuuauuaaucauguuuuauuuuaggaaauuuugccaucuuaacaaguuucuggccagggagagacugccccucucucagggcuggcaaauuccuagauagccaagggcucccaugcaacccaaucaccuucuuacccaaguucacgcccaggccaagcccugccugaaaccagcgcagagccagguaaaggaaacuagaaagugucccuacagcacaaagccugcaagaacuuuccgaagcagccacucccgaacuauuugcucugccccgucccucucuuucugcaggaaacccaacaggcaguugggggaggccuuccccgagccccugcuuccgacucccacccccguggugugaggcugccccucugcgacacacggugcgagcgcacuucuuccuucccagccucguccuggucucuucuguggcgaugccaacuuccccacgccacgccuggcauggacacucucggagcaugggccuccucccugccugugggccuucuagguuuguucaccaucacagccaggccucccgggugcacucacgagaggaaugggggacacaccuacacacccacacccaaagccacuguccccccaucauguccucgccgcaccgucaguuagaaaacauuucauacaaauggaacugugugcacgucucugcccuuuccgccacagcagcaccucugugcgcgaccaugccgggagaagcagcuucugcaacucgcuccccugcauuuacccaucucgcucaugcacgaaguauggcuuuugaaacacgaugugcagacccaucugugaguggcagcuccacugugagccucucccaccuccaccccgucagcuaaaggauacguugcaugccaccugccccuggacgcaggcuuggcugagaccacaagaugcuucuccuccaacaccaucucaugaccugcuuugucuuucuaaaauaaaugauaaaaucccaccaacugcugucuugguauuuaacugguacaagaacacaggugaaguuauucuggagagagggacaggucgggucaacguauucacugccugacaccuccacccgcggugcaggugagcagguguuuccauccaccaucccugaugccugaggccagacauauuuucucucucuaccugaaccaaugaauuuuacauucucuuccaauuuuccaccacaaaaccggaaugucucagccuggagaaagggcaucucagcaccugacucggaaggcuguucaagcucauggcugucuagaaacucagugguaauguuuacaaguuuaaggauuaucuggaauuaacauuuuaaaaaauccagacugucugcucucaggacggaaaaacggggccuucaccauguagaguccaccguccugaucccagaugugagucuguggcccacggacacacucaacagcucuggcguggucagggcgcagaccccacggccuccggacggugucugggccccgacagugcggggcuuaucacuucacuccugagacaccugauucucuucaugucccuagcuuggugcuuugcccaggcaccuuccccaauggaccagggaucugggaguccacucaggagguggaggaagugggucgcacccaccaggcaaaauacuuuucacggccugcaucacagcgaacacuccggggacucgggaguguugucccagguguacgcuguguuuucuggagacguuucuccagccaccugcacgaugacagcuaagaccauccaggccguggcccuuccaggacccucguguccgccuggccuuggcuacaacauguuaccgauggcagcgaugugcucgaggcccugcaaccccagcccccgccucuccaugaaccaccacccucaucacagucauggagauggugacagcugagauguccugcugaagcaucugcuggauguggaugaagcugguuuggauguagcugccaucuagcccaggcuacaccucccaggacccgccugcaggcaccaggcgugcagcacgcggcccacucuagagucuuuuucaaugagagaccagaugaggacagaggcuccaguugcuuuuguucuguuccaagacuugccaucccaguccucccagaagcugcccuggugaugccucuggcaccuuuggcccccacacugcccuguguucccuccaccaggcucagggcuggucagccucaccccuugccgugaaauggcagagccagccgagggccgaggaaccguuacucagccgugucagugacuucuaccaggggcugcacggcacucaggagucaggccaacaggcucugcugacucauggguguugucugagggugggggcugugaugauguccccaggccucccuggcagggcugucacauaaaacaguccuugaagcugggaguccccucuuuagacaguuccgcagccccugugccuucucaucacgaugcugcacagccgaccacacaacagaaggcaccgggucucacucccgggggagacucuucccuggaaggugacuuggcugucccugccuagacucauuuuaagugcagccuaaaucucccucauuuccaaguuaucaggcaaagucuauuuuaaacucacgacccuugaaucagcaggaaacugaaacacgccucaggccacuggggcugacucacgcccugugcugagcggcaaggcacagccgcgggaagguaaacgcagagccgaggggccggccagcaccuggcccugaccgcccccaggccacgcauuccuuguuacuucaccuccuggcggauggcaaccgucccagcuucguggacugucagggucaccgagaguccaggguggugggagucccccacacgagccacuggcacacucccugaagcagaagccacggcgccaaagcugugggcucagggaacuugcccauuaccuggcagccccgcaucugugccaaaauaagacacaacucagcccagcggaguggacagugucugcggccagcucugggauccagggccagcugaugcugggaacagccguccuugcccugugccucuccacacugcgagagccccugcagcccagaggggcuccaccuccccugcaauggggcucaaaagacaauccuucuacggggcuggcaggacagacgugacaggaacaacgauggccugcuccucccggaagguggcuucaagagcacucaggaggugacagaugcugucaagaccggcccagggaaggcacagggcagguuucccagcacccaccacgcgccagcgagcacagagccuucgccugaaccauccaggcaccgcgcccucccccuccgcacacacaggagcccagcugcgauucccucugcuccacaggagaugcagcgagcaccaaagagccuuccuccaggauuaagccugaugcagaagugguuacacugacuacggcaaggucaguuuggcaaaacccccaggaauuucagccuaucuggucucuucagcugacaagagcaggcacugguggggaauccggcgcugccucuccccggcuucuaggaucugagcugggccaggacaacccugagacaccugucgggcggggcaggacuggggcugcagggcgggacuguggggaggggacuguggggcggggccugcagggcaggguguggggcgggagcugcggggcggggacuguggggccggguggggagccgcagcugcggggcaggggcugcccaggagcacuccuugccagaggccuuggcaucaccagggaguccguggaccauggagacucacggguccccucgggccuucugaacccaaaccugcauuuuaagcauguucuguucugcacacuaacaccugagaaggaccguauaagaaaaaacuuguaaugacacaacuaaucuuaaaacucacagaaaaaaaaaaagacuucuuugggguugaaauucaccuucaauaaagggauggaauguaagcagagcugaccaugaacaaccugggucuggguuugcacugcguggguucacuuacacgcagauuuucuuccaccucugccucuccugagacagcaagacccaucucuccucuuccucuucagccuccucaacgugaaaacccggaggacgaaagccauucguggagacccgcugcugcugcgcgaggcuuaagucuauuuucuccucaugaucucaguauuuucacgucucuaguuugcucuacccuaacaguaagagcagaacacacauaacauacaaaaugugugugacuggcuuuauguggucaggaaggcucuggucaacagaaggcuguuaguuaaguuuggggaaaguuaaaaguucuacacaaauuuucaacugcacaggaggcuggcgcccccaaccccuguauuguucaaggguuugcuguaauuuguauuaaaacaccaagcccccuuacaccugggugagucucucucccugaacagaugugacaacauuacccuccgaagacucccagagagaaagagaacacuucaaauucagauuugucuuccacaguauguugauagaacaggccuuuacguacguccugggcaaaugcuccucuccuuauguaaguuaauaacuccaccaaccacuaguuuguguaaugaccauuuaaauaucgaauggugcccaaggccccugagaagggaugugauucagccccuccccucacgcaggcacguggccucagaggcccaggaggaggaagacaggaagucagcagcaggguggaaaaggggagggaagcccuucaagggaagcucucccagaaccuucaaucccagcuccaauuccaaagacaggaacacacucaugacugacaggaucaaacaccaaaggccuguuugccuugagggggacacuggggaggguggggaagggggagugaggaggagcuggaagcagcaguccuguguggcaccaggggcuugcucccacgucggcccugggcacagccccgcauggugaugagguguggccugccugcagcacacggccaugcuccagauaccuuagcuuuaucugaagaguucuuuuguuuguuuguuuguuuguuugagacagcuguguugcccaggcuggagugcagcggugugaucacagcucacuguagccuccgccuccugggcucaagcuauccgcucacuugagccucccaaguagcugggaguacaggcccguggcaccaugcccggcuaauuucuguacuuucuguggagucggguuucgccaugcuuccgaggcuggugucugaaggaugcuuuacggcaaccccugccuuuuccagcugagcccugccggcuguugugcgcuccguggaaagggagaagcacggucuccagcggcugcgucaggaguggugccuugugcacaccucacagggagagaagucuccaacggacugagcggaggaaaaaagaaaaaaggagaaaaggaaaaagagcugcauaccuggcaggccuacugugugcaaagcccuugagugacacacccuaugacccacagcacuguggcaaucccagguauggaagagaagcaccacuggccucucaccucucaccaucucagugggcaaggggagagcaagcagcccagggcaggggggcugagccgagggcaggggggcugagccgagggcaggggggcagagccgagggcaggggggcagagcccagggcaggggggcagagcccagggcaggggggcugagccgagggcaggggggcugagccgagggcagggggucugagcuaagggcacgggggcuaagcccagggcaggggggcugagcccggggcaggggaagagccgagggacagaggcccucacaggaaccaggcccucccgcacaccgccugacaguccacgucagcgucucuguccagccuccacacaccccugcacguucugaagagcccuccccaagaguccaacucucucuccuuccuccucagggccgcaccagcucucucuccuuccccuccucagggccacaccaacugugggguuccagcuaucacucugugcaaaggacuccuaacauggguguccuccgucucaccccauaagccacacuggccaaggccaggcaggcaccacacaucgcgagguagaaucucuuugcuacgguuugaauguuugugucggccccuccccugcaccccaaaauucacagguucaaaccaaacccccagugugcccagcuacuuuuuguauuuuugguagagacaggguuucaccauguuggccaggguggucuccaucucuugaccucaugaucugccggccucggccucccaaagugccccacggcacaacgcucucuacugcagcccuguuuccacucacauuuucuguuaucacggcgggggguggcagcaccgagagcgcguucagcauuacuggccucugcuuugccccucagacacaugcuuggucacugggcuguggaacauacaggagccccgugcuccggaacacggaccacccgacaggagcacggacacagcagucggggcgacgugggugccucacagaagagggaaaaagccaggagggcggcacgugggcgcaaaguucucagcuucguuagucaucaagaaaaugcaaacuaaaaccaagguaagugugaggguuacuacugaguuucaacuugacuggacuaaaggauguguaacuguuccugggagcaucuugaggaagcugccaaaggagauucacauugagucaguggacggggagaggccgacgaacccuccaucugggggggcaugaucucaucagcugccagcacggcagaucugcggaagcacuggacuggcugagucuuccagccuccaucuuucuuccaugcuggauacuuccugcccucgaacaucagacuccaagugcuucagcuuuuggguucuuggaccuacaccagugguuugccagggguucuugggccuucggccacagacugaaagcugcgcuguuggcuucccgacuuuugagguuuggggacucggacuggcuuccuggcuccucagcuugccaacagccuauugugggacuucaccucaugacugugugagucaauacucccaauaaacuccccuccauauauacauuuauccuauuagugcugucccucuagagaacccugacucguacacacaaguacuggugaagggguggagcaaaggaaacuaguccacucucaucagggccaacucacgcaccuggcaaucucuacucauacugaacacaaguaugcccuauagcccagcaaugccauucuggacauacacguccaaaagaaaagcaggugcacagacacaagagacacgcgugaagugcuucauagcagugggguuugcggcgugccacuaggaugugaggguggaacacuacacagcagaggaggcaaacacaucacaacguaagucaaucucacaaauaauguugaggaacccugucucuacgaaaaguuuaaaaauuagccgggcacuguggugcaugcuggcggucucagcuaccagggaggcuaaggcaggaggaucacuugagcccaggaggucgaggcugcgguaagccaagaucaugccacuguacuccagcccgggcgucagagccagacccucuccccucuccccucuccucucucucucucucucucucacacacacacacacacacacacacagaguaauaauguuggggacaaaauacaugauacauuuacauaaauuucugaaaauagcaacuacaguacuuagggaugcauacuuaguugacaagacauccgcgaagcguggaaaauggcugccuggcggauggaauuggaagggacggugaaacggguucuaagugaaggcugcggaggcguuugcuuuguggucugcuaaguuguacauuuuuacuggguggacguuuggguucucagcugaagcagucuuucagaaggugacagagauaaaggccacacuauguccuugcaaggccucagaggugucacugaccuuuugcugcaggaccuguucuucucaggggucuuggccuccuagaggaaggagggccccaucgcccugcuaggcccuacugggacccucaagggcaugagcaugacgacggagcagcuucaggcuucccagcaugucgggcaggccuagccaugcccaauacacacugcagggcacccacugcagagugcaacagggagcuuggagccugacaaggagacacacagcucugugaagacgaaggggaggaggagcaaggaaaaugcuucuuuuacacagaaggcgccaagauacaaacuaaaugugaugaagacaaagaaaagcaggcguguguguuaaagguacaauugcacagcuaaaaauaaucauggccguaaggcagggacggcagauggagggugacucagcagauuuccuccaaggcuugcgaggguggaaauaaacacacggaagugaccagcagagagaaacacgcagggaagaggaagguuagaaaggucuggggugucacgcaccguugcugggaaugcagaggaggacggucugcagaaggggacgcagccaccgccccccccaccccgcugcagaaggugcacaccacucagcaaccacccacccacugcucaaucuacccccaaauuacacaaauagggccaggcacgguggcucaccccuguggucccagcuacucaggaggccaaggcaggggggucauuugggcccaagaguuugagacccgggcaauguagggaaaccucaucuuuacaaaaauaucaaaaaauuaaucagucgagguggcacgcaccuguaaucccagcuccuugggagccugaggcaggaagaccccuugggcccaggaggucgaggcugcagugagcuaagauugcaccacugcacuccaaccuuggugacagagcaagacccugugugaaaaaaacccaaaccccaaaccaaaaaaacacaaccggggcaugaaaaagugcuuggcccagagcagugccccaaagcaucuccuaagaaaggggcuuaacacaaagccugcccgccaggggcugcugguggcauccgggcacaucugcacguggggcugacaggacuaaggagguuccacagacacacgaccaggcggagacgcagagaaaagcagguacagcaagaaguccacugggcaaugcagagguggggaaugcagagggggaaugcagagguggggaaugcagagguggggaaugcagaggugggaaaugcagagguggggaaugcagagguuggaaaugcagagguggggaaugcagagguuggaaaugcagagggcaccuacacuucugaugacagcgaaauauguaaggcuggcucaaccaucaaucagucaacgucacccagcaugccaacaagcuaaagaagaaacaccacauaaucacaacugguacagaaaaucauuugauaaaauucaaaacucacgauaaaaauuccuaggaaaacaggaguguggagaaacauccucaacacgauaaaggccaacuaccaagaacucaaggcugacaugaucaagagugacgugcugagggcugcagauggaauggcauacagggcagaaaggaagaaauggaauaaaacugucucucucugaagaugguguaaguguccaugucgaaaaucacaaggaaucuaucaaaaauuccaagaaacuuuauuuaauagaguucagcaaggacacagaauccaagaucaacacacaaacaccuauccuauuucugcaauaauccuaugaaaacaagaaauaaagacaguaccauccuauuucugcaugcuaccaauaauccuaugaaaacaagaaauacacaguaccauucuauuucuacaugcuagcaauaaucaaauaaaaacaugaaauaaagacaguaccauuuauaggugcuccaaauaaaaauaaaugcuuagguucauauggaacaaaacuagaaaaaccuauacacauuuuaggaaaaaacaggagaaaaucuuuaggaccuagggccaagaguugucagacauggcaacaaaagcacaauccauaaaagaaaaaacugauaaacgaccucgacaaaauuaaaaacuuuugcucuuugaaagaccuaguuuaaagagugaaaagacaaacugcagacagggaaaaauaucugcaaaucacaagucagauagcaggcuuguauguagaagaaagaaguaucaaacaacaaacauuaauuagaaaauaagagaaaacacacagacauucagaagaggugcacguggugaacaagccaugaaggcacucgacauccuaagccguuagggaaacacaacuuaaagccgcaaugagauauuacugcacaccaaucggaacagcuaaaauacaaaauacucaaggaugcuggagaggauguagaaaagcuggaacucucucgcuugcugugggaacgcaaagugguguugcugcucuggagaacagcaaggcagccuuacgaaccuaagugugcgcuugcugccccacucaacaacugcaccccaggacauuuaucugagaaaauggaaccucaugugaacacaaagaccuguuugcgaauguucacagaacuuucacugauaauagacaauggggaaaacccuucaacaggugucccagcgguguccucgaaacuggguuucauucacaucacggcauccccucagcaguaaaagggauggcuauggauacacccaagcguaugggugaaucugcagaggccccugcugagugaguggacacacccaggcguacgggugaaucugcagaggccccugcugagugaguggacacacccaggagcacgggcgaaaucagcggaggccccugcugagugaguggacacacccaggagcacgggcgaaaucaguggaggccccugcugagugaguggacauacccaggagcacgggcgaaaucagcggaggccccugcugagugaguggacacacccaggcgcacgggcgaaucagcggaggccccugcugagugaguggacauacccaggagcacgggcgaaaucaguggaggccccugcugagugaguggacauacccaggagcacgggcgaaaucaguggaggccccugcugagugaguggacauacccaggagcacgggcgaaaucaguggaggccccugcugagugaguggacauacccaggcgcacgggcgaaucugcagaggccccuggugagugaguggacgcacccaggagcacgggcgaaucagcggaggccccugcugagugagugcacaaagcccaccucuuaggucacucccuguggacucuacucccacggcuuccuccaggacaaaaccaccaaccucggggaaacaggcggggacuccgugaggagggcucaugucugucgguggcugucgaggaggcucuaggaccagguauccaggauaagacgggggaucugaaucaagucugcagggcggucacccugucuuccaaugucauguucccggccacugggcgaagguggggaagggcacaagggaugcugcuauuuuugcaacuuccugugagucuauaaugauuucacagaaaaaaggaaaaaaaagggagaaaaaacacaagggguguaaggagacucccaugggugaugaauagucuauacuuuuaggugaugguguuuccccaacgguauacguuucccaaaacccacugagcuguaaauuuaaaaugagugaauuuuaugucaauuguaauucaauaaagcuguuaaaaaauuaacuagaaacagaaaaaaauuuuaauucccauagaaagaaggaauaaaguaaaaaaacaguaugagguaggagguaagcuuccuuucauaaaccuuguuuuguguauuuggcuuuggaaucaugcauuuuacaucauuuaaaacauuaaauauaaaaugagacugggugcagugaaucccagcagucugggaggcccaggcaggcagaucacuugaggucaggaguucgaaaccagccuggccaacauggugaaacucucuacugaaaauacaaaaaauuagccgggcaugguggugcgugccuguaaucccagcuacuugggaggcugaggcacugggaggcagaggcugccgugagcagagaucacaccacugcacuccagccugggcgacagacaagagugagaccuugucucaaaaauaaaauaaaauaaaauaaaauaaaauaaaauguaaaaacauaaaauuuuguuuauguauucacauuaaauauaaacauuuuaauaauguuuaaaaugauuuaaauauacuugaaugacauuaaacauuuaaaggauuuaaagcauucaauauaaaaauacaaaaagcaaucucuacaacuucaaaaaggaagaggaagcaauacacuuagcuguguguccggucaggggcaggacacaaagcauuugucaacaaugaccaugcagccaccaccacaccaggagcauuccugacagcacgcagcuucugggugggugggaaggcucgggagaccuggcucaggaugugagucaggugcuaggggagccaguggagagggaggggcugcuucccagguggccgcucgcacaccgggagggcugcugcuggcucuggcagaaggcccaaauuccuuggugcacagacacggcugcggauguguggacauguccguggggcuacgugaggguccccgugacguggcagcggguuuccacagugcagucauugaugggguggugugggggggagccacggcaccucugugaccuaguaucggaagcaaggggcugcgugaggguccucgugacacggcaguagguuuccccaguacagugacuggggggggggggggggggcgggggcggaggaagcugcagcaucucuuguaucggaagucccacggcuucacuuccaccucauccuguuccuccucggcgaguuccaaccucuagcccacacucugcagagaacggugcuccacuucugaagggaggcagaucaaagauucuguggacacucuuuaaacuucccccaguggcuuuugauuaaaaccugguaauuugacuguacaguucuaguuagugccauaugcccugaggacaaaaauuaaaauuuugaaaaauauuauaagcaaaacaccuuccuuuuucuugagacggagucucacuuugucgcccaggcuggagugcaauggugccaucucggcucacugcaaccucugccucccagguucaagcaauucuccugccucagccuccugaguagcugggacuacaggugccugccaccaugcccggcuaauuuuucuauuuugaggagagaugggguuucgccauguuggccaggcuggucucgaacuccugaccucaggugaucugccugcuuuggauucccaaagugcuaggauuacaggcaugagccacugcgcccggccugaugaaauacauucuuaauauuaacuucauguguuucuuuuuacucuauaaugaggcuaauagaaaauuuaaaauuagaugcacaguucacaucauauaucucauggacagaacaacucuaugggacagaagaccccgaucucugacaaacaggcaaaaaucccagagaaaagaacaaagggagaauuuacagauuaaagacuuaaaagacaucaaagaaucuuaguguguagacccuguuuggaaaccaguucaaacaaagaacugcugaagaaaauggcacauuuaggaaagagccuuuugauaccgcuggguguguggugacacugagaaaguucaaggcacccagcgauucaggagauagagauuuauagauauguauuuagguacagggucuccucugucgcccaggcugcaguguaauuaaauaaucacagcucccuacagccucgaacuccuggguucaagggauccuccugccucagccucccaaaauauuggggcuacaggcaugaaccaccacaccuagccugugugcuauuuuuauuuucauuuagucuaagauacggugaugguuuugaauguuuucggcggaugcaaugguguggacucggguuugguuccggguuaacgggcugggguggcuccugcacgugggccccacaugcugggaaccgucaucaccacuguguucaccacacucucucuuaagaagggcacacaaaacauucaaaaaaaauuuaaaaacucaguagcaugcaguggcugaugccucuaaucccagaacuuugggaggcugagguggaagggaucauucgaucccaggaguuugagaccagacugggcaacauggcaagauuccaucuccauauuaaaaaaaaaagauaauaaucuuaaaagacacaauuccagaagcugcagaaugugucacagaaaugacuuccuuacguauuaaagaauccucacaauaaaggaucauuuuacaagcagacuauaaacacugaaacagacaaaaaacuaaaaacccaacucaugagaaacaccuggugaacgcucuucagcuccgugaaguccugggauggcccaagcaccucuggugggcuguaccuuuucagaaagaaacacugagccccccaaguccccgaggacagagaugccuuacagcuccacacgucccuccacaacggcagcaccuguacccgcagcucuggggagaaaugacaccugcaggccaagacaaaugcaagaaaacagccucgucugcucacugauucucaccaacuuccucuauaaaaugaggacaagaacccauucuccuaaaggauuuuguggggauuaaaugaaaaagcacuaucuaaauccaaguuaucaucacuguaauggcuuuagaaaaaagcaaacgacaaacacaacgagagaggcgcugagaccaggcagggcucuccuccggcagggccuggucugcacugcccucucugaggaaagugccccgcugcccugaccucccuaguuucacaccuccacaccuccaaggagguuauccugguacaacugagaaagcaagcaauucccuuagaaacguccauuucuuuccuuuaugcucaaauguuuuauuacuccuuagggcugcuuuguuuuuuaacgcaaggguccacaguugagaacguaguuacaaacucaagaaacgagcugcaacagaacagcggggcugcuccacgcuucucagccauuuucccauccugugcacccggggaauuucacacguggucccccagagugacagggaacccccagggaagaagggccccuguggggcaugcagaaaaacgccugcccccuggugugaggucacagacucaguggccaagcucaacaaugcucugggaacuccagucaaagaugcaucacaacuuuugggucaugccuaaggucaauuccagaaucauuuuagcauguuaaacagacacugaaaauaaaacauauuuuauuuuuuaaagcagcuuuagguucacagcaaaauugagcaugaaguacagaggguuccccugcacccccgggcucagcauccccacgagaguggccguuuguuacagcugagaccccccuggacacagcaucaucacccacaggccgcacgaccucaggguccaccgggugcugugcagucuaugguuggacgaacguauccugauguggacccaccguugugguaucauacagaguaguuucacugccccaggucccccguguuccugcugcacaacccuccgucccucccucuccccagccccuggcgucacugaucuuugugcugucugcacaguuuugcccuuuccuggaugucagagucggaacccuacaguguguaguccuuggagacgggcugcuuucacucaggccuggcagcucgucuguuuuuagggccuuguaauagucugucgucuggauggaccuugguugacugauccauucacccucugcaggacaucuuggcugcuuccaaguuuuggcaauuaugaauaaagccauuuugugaaagugaaauaauacagaacaggaaacauuagggggcacugcacaccaucacagaaagggacgguauuauucugugaguauguucccaguaugugggcguguguugugaacagagagauaaacuacuuucucaccacuggaagcagucaggacaauucaaaugcuggccuaacugguuaagagcccucaaucuguggucagauauaucuaaguuucucaaucuauaaaauacagaaauaaggccaggugcaguggcucaagccuguaaaacaagcacuuuggaaggcugagguggguggaucacuuaagcccaguucaagaccagccuggguaacaugaugaaacccuguguuuuaaaaaaaaaaaaaaaaaaaaaaaaaaaaacagagagagagagaaagaaagaaaaaacacuguucccaagcugcgggcucaggacaaugucugaugccuggccuagcccucaucaauggccuucacaaucccugcugacugggagucaacccccagugaguguacugccaauacggccaaguuucugaaguuggugacaugugaggguaccccaagacugaacagaaacaaccuccucucagguucugaguggguccagcucuucuuaccccuccaagccugccauucucugaggaguccucucuuccuccacugcucugcuuccucucacaaagggggagugucccaccacguccaacuccaggcuggcaaagugacgagaaaacaccccacccaugugggcagugggcaugcggcaugcuauggggccaugagaagcagccagguggguaggccagacccugacccagagcaagcagagcccagcgcagucucagccacgcuccaugaggggccacauccacgagggcccaggagcaacaucccaggcacaccccagggaugagcagcacaggccgccaaccacgucauaccacacucacuugugcaaaacacccucaaacugcaaaaagcccacccacguguccaccagcagaagagcaaaugaguccagguggcccacaacacacggggcgcacguguccauagacagcacacuggauucgaagagccagacacgagugugucugcuguggccuucugcaugcaugagggccccauggugcugggggccaggcagacagucaagcagcagaguggaggggagguccaggaggagaucccacagguacaugugacaugagcucuaucguaugugcaccuaagaugugugccauuuccuccacggauguuauaccgcaaagaacaauaaaaaacgacuaacacugauugcugaccaccuccccaaauaacuaaucaggacacacccugaugccccauguccggccugugggggcacuguggaaagcacaggaagugagcucagugcgugccuuccccauuguccuggcguuccaugcaggcugggagacgcgggugacagccucacaccaccccuguucccagaagaggccagugcacccccaagcaggggcugcaacagggcugcacagagggcuccaguuccuuccagcacaggaacaaauccacaccgaggcauccgugagucccacaggucccagaagcaugggagcagcuugaggccucugcauucaggggucucugccguccugagcuucaggaugaguggguucccaccuagcacgcaguacgcaguggguuagggcaggugcucucccuccucucccuaugaacgcuauaccacucccaugaaagccugugcgugcugccucaggacccuguagcagaacagcgagugacgucgcuuuggcagggaaccuuugguuugcaaagccccgucacacacacaagcugagguaagaugacaagucugugucucugcaccucagcugagcccucaggacacagcacaugagcgcccaggggccugcaaacagcaaggaccaaggcaucacugaccgugacaggccccagugugugacagugagaggccccaguguggguucucacaagcuuguuuuacgguuugacccagagaguaccugugaguuuccccuacagcuggugcuucuaaagggcuaggagaaacgcagggcaggauccccacacgccagcagcugacuggccagaccccugccugugcugaggcauccgccgcaaacaugaccgugcaacaugcuucaagaugcccugugacucucucagaugggucuuuuauuagaguuucuaaauaaagaagugauggccaacaucacaggaaaccuuagauacuauuccugccaguugguuugaaaaagcuuuaacuguuaauuugcugaucguuuucagccacacgguuuucugccauguaauccacagaacccaggccucuggccacuuguccaggauaccucuggagcucagagccacuguccuugugggcuacucaagacuugagggguucaggcaagagccacaucaacagagcuggaccuggugccuggcugggagcaggugccggggagcagccaccaaaugcacacacgccagggcacgcaacugcccgcaccuccaagauugucgucagaccuagaggcgggugugcguccacagacagcacacuggauucaaagacccaggaaggaaggagucuguuugcugugggcuucuguggugcuagggaccaggugaacacugaaggaggggccagacggaguccaggaggacuccuguagcaggacauugcccagauuucucacaauguccucuacaauuaagagcacaaccacuguuccuucugcacuggugggaacccagcacuucaaugagacacaagguuaaagugacgcuuuguaaggacggaaagccaccugugggcaccacaccccccgggugggccacgacagggagcacaggcacuaggagacccggccuguccuaaaagcacgcccuacaaggaguccccacucucuaccuaucugcuucuaauguucugacuacaugagagaugauaaaaggguuucaauacaaguguaacauuuuaaauauaaaggaaugucuuuccauuagaaaacaacugcaggccgggcgcgguggcucacgccuguaaucccagcacucugggaggcugggugcgguggcucaugccuguaauccuagcacuuuaggaggccgagacagguggauugcuugagcucaggagguggagacuagccugggcaacauggugaaacccuggcucuaccaaaaaaaaaaaaaaaaaaaaaaaaaaaaauuagccaggugugguggugcacaccugcagucccagcuauuugggaggcugagaugggaggauugcuugaaccuggcaggcacaggcugcagugaguugagaucacaccacucuacuccacccugggcaacagagugagacccugucucaaaaaacaaaaaacaaaaaacugcaaauuaaaacgccaaacgcacagauuaauggaggaagccccaugcccaaaugcucccaaggaaacgucagaaaggagaggacuucagguggcucggaauccuccgccacgugaccaagcccagcugagcacugggucucauuggauuugccaucagacacucacaguuuuugucacuguuaacccuacugcacaauacaugaacauggucuaagcaauucuuuuuuuuuuuuuuuuuuuuuuuuuuugagacagucucccucugucgcccaggcuggagugcaguggugcgaucucagcucacuacaagcuccgccucccggguucacgccauucuccugccucaaccucccgaguagcugggacuacaggcgccugccaccaugcccagauaauuuuuuuguauuuuuuauaguagagaugggguuucaccguguuagccaggauggucucaaucuccugaccucgggauccacccgccucggccucccaaagugcugggauuacaggcguaagccacugugcccggccuggucuaagcaauucuaaccaugcagacaaugugcaggucuuuccuagguggaaagcaaguuugcccaagucgcacgagcaaggcuggagucagcaaugccuguuccucucccucuguucucuaaugguguggucuucagucuacuguguguggaaucccccucuauugggaccacagcuccugggcugcaagcaccugcugagcaugaggguccagcuuccaagcucacugucccacgggugacaagcaacacagugaccugccucccacaucagcuggugccaguaucauggugacucccuacacaccaggaccacugugucgcgcucugccacucaggagccccaggggcccccacuauggccaucccaggacgccgcccgucaggcucccaggacacugccccaagcacccagcuucagugggugugcugccccgagacgcacucucacugugccggggggugggaccucugcagcccagcacguccacucaguguccaugugcugccaugagcgccacacuguguccuccaggaugugggucucuguuagucccuccccuaccaagccaggacagccaccugcuuacaggggugcugacaaauacugacuaccugcaaaauugaaacauggguuugaaaagggccugaguggaaauccuguacuuaacauacacucuguuaaaaaaaaaaaaaaaaaaaaggaccaggcgcuguggcucacaccuguguaaucccagcacuuugggaggccgaggcgggcaaucaccugaggucaggaguucaagaccagccuggccaacaugaugacugucucuacuaaaaauacaaaaauuagcugggcgugguggcaugcaacuguaaucccagcuacuugggaggcugagacaggagaauugcuugaaccugggaagcugagguugcagugagccaagaucacgccacugcccuccagccugggcagcaaagagcaacacucagucucaaaaaaaaaaaaaaaaaaaaaaaagagcgagcuuuuguagaaacagguuuaaaagaaaaaauaaucucugcucuuuucagcauuuagaaaaucagccaggcaaaacaaucauuucccuuucuuagcuaaaagguuugccaaaugaauacuuggagcaaaauaagccuaauuaguaacaaaaaaaucacccagauauaaaugcguaauuuaaacccauaaugaaagcacaugaggaacuccuuucccucaaagucaccaccgagggccucacuggacuuaggacccaggaaggaaugaugaguccaucugcucgugaccugagucucuaaaccaggaggacagacguccuggguaaccgcugaugggugagcguugcacccccaggaucccuguaauuauagguucucaaggacaccaacaccagaauccauaucccaucuagaaacuucuuccugugaugccugccaaaagguccauuuuucaguccauuaucacaaugaaggugaaguuuugcuguuuaggucaaaaucaugcauuaggcaauagaacgaccuagagaugucugaauucccccucaguacaaccaaaggaguaagagaggcccagguuugcuugaaggcuuacacuagcaaacaaacaaacaaacaaacaaacaaagagaaaccaagaacugggaaagcuggucgguagcaucacacaggucagaucugaaagccccaugguccgaggagcccauccugcccugagugcacgcagcgcaugugaagagucagauauaaagguggcucuuucacaaaccauuucggaaauuuagacgaacccucaauuuauuuagaauggguuauuauauuuuauaauuucuacacagaaaauauuuucuaaccauaucauuuuauaacaaauuagcaauagcuaauguuuccuuuaaaauuuuucaagcacacagaaaaggaugaaggagaauacaaacacacauccaccaucuguucauuuugccauauuugcuuuagaauucuaacauuuaaaaauuacaaauuacauaaugguugaagccccuuauauaagccccacccugcuguggcugcuccucagcgucgaucugauuuuggggcuaagcauuccucucggcgcuuugauacucacgcuacacacaagccuacaccaaagccggccgcugucuuugcagguaacgcauuggacgguuccugccguaccuuuucccuucaaguugugcucuggggucuaucuguguggauacaggcaguucuacuauucuuaugacaacugcagugugcgcuccucguugucugaaaaauccauucuccuguugacuaacauuuguuuuuuccaacuuuuugcgaauacaaacaacacuaaaaugaguauuugucuguuucuuuacauaucuaaaguuuauaacuagaaauggaauuucuagcaagaaacuguaaaaugcuuuguaaaauaucugaugaaaugucacacuguauagucauucacaaacaugucaucuuucacuuuugauuagggcagaugucuucuguuguaauuuuuguuguuguuguuuuugagacggagucucgcucugucgcccaggcugaagugcaguggcaccaucucggcucacugcaaccuccaccucccggguucaagcgguucuccugcagcccccugaguagcugagauuacaggcaugcgccaccaugccuggcuaguuuuuguauuuuuaguagagaugggguuucacaauguuguccaggcugaucuugaacuccugacuucaggcgauccaccugccucggccucccaaagugcugggauuacaggcaugagccacagcgcccaguccuguuguaaaucuuuuaucaagagaucuugguuagacaaggggaaacaguacuuugcacaucaucuuuuuuucuaacaugauuacauucuacaaaaagagacaauauaauuaacaaauuucauuuaaauaaaaacuauaaacucaagugcuaacaggaggcuguucauuggcaaaacaaaaucuuggaagaggcacaagggcccagagagcucugaaaccccagaaaucacacagaaaauguacagguauguggacaguccuggggagaggaugcacagcuuuugcccaauucucagagaguccagaccugaaaaacguuuaggaaggcaccuuuucaauguccaaaugugggcagugaugugggagugaacaucagccaauagaguccuggacggacauucuaccuuccaaagcagaccagacucaccaacacacccagaaagaacauuuuuaaaauauaaauggcuucagaauccuuuaacauaugcccaggaaaaaauuaauaagucauaacccaagucauguggacuguuuauaugcaauauuagaaaagaaaucaagguuuccacugcgaaaagccugaaacccacagcucuguuucuaaggugaaugagaugggugagauccgcggagaagacuggacuucugcugccaucauggcaagcagacccgguuuggaaacaaugcuguggguccauuucucucugcauuaaauacaccacaggauuuuucguuuuaaauuauuaaucaggcaaucaaaccaaaaggaagcagacaauuuaaguuguaacagggcaaucugcagauucucacagguuggagggauaaggccccaacgugaacagaccccaccaagcagcuucccagccuuccagaagguuccagaaggccugugugggcugcugggcucgucaccuuagcaacggcucuaaacauaugugcagugacaccagcugauuucugaaagcuguaaauagaggauaauggcauaaaaaaaauuccagauuaaaggaccacccacugccuccucucccaccccauccagcccauaaaucccaccguuaacacugggagcaaugccacguaugcaaacguggcuuuaauccccucacacaccuauucaucugcauaaugauauaccuacaaaagcaaaauaagguccuuggguuaacucucucugcacaaacgugcacaaacaaaaaguggccaagagauggcagagucuggcacggauggaccagcccacagcagccacggcccacggcgggagugcugcaccuccacccacagcggccacggcccacggcaggagugcugcaccuccacccacagcggccacggcccacggcgggagugcugcaccuccuccacgaacagcagccacggcccauggcaggagugcugcaccuccacccacagcggccacagcccacggcgggagugcugcaccuccacugcccacagcggccacggcccacggcgggagugcugcaccuccaccgcccacagcucugcuucccacccuccaccucacaccaccaugggcacuuggucccuucucucagggcccuucuagaucuuggcgucugggccucaaagcacaacacagguacugacagguaggucuccaccaugagagagaaaaagaugaggucaacugccugggcaaagguuccagguggaacaucaagagcugcuggugaaugagagcggcagcccaggcucagaccucagaaccagcuucuaucuuugaaggaugcagcccauuucaccugagagucggaaaacguugaacuccccagagauguugaggccuugggaagacagcauucgguccaggauaaaccagcaauacucuggaccagguuugcaaagaacucgcccaacaggaacaaggcaaagcgugaggaggaacgggcagggagaggccagcgugaacucgcugcggccugcguggcucucuccuagcacaccacgugccugagcaggauaugccuuuuccuuauuuccccucuaucaucuuucugaggcauuauauggaaaacugggugaauaaauccccaaguaugagcugacauucuuaagagaaaaaacaaacuugauacuucaugguguaaaaaucuauuuaugggcccuacagaauuacuucucacuauaguccucauuaaaauuaaauacuaaauacucuaaggaaacacacaauugcauguuaaaacaugaaaaacauuauuacagaauaaccaaacuuuuguucccucagagugccuuucugugaucguuuaugcccaacuggcaaaggagugggaaagggacggaggugaaugaaaagaaggcucauaucccagagcccaaaacaggcaucauuuacaugcuucauaauuccgaauuugggaugcacaaaccaauaaagacuauguacucaugucuguuugcaaauauaagcgcuuuuuaaauuuuuauuugagacgcagucuugcuguugucacccaggcuggagugcaguggugcgaucucggcucacugcagccucagccucccgaguagcugggauuacaggugugugccaccacgccuggcucauguuuuuguauuuuuaguggagacgggguuucaccauguuggccaggcuggucucgaacuccugaccucaagagugauccacccagcucggccucccgaagugcugggauuacaggugugagccaccgcacugggccugagcgcauuuuuuaaaaagcaauaccuguguucccaaaaacagaaaaauugacauuuaguuauaagcuccaacacuuuaauugcuuaaacugaauuuguggcaaauuauuucaaaguaaaaaucagcucagauuuguguuuuuauguguaaucucuuaaaagccaggguacacagguauuccuaacacauaauguaugugugagugagugagcgagcaaaugagacagagcucgaggugggcuggaggcaugugagggugcacgcgaaacacagugccuccucuuggaguugccagaauucaccucguucagaaccucaccccagucagaaaacacaaggcagcaacuggccggaacuuggucagucacauccauaaaccaccaauuaccuucacagaccacgacuaacagguuuauuacagaugagucacagcucauguuuucaaggaagggucuccaacugagcagucaccagugcagccugcgucagggcgcgccucccuccagcgguccccgcgucgcccaugucugacacaguuuaugcuucgcaggcgguaaggcuccgcuccucacucccauggaccaacagaguagggaaaacgaaggcacguuggaaacuacggaucacgggcuguuuugggugugggaaauccacccacccacacucacggccagcucugaccgacugaacccaggggcacaucacagacauaaauaucggugcaggcggccagccacuccucaagcccggccccgccccuccugcucccagcggaagcuuuuggugcaggacuucccgggccucaaucuccucaucuauaggcugggaacaaacccuggagucugugcucugggaggagcacacacgggcaacccuggcucaggacagauucccagccccuaagucaucacuagggcuuaacgauccauuucaaauuacaucugcacggugcuuuacuuucauacguuauuuuauuuggagccucuaacgagccucagcuaacagaugguauuauuuccacauggcaaacaaagagacaggagcugcaaccauccaaagacaccuccuugcuaugaaugccuggccaggccuccaggcaggaccagcaacuccagaccccgucagggccaacacgggccacugcuguccacacacuccuagaaaauauccaucugucugaagcgagugacacagauuuuacccucuugaggauaaaauaaucccaucugccaaaaugacccacaaauaaaggcuccuccuugucugaacgcugccucagcgucugagggauaagcccacaaugcaagcguccgggaggacacuccaggcugaggggcccaggaagaaagagggccagaaaugagggcacccucaugcaugcugggagcugccgacaccuucagacugggaagaacaaagagcucccaagcacgagggcacgggagcacagcggagggcacgggagcacagcggagggccagacgugaggccagaggcggcuggagcagcagcucccacccaauagcagacgaggcgugagacucucaaccaccuuccaaguuuucucuucaucuucaagagaaccucaaacuguauuuuccuuaguuucauuaccaggcuccuuguagaaaauaccagugaaaaagaaugguuggcagaacugaaaaucucaggaaaaagcacaaacacagcacacagcagaagcaggcgcagaugaggcaggaggaacggcaaggccaagcggugcuccagggaagcccagcucggaugguuucucaaccacucccugcuuaaaaacugcuucacggccugaaagggcacuaaaaucugggagcauccaccaggaaauggaaaaggcaaacucccaacauaaccacaaaaagacacuguacaaucuccaaacuguaaagauggaaaaaaaaaauggagcggcaaaaaaacauauuacaagcccccccuccccaccccccggcaaaaggagagagagaagacccaucacgacaaacggauggaaagcacucgaccccacagagcucagugccgacaccccccggcaccuggugccccaucuggggaggcucugcccucguggguggacgaacgcuggcugcuauuaagggcuagcacugggaggcagucccguccauuccucugucccugcagccacggaaggacgaagccccaagcacggaggcagagaccaggcccuccaguggccccaggcucuccaacuuccagcuuccagaacugugagaaauaaauuucuguucuuuauaaaugaaccagucucaggcauuuuguuacagcggcauaaacaggcuaagggaaaaaaguaaauggacuaagaaauacaagaccaaguuugucagauuggaauggaaaaaguaauccagcuggcucagcacgagcugagugauguuuaauccaugaacaaacauuucagaaaauacacaccaggugcaugcugugcacaccagguacaugcugugcacaccaggcugggcuuccucuaucaaugcuagguacagacuugaggccagaaugcauuccaggagguaaggugagccacuauaauauggcaaaaaguuccuuucacaagagagcuaagacgguccgacauuuaugcaaauaaaagccucugaguaaagaacaagaaucaacagaacaggccagacacaggcucaugccuguaaucccagcacuuugggaggccaaagcaggcggaucacuugaggucaagaguuugagaccaggcuggccaacauggaaugacccugucuccacuaacaacacaaaaaaaaaaaauuagccgggcguggugccgggcgcuuguaaucccagcuacucgggaggcugaggcaggagaaucccuugaacccaggaggugagguuguaaugagccaagaucacgccacggcacuccagccugggcgacagagggagaccccgucucaggaaaaaaaaaaaaaaaaaaaagaaucaacacaacagagaaaaugcgccucagccacggagcagauauuaaagugccuuucaguaaagaacagacaaggagacaacccuaacccagacuacaagacagaagaucugaaagcaagaccaagcuggagcuaaacauauaaaaucauccaauaaucacauagaaaauaacacaauaaucacgcaauccauuuuucaagcucccagggaacaacagucauccaaacuugaucacacagacaacuacaccacacgccuaaaaacugugagagucaccuucugaagugacagugcaguucagaugggaggauggugaccagaaaacacagccuucaaucugggaauuaagaaaugcauuucuaaggaugagggaggagggaaaccagaguaggaauuucgaauauucaaaauuggaaaugacagagaugcuauacagcaaggugggagauccagguaaagugguuguuagagggaaauguauuuauauuuaucgcuagaagacaucccaauaaagagacucuaaaaguuagaauacaaccaaaagaauagaagaaaaacaugagaaauguacaaacauaaacgaaacaaaaagcaaacauguaacagagacuaaacaaagucaaaggugaguuuuauuuuaaaugaccuauaaaauagagaacaagcuacacgacacaauaggaaagcaacuagacaaaauaggaaggcgcgaacugucugcgaagcaaauggcccaauccccaagguuggucaguagcaggaagagaaggcucugcugggcgaaaggccagcuaaagggggugacugagcacaugggcugggcuccuaggcccguggaggugucucucguugguccgggcaucagaggaagcagcaagcagcuugcugaaauggaaaugugaaugaaaacacugccacagcagcaccugggugagggcuucuuucaaucucuggcaguguagccuugacaagcugacacauaagccugacugucgcacauguguguaccuguauguguguacgugaacauguacacauaaaaagaguuccguucggccgggcacacuggcucaugccuguaaucccagcacuuugagaggccaagauaggcggaucacgaggucaggagaucaagaccauccuggcuagcacggugaaaccccgucucuacuaaaaaauacaaaaaaauuagccgggcgugguggcaggcgccgguagucccagcuacuagggaggcugaggcaggagaauggcgugaaccugggagauggagguugcagcgagccaagaucacgccacugcauuccagccugggcgacagagcgagacuccguaaaaaaaaaaaaaaaaagguucuguucuccagguugugaaaaugugacuauuuuacauucuauuucuccuuaucgguuuuuccuaauuuucuaaaauguugaguauugcuucaguaauaaagguuacuuuuuaaaaaagaauacaaagagaugaccacaaacaucuccaacauuaggcaucuccaacauuaggaaaaacauauucaguuuuucaccaguaagaauggugucagucaguggguguuucucagaacguccuccaucagacugaggaaacucccuucuguucuuacuuugcagagcacuuuccucaugaauagguaugggauuuugucuuuuuuuuuuugacagcaucucauuccaucacccaggcuggagugaaauggcaugaucucggcucacugcagccucuaccuccugggcucaauggaucuucccaccucagccuccaggguaacugggacuacaggcgcgccacccugcccagcucauuuuuguauuuuuuguacagauaggguuucaccauguugcccaagcugcucugcaacuccuggacucaaacaguccucccaucucagccucccaaaauguugggauuacaggcaugagccaccauaucuggccucaaauaccauuuuuuaaaaaaaucuucuuagaugaucuuacggcauuucauuuuccuuaugucaauaugguacacuacauugauuuuuaaaugcuaaaccaaauuugaacuucugagauaaaccccgcuugcucaugagguaucgcuauccuuucuaucuccuauaacuuaaauuuacaucaguauuaauguggguguuucucuaauuuugguaucaaggugucccugacucauagaaagacuggauguguacccuccucuguuguggaagggcuucuauauaacugacuuuccuuauucuuuaaauguauaguacaaaugaccaagucagucauccgggacugaagguuucuuugugggaaggguguuaacuaaaauuucaauuucuuuaauagauacaggacuauuuaagcuaucuauuucuucuucaguaagcugaacuaguuuaagucuuuugaagaauuugucuauuucaucucagcugucuaauuuauuggcauaaaguuaacaaauucccuuauuguacuuugaauggcuauaagaucacagcaaugucccuuuucucauguccauacuaaaaauuuguugcuucuuuuucuccugauccauuuggcuaaggggcuaccaguuuuauugucuuuaaaaaaaaaaaaaaaacacccagccgggcauaucaccugaaaucacgaguucaagaccagccucgucaacauggugaagccucauuucuacuaaaaauacaaaaacuagccaggaguaguagagcgcacuuguaaucccagcuacucaggaggcugaggcaggauaaucgcuugaaccugggaggcggagguuacagugagucuagauggcaccacugcacucuagccugggggacagaguaaaacacugucucaaaaaguaaaaaaaaaaaaaaaaaaaaaaaaaaagaauaauaauuauaguaaucaagacagugugguguuagcaaaagaaucgauaaauagaaugauggaacagaaaagaccaaaaacaggccaggcgcaguggcucacgccuguaaucccagcacuuugggagaacacggugaaaccccaucucuacucaaaauaccaaaaauuagccgggcgugguggcgggcgccuguagucccagcuacuuggaaggcugaggcaggagaauggcgugaacccgggaggcggagcuuacagugagcugagaucgcgccacugcacuccagccugggcgacagagcgagacucaucucaaaaaagaccaaaaauagacccacauaaauauauagucaacuaauuucuuaacaaauguaaagaaauugaauggcaaaauaaucuuuuccacaaaugaugcuggaaauaauugaauauccucaugcaaaaaacaaaaaccucuaaccuuaccuuaugccauacacaaaaauuauuucauaauugaaguaaauaugacugaaaacuauguaucuuguagaagaaaacuugcucuacgaugcuggcuuagagagauuucuuaaagacacaaaaagcacaaaguacccaagacaaaacuaugaaguuggacuucaucaaacuaaaaacuuuagcugcucuaaagacacuauuaagaaauaaaaauacaggccaaauacuuguuaaaacacacacacacacacacacacacacacacacacacacacacacacacacauauucaaacaacaaauagcugguaaaggaccugugucuagaauccauaaagaacucucaaaaaucagcagacaacccgauuuuuagaaaugagcaaauggcagauaugaaagugaagacacaugcuucaccaaagcaaauacauggauagucccuuccccccaccaaaaaagccacaugaaaagacaagcaacaucauuugucacuagggcacuggaaauuaaaaccgcaauucacuagaauggcuaaaauggaaaagauggacuacaccauguaacggcaaggacagagcagauggaauucccauucaacgcuggugggaacacaaaacugaguggucacuuuggaaaagagucuggcagguucuuaacaaguuaaacauucauguaacaugugaccgagaaacccagacccagaaaagguaccacauccagccaucugaugcuuugcaugcaacuacucauaucagcuugacucccaacagcuaaaacuaggaaacaacggacaugucuauaacugcuuauuggaugaacaugcgacauaucuacccccuaaaaagcuacucaguaaacuacugacauacaccacagaacccagaucaaucucaaaaggaagaugaaacacaccagacacaagaguccacacucaaugauuccauucauauuaaauucuaguaaagcaaaagcuacagugaccgaaagcacaucagcauccuggguccaggaaauaggaugacaugcugcugcaaagaggaaagggggaacuuucuuggggugauggaaauacuacucuguaucaugacugugauggugggaacaagacaguuccaacugauuccuuaaaacucucacaucuguagucaugagcaacaugaugcucauguugaguguggucaacaggccacauucaugauggugguaugugcuaccauaagaugcuaauggaguggaacgggucccauggcauaaacaccuaccacuguguuacgauuucuuuccacgauucagcagggugacucagcaacaggcucuaccauguagcuuaggugugugggaggcucugccuucuggaucuggguacgcacacucugugaugcucagaggacaagaucaccuaacaacgcauuucucaggaugcaucccccgaccgcuauuaaaauugaugcauuccaaaguauuuaaacuguaccucaaagaagcucucagagagaaugcacgggaguggacgauggcgggcacaagagcucgucaagagcacuguugugaagaaaagcagagaggcggcggcggcagcugguggugggcaugggcgagggguuccacggcaaagaaugaaauugaaugcccaucaccccacgcccacaggccgccaaacacaucuggaaaagcagaauacauuccugaaggggauggcauccauggcccuagggaaggaagaccagaucccaacaggagcaggaugaggcuguccuugauacugagcagguggcugacuucaccacacacccuccacuaccuccgcaaaucacuccaggcauucauuacccacuacaccaaauaacugauucucauuucauaaauauacguauucaaagaggauccuagcgaacuuuuucaagaaaacacuggauacagacucucgggcaggucuguaaguuaaggcauggagacgaagcuucucucuguguuuggcauugaggcaaugcugcugugggcacugcagacauaggcccugugaccugggcgcagguucgugucaugccacacagcaugcaauuccauggacacaaaaugaccagaacagcagacucagagaggacgcagaggcugcagggggaacaaggagugacgauuaaagguccaaguuucuuucugaggugacagcaauguucuagaacugacaguccuggugguugaacagacccgugaauacacuaacaaccuuugaacugugcgcuuuaucuggguaagccuacggucugucaauccucucaaucaagcugguauuaucucuuuuuuggagacagucucacucugucgcccaggauggagugcaguggugcgaucguggcucacugcaaucucugccucccagguucaagcaauucucacgccuccgcugaaaugacaggcacaagccaccaggcccagguaauuuguguagaggcggggguuucaacauguuggucagauuggucucaaacuccugaccucaagugauccgccugccucagccucccaaaugcugggaucacaggcgugagccauugcaccuggccgauuaucuucuuugaaaagcaugagacacguuucccuagggauggaaugcuggacacgagacaagacuuguccuaaggacuggaucucacaguggccagguaugcaucacgccacgcggugcagagcccugggggaaggcaagucaagaagccaggggucuaggcaccgcaaugucucaaggcagccccccaagaaaaccaagcagaaggccacagugacgcccuccugcucucaggucaguggcaggagggcacuugcugaugcugggcacagaggaaugucagggcagaucuucaaggcucacacccuucagagcuucuggcaagcucaacacagugagcgagcccugcccccaagagugaggccccugucagggccacuuccucucgcccuggcccauccagaucucacacacacugugguagaucuuugaaggguaaaagcucuguccgcuccacucaucagcaccaaaguguucugugccuggcccuucuccacccaauucaccaguuuauugaagccucagcugggugagucccgcuugccucugaaaaugugugugcucagccaggcagauucuugagugcguuuccuaugugcugcugcccuccuucaagaugaccacaugggcccccaagcagggccccuaccugcuuugucagcaucuuguccuuucccucuuuucucucacggcuuguucuacuucacggcauguuuaagcaaagggggucacuacaacaaaauuauuuuaaaacaaacauacuucagaaaaguuuauggaaaacauuaaaccuugaauauauuaacuuuacaggauccauuuacuucacccuaacacugaguuaaaauuauaacaagagaaaguagggcugggcgcgguggcucacgccuguaauuaaucccagcacuuugggaggccaaggcagguggaucaugaggucaggaguucaagaccagccuggccaauauggugaaaccccgucucuacuaaaaauacaaaaauuagccgugcaugguggcagacgccuauaaucccagcuacucaggaggcugaggcaggagaauugcuucaacucaggaggcggagguugcagugagccaagauggcgccacugcacuccagccugggugacagagugagacuccaacuccaaaaaaaaagagagagagagagagagagagaaaguaaacaaaguuucuauuuauuucuccagaggaucucaaaaguagagcuggaaauaccagcaguaagaggaacaccaguccaaggcaacuacaaggaacuggucacuuuuucauuuuuuugagacagagucuuacugugucacccaggcuggaguacaguggugcaaucucggcucacugcaaccuccgccuuccggguucaagcaauucuccugccucagccucccuaguagcugggauuacaggcaugcacaaccacgcuugccuaauuucuuuguauuuuuaguagagacaggguuucaucauguuggccaggcugguuucgaacuccugaccucagcugauccgccugccugggccucccaaagugcugggauuacaggcgugagccacuacgcccgaacuggucacauaucuuauggaacauaauguuuuucaugaucaacagccacuaugggaacacaacacacaucagcccugagacacccgaaacaagacagagcagccucugcagccucucaugcagggagcguggggcaugucugccacagggugaggggcggcgggcagagauggagacauaaaggcggagcuggcuuccagccuugugaaccagcccagcugaaugccccaagucuguaaauaauugaugggagccagagcacccagcccugcagggcucucgggagcugcccgcccaacagucccaugccuggcacucccucaggugccgccugcaaggucacuccacugcuucuaaauaaugcacugcacagauggaggaaaguauaccuuuacccauucaaaucuuccaaggcacgcauuuucacaaauuuuacauauauauaacuaaauuuugcauucagccaaaaaaaaaaaaaaaaagaaaacuucauguugaaacacuguaucucacccuagaauuugaaaagccuccuuuuccuucucacugucaaucuuuuuugaagucucaaaaaugauuuuacuaacauuagacaaauacccaaauauaaaaagugcuugacacagucaacacugcagcagugagguccacuaugccagcgcagugcagagccagcccaccucccugcaccaguggaaaugucacagagggcagagggcagcgugcccagcaccugcucuugauagggagggcacuucuaggcuggaauacucaagagauuugauugugugucaucaaagcaugcuuuaaauacaaaagcuggcagggcacgguggcucacucuuguaaucccagcacuuugggaggccgaggcaggugaaucaccugaagucaggaguucaagaccagccuggcuaacacggugaaaccacgucucuacuaaaaauacagaaauuagccgggcaugguggcgagcaccuguaaucccagcuacucauaagggaggcugaggcaggagaaaucgcuugaacccaggaggcggagguugcagugagccgagaucacaccucugcacuccagccugggagacagagugagacacucucaaacaaacaaaggcugugaguggccuggaagcucguucuucuagcuccuuuggcaaagaaaaugcccccaaaggagugagggcaacagacuuuccaagucccaggaaaugcacagauucacaugcugaagacccaccagaugcaggaaggaaacgccagaacaacauguuugcuuucaucuaaaaacaucagaaaaagucuaaauguugcugacauuuccugggcagcugcccuguggucucccgucuggccaaggagccucaacccaguugcucccaacauacucccaucccaggcgaaccuaugcuggugaugcucgggaggcgggcagagggcucacggagggagggcggagggcucacacccugaggcucggaaggcgggcagagggcucacacccugaggcucggaaggcgggcggacggcucacacagacccacaaggaccaaagaggaacgugcaggacuccaacacaaacggaggacgauggcagaacagaagagcugauuaaguuucugcugcuuguaccauaaacuuuucaucagccagacuguuugccugaaagaccuaaucaaggcugacaagaauucaaagccauuucaaagugcuccucaggggugaacguggccccauguccggcacaugcucugcucugaacgcucucucuuccagcagggacggccccagacaucgaguaucacaaccaacucaaaaauagacugaaaugucacaguaucgccaggaucaaaagaaggucucuuaaaaauaaaggguuucuuccauuaauaaguaaaacaagaaaaaacccaaagaugcucacuugaacuucaucuuguuaugagcauccacccgucgagggcaggucuuguguuacugagcgcagccugacaaucgcaucugcaccgaggcccugccacggcgguucacggcaagggucuguggcucuccugugcgcagcccaauggaaaggcagagugaccgaugagauaaacaccacaggaacagggugcuccccccagcacagcucgggagaccagggcucaggaacgcuaagugacucgcccaagaccaccagaaaugaguugggaggcugaggugggaggaucacaugagccccgcccugggggcugaggcgacagugagcccagauagcgccccugcacuccagccugggcacuggagugagacuugucucaaaacaaauacaagaaagaaucuggaaaaccuuaguuacuaugaacuagugcuuuucacuaacaaaacacaaguauuuuuuaauucucacguuucugaucaucuuuguuuauaacauuuauagguuacaaacaaugaacuauuguggguuuuuaaaaacugauuacagacuuucaggacguccaaaggagacaucuuugucaagggaguaaaguggagaauuccagagacacgcacaguucucgguggcaagccauccgcugaggugagaaggaugugauccaucagccaacccugccuagaugaugacaccagcuccggaagccagauggagcagcuggacacauucagaacagugcuuucaagcagacacugcuuguuccaaugucagcucuauaaagaauguaacagggccaggcgcgguggcucacgccuauaaucccagcucuuugggaggccgaggcgggcggaucacgaggucaggagaucgagaccauccuggcuaacacaguaaaaccccaucucuacuaaaaauacaaaaaaaaaaaaaaaauuagccaggcgugguggugggugccuguagucccagcuacuugggaggcugaggcaggagaaugguaugaacccgggaggccgagcuugcagugagccaagaucgcaccacugcacucuagccugggcgacacagcaagacuccgucucaaaaaaaaaaaaaaagaaaaaagaaaaaaaaagaacguaaugguacaauuuuggggaccccaaaaggauaaugcacauaauaaacaacaaaagccugaggcuucucccaggcccuguggcuguaaucucccggagucccaggcauccugcugcugggaagggccagcucccaagugaccugugaccaucuuggagggguugguggcugccuugucagcagggcaugucccaaugcuaaugguucaacagccaggcuugacaucuuuuauucuaaaaaucuaccacagaauagccaaagggcagugguggggaugaggaugagucuguaggagggacaguguaaggaagguggagccaucuaggggcacugcucagagguaggcucggccagagcuacaacacaccuucgaagaugagugggguugggggcggggugagucagcuucaacacacccaggauucaccucucaucugucaaaucugcugauaaaagucacaccaugaaggaagggcagucagggacugugcucaccacgugucccggggacaggacacuugcugccagucuccagcaccucacagggaaccagggggcaggugagcuuguggagaaacaggaauccucgugcauugcuggugggaacauauaauggugcaacugccaaaaaaaaacagugugacgauuccucaacaaauuacaaaaggacuaagcauaugauccagcaguuccccuucuggguagauauacaaaagaacugaaagcagggcccccaaaagacaguuguacuucgacguucacaguucacacagcaugguucccaacagcaaacccgaguguccccuggcggaugacagagaagcagaaugcgucugcacacagcauaacgcgacucagcccuaacgaggaaugccugucacagccaaugcugcggacuccacucacaggguccagggacaaacagcagcugcacaagaggaagggcccugagggaggagucugggaggaaccacugcucaucggcaagccaauccauggccacaggacaacgcugcugaagguacuggaagccagggugcuggcugccccuuucuggggacaccuuuccuuucuuuuccuauuuuuauugaacacugggaugaaaguaaugaaaaguaguaaauccuuucaaaacaaucagauuuaguuaugaugcucaauuucugaaaucaaucucuucaaauagccaguaaaugcuuccuuuccaaagacugaacccucuuacugcuuugaacaauggaggaagugagugaggcaccagaugcaacuuuugacccaaggacacaggucaagcugugacaguuaacaaccaggguggcuggagaugcugcacccacccacguggcuuugcuagaaugccaccacgugcgggcagacacaggccacagcccccacaccucacucuggcaucagcacuggucccgcauggagcugugccggcuugcagaagacguagagcacacaggcguguuccuucccuucuguuggccacaucacagcugcauauucacgggagugaacaucaucuacacaacagcuuccacguuugcaaacaugcacagcuuagcgaccacguuucaaagagccacguggauaacugccuauauuacugguacucaauuuccagguuggguugguaacuggauuguuuacaacacaaaggauaacuaguugagaagauggauaccccguuuuccaugauaucaucacuacgcauugcaugccuauaucaaaacaucucauggaccccauaaauacauucaucuauguacucacaaaaacuuuaaaaauaauaauuaauaaauaaacagaaugacuaagauuucaacuguuuacccaggaugcugccugcagcucauuucagugacaacccacaagcugcccucgcuggcccugugugcugaggacgggacaucugcacccagcccuagauaaccccacgugcaaaccacuuccccugugccgcuaaaacccacaucucacauuucaguuauaguuuguuuuuugccuguagguuuuuuuuuugagaauagggucucccucugcugcccaggcuggagcgcaguggugcgaucauggcucaccacagccucgaccuccugggcucaagugauccucccacuucagccuccagagcagcugggaccacaggcaugcaccaccacaccuggcuaauuuucuauuuuuuguaaagacaaggcuauacauuucuuauauaugucuaaaucgucaguauuaaacacugacagagcaaagccuuucucugcuucaaauuuuaauauuccaaaauauauaaaacaucauugucacuguccucaucuaaaagacugauucuggaagaaaaaaaaaaucaaucugaaacaagaucacggaaaugcgaucugucccacacacaccaucuuuaacaugaauggugccuccaaagaacaaaugcuagaugcaaacugcuugaguaugcuucuuuauuuuuaguaaagacuccagaaaaucccagagcagccauuucccauacaacucaaucgcacguacagcccuuuaaaaagcagacucccagggaacugcagccagcuccuggagccagccccagcagaggagcaggaagaccuuccagccugcgccaaggagcagcgcacacgucugcugcagccccucggcccccacugcuucgggaugcagauggcagcacugugaccucacugugccuaccuccuuguuccggcccugcagucuugauucuucaggcuaaucccacacucugagccuuggcugcuggccgaaacuguuauuaauggcacagagcugcucauuucagcuucuuuuaccacgaagguagccggcuguucaccucucugccucuccacacugaagcaggaacuggguaacuguacaagaggcauuuucaacggucuucauaucugagucucaacagccagcagaagauguuugcauuuuagucuacacuacauucuaugugaugcagaaagauaagauaguuuuuauucaauucuuguguaaaagcuacaaaacccuaagaacagagagugccauggaugccaaaaucagcaucacauaguuuauauguuuuuuaacuuuuagguucgggggcacaugugaggguguacuacauaaguaaacacaugucggcagugggcggggggggagguuguacguguuauucuaucacccaguacuaagcccaguacccaacaguuaucuuuucugcuccucucccuccucccgcccucuccccucaaguagacccccgugucugguguuuccuucccuguguuuuuaaguucuuaucauuuagaucccacuuguaaagucagaacauguaguauuugguuuucuguuccugaguuaguuugcugaggcuaauagccuccagcuccauccauguucccauaaaagacaugaucucguucauuuuuauggcuauguuaucuuaucuuauuuuguauuagggauggggcuucacuauguugcccaagcuggccugaaacuccuggguucaggcaauccucucgaauuggucucccaaguagcugggacuacaggugaacaucaccaugcccacuuuuccaucuucaucacuugauaaacauuuauaaugaaugacauuaaauuacacauagcaaaauucugagaaacuauauaccacaaauccuacaaaauuuaaaagauuaaaaaaccauggauuauuguuaugugcauuagccaaugucagugguuccaauauuuacuuucaccacuaaaauggcacgaaagcaugaagucgggaaugacagcauucuagaagccagugcaccugagaugaaauucaugguauguucggaaccuagaacgucgauggucaacacuaggcagcuucaucugucauacguggacucccuuucaaaacuccaggugugugugucugucauguggcuauggagaggaagaggagaagaaaagauuucgauucacuaaaaacuccuguuaagccuccaagaaagauccaaguaaucagauaccuggucagucacagccucucugcaugaagccucucugcaugugguuaagaccugcaaaccucaacagaauccacggucucuugccccugcacugagccugugucgggacuuggccacugcucugcaucaggugagaggcuccuugucucucacauccagauggauccgauccaacucacacagugaacgacuccaaaccugggcagcccugggcuccaggaucagcccaccccagccccugcugcaauggcaccuccuacucucauuguggaaaccugucaacccaauuacagacacccuggcuaggcccguacuucuuccuguaagccugaaacccugcucagcuacccuaaaccaccaccucugcgcaccccuuaggaaaccccagcagcacaucccccuucuuccucccgcagagggccugccccaagcagcaggaaacggggugacacaggccuuccuuggccucagcacacacagaaccaucacagcgccgggggcggggggugcugcagggacacauuccagcugugcacuucucugggggccagcacagaccacugagcaugagcugccucauucaggccaggugacugucuucaucaucauucaacuuugaaacuuaggguuugugccaguccaccuguuuauguuccauacuuacauaucccaagccauuaacaaguguuuucuucuuugguuaugaugcuacagaaucagcagaggaacauccgcaucaccagaaggcucugcaggcagcacugaggcccauccugcugggagaaugccgcucugagggcagugggacugccagcaaaggacacaggcucagggagaccuuccacuccugcugaaacaccaaucaguagaagaucaccacccagaaauaucacuuucaagcuuaaggaucacaaguuacaaagauaaaugucucuaaggacuaagggagaaguacaaaguaaaaagauuuaagcuugggaaaauuaacccuaaacauuuaaaaacaaaacaaacaaaaaaaauccgcacucuagauaagaccuucaaaacagcaugccugucagagggacaguaaaggucagacggggcagcaaugggguaugagcuggcacagccuugcaacacccuggaugggcggccaggggcuugugagaguggcuccaggcaggaggacccugaauuuaugggagggggcaagacuaacccucaagugcuccucagauacguuucauuaaaugcacugaaaguuuuguaaaagaugcaaguuucaacaugagauacaauuauuuacccaaucugacauguggcuuaacaaaugugaguggauuaggggauuuuuguuuuauucuucugaaauaccaacugccuucuucuuccccuucugaaacaaccacuggacaaacugaacggcacauaugcuuuucgggaucucagcguaagcagcucccacugcuagggaugaagagugcuccucugucugccugagugaaaccucacgacaccuugcacagcccgcaguccuugcugacuggaagcagaaccaaaaccugagcuggagagagugcacgaaaguuccaucuagacccaaaccuaaauugcacagcuacagaaugaagugaacagcacugaagccggaagggacaagacucaaucccacgugacugaacccauguguccagcaccagagauacugggcggagcacacaucucagcuguguaaaaaguagaaguuccucuucaaagacuuuccuccccaucuaauuaaaaauaaauaguaacuucucuuaaaagcaacauuuauucaaagaccugugcugacauuccuaaauaucugcuagccuuaauaaagaaaucaauguacuuuauguucuuagcucccacaauuuagccuaaguaucugcccuggcaugcuuauacuggucgaagcaagcauuaggucacggccuguuccucuuccuuaguugaagguguuuuuaccuuucucagcauuccacaaauuacuuccuccuuccuuuguucuccucugccuuugccucuuuuaaaaaguucuaaguugcuagccaaucgggacaaauacagaaugugaggucccguuccagccaauggaaaccggacacagcaguugguauaaaaaaaccggacacagcgucagguuauaaaugacccuggucuccuuuauccgguguacucucguggcaaaacugcuggcgaguguacccuuucugcagaagguauaaaaaauggccuugcugaggaaauuaaauuuacguucaagugcuauuucuuuacggcaccagggcacaagcauuucaaacagcugggaacacgccuaucccuguuaaaaaaaauauacgauguuuccagauaaaagaauucugaucagaaauagguaaguuuucauuuaaaauuuuuuccuauacucugccuucugaagcagucucuaaauucacccuguauuugacggugcaugcgaauuuguuauuuaugcuuaaaugccagccaaggaguaagauucagucugcauuaggagauauaccuaaugcuaaaugacgaguuaaugggugcagcacaccaacauggcacauguauacauauguaacaaaccugcacguugugcacauguacccuaaaaguauaauaauaauaaaauuaaaaaaaaaaaagauucagucuugcaaaguuuugaaaucucucaagggggaaaaaaaaccuuacauaguucacaauucugaguccagaaucuaggagaaaccaccaaaacuuucuuugcauucugucaaauucaaacgcacucugugugccaagccucacucacuuuauguccaccaagcaccacacgcugcuucccguguauguggcccaggccccugugaaacaaacacacucucugugguagacuggaagaacacgggccugcagguuccagucaggaaguggagugcuagcccuaugcggugacucaugccuggagcacagcacuucaggaggcugcggcaaggaggacugacugaggcaaaaaguucgagaccagccuggccaucguggcaaaacccugucucuacaaaaaagaaaaaaaaaauuacccagguaugauggcauacaugccugcagucccagcaacucaggagccugagcaggaggacagcuugagcccgggaguuggaggguguggugagcuaucauugugccaugccacugcauuccugcccagccgaccaagugacacgcugauuuaaaacacacacacacacacacucaauggaaggcaaaagaaaaggaagaaaaaaaagacauggagccuuucuuuccagcccuggagccuggguguaccccagacuugcugggcccacgaggacccugccacuuccaccugugcccucaggcaacaugugggggcccacacagacugaaguaugaaauggauucagcccccaucagccuaaugcagcuucaugagugaucccagguaugaccagcagaaaaccaccaggcaacacaagaauuaagagaacucauaaaucauuauuuucuuaagacaccauguauugucuuacaccgcaauagguaacugaaacacauccuacucacgguaagaacaagcugaaauauggaaaguuguuugagaugcuacuuaaacacagauuuaacuccagagcagagccuuuccauguauuuuucuuaaccuauucgcccucaaaacagcgcugagcacagcagucagacccuaaagcagagguguccaaucuuuugaccucccugggccacacuggaagaagaacuggcuugggccacacauaaaauacaccaaugcuaacaacagcugauaagcuuagaaaaaaaucucauaacguuuacaaauuuguguugggccacauucaaagcugccaugggccgcgggcuggacaagcuugcccuaucucacacuguucccugucagacuguaaacacuacucagaaucacacaaucucaucucggcuccaaguggaagcuugcucagcaccacggccaaccugaucccacugcagauguuccaacagccuggcacgcagauggcccagggaaaagccucaucgaaugcugaauaccugugagaucauuucuuacaaagccaaaugaacaacacuauguuaauuuucaaauuuuggcauggaaaucacauucuaagacgcuucccaagcuuucuggaggaugcuaugaauucuguuuuauagguaacaagucuggaagccaaaauaaucaagauuuaauaaaauggccucaaaagugacaagacucuccuucccuuaugacagaccauguuugcuuuccuuuuuacuagaugauuaacucaauucuuucaacaauccuguccagugaugacuaucuuguuggcuggucagaaggggaaguuccagagcugguuuuuguagaaaaccucagauucuuucaaucccaggccaucuuaucacguagucuaaacccuugugucaucaccuccugacguuuccaucagcagaggcagagcucucaccuuaaagagcaugaggccaaaucacuggcugcaaagcacagaacacagacauccuuggccacacaagagugagagccacugagcccaaccagggugcaggggagccucccagaugagaggccugugcuuggucccacagggugcagccuuaccgugcugcugagacacucugcccaagaaauggcuccaggauuuucugaaacucgcuuucaaaauauuuccaagcucuuaugucuuguguaugccuuaauaauugaaaaagagguauguucacucaagaaagggaagagcaguaagccaaguagggggccuuuuaccgcaauucuuccugggcagugucuguggaagguggucucuccgcagaaacccaacguuuuuuuuaacuuuguuuuagguucggguugcagguuuguuacguagguaaacuugugucaucaggguuuguugaacagacuauuucaucacccagguguuaagcccaguacccaacaguuauuuuuucuguuccucucccuccuccacccccaacccucaagcagaccccagugucugcuggucccucucuguguccacguguucucaucauuucguucccauucauaagugacaacacgcaguauuugguuuucugucccugcauugguuuguuaaggauaagggccuccaggcucuauccauguuccacaaaagacaugaucugaucacuugaaccuggaagguggagguugcagugagcuaaaauggcgccacugcacucuagccugggugacaaagugagacuccaucucaaaaaaaaaaaaaaaaaaaaaagacaugaucucauucuuuuucauggcugcacaguauuccacgguguauaugcaccacauuuucuuuauccaauccgucacugauagaugcucauguggauuccaugucuucuucugugaauggugcugcaauggacauucgcccgcaugugucuuuaugguagaaugguuucuauuccucuggguauauacccaguaaugagacugcugggucaaaugguaguucugguuuuagcucuuagaggaaucgccauacugcuuuccacaggguugaacuaauuuacacuccugccaacaguguauaagugcucccuuuaauccacagacucgccagcaucuguuauuuuuuaaccuuuucguaacagccaugcugacuggugugagauggugucucgcugugagaaacccaguuuucacgaucagcugguuuccacucgcugaaaucagcagacucuuguugaaaaggcugccaucuugccuuggcuaacccgagcuguuuccuguaucugucaugagggugcugagacaugucuagacagaggugcggcacagucaacuggacaccauccaugacuuggcccuaacaaagcagcucucuugaaugugugcuauggguacaccaagucccacuuccgggggcacccagggcaggggucagcaaaggcuuucuggaaggguccagaugacacacacuuugggcuuugcaagccacucacggccucugucacaucauccuguugcugcugugaacgacccuuuaagaaugugaagaccauccuucgcaaucugguuguacaaagacagacccacaggcuggauuagguccgcugauugugguuugccagccccuggccuggagcuuugccagugugcaggcuggaugcccagccacggcuccuucugcuaggacgaccucuccucuaugacagacuccaagaugccaccccgagacucaccggauacucacuaccucaacucuccaccccgcacccaucggugaggaagagcaggcaccucagggggacaguccauacaucccccuucguguuucccaucgaaacacaacaguccacuccacgugggaguucagcguucucucagggguggguagagcgccgcuccagacuccugccgcaggggccagugcuggcccagcaguaccgggagccccuccuccugagcacaguggcggcgcccagagcggcagaccucccaccacugcuuccacuggggaaaggccggggaugcucaacgcaaccuuagccggcaacucaggggagagacgcucucaaacgaccgggagucucaggggagcgacgcucucaaacaacccggaguguacagcugccauggucacccacgcucccucuuaggccacggcacacaccagucccugccgccugcuccccucuacccuguuccugacccgucccuccucagccugacaaguccacauugcuugggggccucuauaaauccuccauggcacaaaaccucccuugaccaggaaagcucccaaaggcuccaagcagcaacagcugcagguuuuuugcagauuggugaguacagcuccacgcaucccauccugacuacccccagcggcugcauguccaccugcugcugccucuugcaaacuaugacuuguucaaaagcagguggggagccugggcaacauggcgaaacccugucucuacaaaaaacaaaaaucagucaggcacgguggugugcuugugguaccggcuacuccagaggcugaggugggaggaucacuugagcccaggaggucaagucugcagugagccaugacugcaccacugcacuccagugugggugacagaacaagacucacucucucaaaacaaaaaacaaaaaaagaaauuguccuugcaaccaacugcugugcuccguuuaucugaaaacccuguuuaucugauuucuaguccuguucacagugcucacuacgcuacucauugguuuaaaaaauaaguccuacaucaaaccagauuccaacaauuccaacauacucuguccacucuuaacauguuuucgagcuuuuuuuuuuugauacagauucuugcucuguugcccaggccagacugcaguggcacaaucucggcucacugcaaccuccgccucccagguuacaagcgauucuccugccauagccuccugaauagcugggauuacaggugccugcugccgugccuggcuaauuuuuguguuuuuuuuuuuuuuuuuuuuuuuuuuuuuuuaguagagaugggguuucaccaucuuggccaggcuggucucgaacuccugaccucgugauccaccugccucggccuccgaagugcugggauuacaggcaugagccaccgcgcccagcccagagcuucuuuugugcagcauuuucucuugcucucaauuuaauuucuugcucuaagggaaaagacagcaauaaaaacacgcagcucuuaaaaaaaaaaaaaaaagggcugggugccauggcucacaucuguaaucccaacauuuugggaggcugaagugcuauaauugcuucagcccaggagcucaagaccagccuaggcaacacagugagaccaguuucuaaaaaaauacaaaaauuagucaggugugguggugcacgccugugguuucagcuacuccagaggcaggcgggaucgcuugagccaggagguugacgccacagugaguccugaccaagccacugcacucaaaucuaggggaggagaaagacucuguuuccaaaaauuuaaaaaaugggcacacagaacaaagaggcagugggacucuaagagaaggucuucgugcucgccuggagggaacaaggguugcauagagacuugggagucaaccaagauguaagcagcagacugagagaccccccacuggcacccauuccuccacagcaagcccacagcugcccuacaaugaucacaucacuaccaagcucuggccugacaaucuacccuagaaaggaccaaccacaccagaucacagcauaagcaccccaaacccaagaaguuuucccaagagagaauaugaaacaauaaucuucaaagggcuggucuccaaacaaaaggcagugcagcgaccuacaccuagguacgcccgagaaaugcccacacgucuccacgacacucgcaggucuguguucacagcagcgcugcaaagggccaaacagagaccauucagguguccaucagcugaugggugcaugacccgcaugacccugccacagggagggcugugcucugaugccugcugcagcaagggugcgccuccacggcaccaagcucugccgcagcaugggugcgccgcaacagcacaaagcucugccguaucagacacaaaggcccacagauuguccuucacaugaacgucuggaauaggcagauaaauccacagacagaaaacaagacuagugguugccaggguggaaagaggauccuggaaagggagggggugcggucacagaaggacaaccagggggguccuuguggugacgcaaggguuuuaaggucccgacugugggacacaggcaucugcaucugugaucaacuguacagaacucaauacccuuuccaaguaagggugaaacagcugucuaagaccagaggguuucaucaaugccgauauacacccuaggggugauacuguucagugugcaaaaugccaccacuggggaagcuuggcaauguguacaagggacugcucccuguucuuucuuacaucucaugucaucuaugguuaucucagaagaaaacaaacaaaaaccaaacacggggggcccagcccaccucaaaccccagcugcaggauggaagcucagagaggcugggggccuggccccuucaggaagagccaggccaagaccauccaguaacgagaacgcaaaccuucuggcuucagagcucucacugaggaagaaucucaggcauggcaggaagaagacacacugcuguucaacuggaaaaggaucagacucaguaaaaugcucuuugcauucuuccccacgccccucccugcccuggagcugggguggagcugcuucuucucaggacucaggcgaggggagcccauguccagggguggccagccugcacuuuagugugggccugugcccaacuauguggcagcucugaggaugagaagauguuucuggaaggagcugugagccacagugcaguccagaaggggagacaggcgugcccgguaccugccccagccacacccugggcccaguuaggauccuacaggauccugagcccuccugccguuauccagggcaaagauggcaaauggcuccugcaagaugacacccagggccuugaggcaaauucccccaaccaagcaaagagaagaccagaggcuggagcacaccuccugcugauggaaacagcccagcagcgaccacagggccuuccaggcagcucagcgucaccgcacacauuugacaaaugaccgacugaagccuaggacgcccaggugagcucagcauccuccccugaccugcacccaccuggccuuguuccuccacggcaggacccgagagcagaagggagcuuucaucacggugacugcugugcugggaaagguuuccaugaugcuggucagaggcagccgaagauggcagcaaccucccugcugaugucagccccagacgacccccaggccggcuccugagugcucaguacagcagccucucaaaaggccaagccuccauucaccccacggcacucaacacacccaagaacagaacccugcaggcgccacgagacgcccaagaaccaagcccugcggacaccacgagacaacccuagggcuccgucccuugcuugagcucuccuaguugagaaaaauguguuuggcaauguuauagcugccccgucucaugacgaaggggacuuguucaggugagaaacguucaacugcgcgcucgcuuacugaaaaccgccgagggggaagacgggacgagcgucuugacuuucagggugcacguaaguggcuggucccaccaaggaagugccagaaaaagaugcaacgacucucacuaccucccaacacuuucgcaaauacucacugaagaaaggccaccuacacagagaggcagguucagcaugacaccacuaggcaauucucacagaacagaaacaaauaaagaauaagaaagagaugacagacaagcaccgccaguguccauucuaccauuuggugucguuuuaugucauuuaaaucaagucauucccugcacagacagguguccagcugcucggugcauggaggccagagccacagaaggggccgcugacgccagcagcuucucucuggugcccaggcuauguggucuguagucugugcaccacccacagaugaguucucucaaggaccagcucagauuccgccaugcugcaggaagguccaggcaggcgccgcuccccacauucaagggugcugugcacucccugcccacaugacgacacccaaggagggguguggagggcgaugcagacuccccccugcacccccucaggaugacuagauggauaugagagguggucucggguguggagggcgaugcggacucccuccugcacccccucaggaugacggagaggagagguggucuccaucaaggccacgcccucugcccaggccagcaauguccaucauguuccugagcaaaccgagcucuuccacaggaggaaagggagguagaccuggugaccgugugacuccacuggcaucaagaggaacucuacugacuggccuguuacagaacaggaggcugcuccauagaaaucagcuggaagaaagaacccacagaggcucuaaagaugggaccgguuugucacgggccaagaacauggugaagccaggacugagcacucacacugaaaccaguggguccccagguggacugaggaaccacaaggaccaccacggcgggcacccggcccucgcaugcacacacgggcaacuuuacaaccuggccugggaagaaggaccggcgcccacucccaggaggaaaagcagcggcagcgcacggcaagauggauccugacacucagagcuggggaaagagccacacguccuccugcagcccgagccucucacugagauuaagaggggcucuggggcaggcggaggcggcggcagcgcccagcgacggaugcggccaccacugcagggccugccgccgguguggagagcccgagucacggagccccaugcugccccucacagcacggacggggucgacaaggcaguggcaggcggagugagaggcggcucagggcaccagcugcccacugagucacugugagaagagcgaaggccaaggcuugggaagguuuccagcugacagagacgccacugaaacaugagcugauaaaacaagaugauguuggagauuuacuaaaauacuaacauuaagauauuaauacuaaaaauuaaaauacugaaauuaaaaaauguuuaaagaaagaaaaaaauuuuuuugaaaacaugaacaagugcaaggaggagauggaucaacccgagcuggucaaaugcuaguaaacgcugagcccggggacccaggacacuguucucucagauuuugugacugaagauauuccccacgcaaaguuaaacaaauguugagagucagaaagccacccuguggcagggacucacugaaaguuacuuccuacagcuccugcaccacccguucaucagugguccccguuuacggaccccggaagcucccgggugacccaguccaccucagagaguaucacccacagaaugcaagcugacuggugugugccugccuaccuacauacaccccgaggaaggcacagcacccacaguacgugcguucacugcaaggaaagaaucuuccagucaccguuccucuguccccauugucgcugucauaaagaacucuucucccgcugcauaucaccgggguucaaauaaagcccuucugagggaugcccugugggaaugacagaagcaauggaaaaggccuucacagaucauccaaugcaacuggaaaacuaagacguuuacccaagauugugaagcaauuuaauagcugaacuugaacaaaaacaccuauuuccaaaauuauccccagauaagugguaaggcugugguaagcggcagcauccaacacagcaacaccggaccccuggcuagaauaacccacacagugauacagaugcgcaggaagcucaauuccaaaacacacgccuuccaccgggggcaaccccaacagggagccaggccacccucuccagccacgccagcaccgccguccacccagcugcuccuucgagccgugcacggccugagucacaggaaaagcccaguucugcugaguggacggcugcaaggggaggcuaaauauggcucauagcaguaccagacaccagcgauucgagagaaaacaucggcaugugacugaggcugacgucggaaguucacauucccacgagcugcuuuacuucacgaaaugaaaacaucauguaacucucgcugaugcauaaggaagaccugcagaaacgcugcagacacaaccccacgcgggaggcaugcacacgacaccccucccacaccuaccugggaucccccaagaacccagcacccagggacaccugacagacgccuguguaggguuacaagauugguagaaccuuauucuuacuuuuaguuagagcugcuauuaauugcacuugacacagagguggggccugagucuuggcaggcgguccacacgggacagggucaucaggagugaccaccaagcgggcuggggcccuggcccacucgacaucuccagaagggucugacgaccacaauaccugcaggacaggagcuccgcacuucugcaaagccagaguggagacaacacgcaagugugaggcccgcagagagggguguuaacccgagacaaaaaugaucaauaguuuuacuggugauuuucuucacccuccccucuccccaugacaucccuuaaagagauccuuuauucacggcaauucuuuuuaaaaacauuaauaucagacuucaaagauuuacaguauuuucauagaaaucaaugagauuuuaugcuuauugaaccuaguaauucucuucacuuaaaaaauauuacuagagagccgaggucagcgaguuauggcucaccauguguuuuuguaaaaaaaauaauaauaauaauaaucacacucaccuguuuacauaaaaucuaugacuacuucuguucuacaugggcagagcugaacgauacaacaggaacuguacauccagaaaagccuaaaauaccacuaaucggcccaguacagaaaaagccugucaagcccugcucugugagagaauucagagccgauggccucugccggccgcugugugugugagcuacacucuguccuaugcuuccaggaugcgccaucuacagagcaaccucaggagagcugugggaacagcugcucgggccaucucccgcgugcuacgaucagaggagaaaagcuccuccagagagcaucgggaaaagcacuucaacucugcucagguaaggaccagaaaaaaacaggaacuaaaacaugccagcugaagaacuccaugaugaacguggacacacacgugugcacagagcugaccccgaacaccacggcuuggcugcacacggcaagucacccaucgauuuguuuucaacaaauacacugaaaaacuuauuagagauuugugaccauuuggaaagaauuacaaaccauacagcccaggaauaccgaaaaaagucagaaaaaguaugucaugaauguacaaaauauauguagauauuagucuaucauuuccuaccauaaacuauacacagauuauaaaaaauuaaacgcuuauaaauacuuacagacuguacauggcaucguucagcagagggaaacguaaacaaacguaacgucgcaggcucaagcagaaguguauacaacucagugcgggacauaccacacugcacgcuguaaugaucucacagccacagccugugcuaccgcggugagcucaagugugucgguauccgcuuaaaacaccgugugacacuaaucgucuccgcgugagcagcuggucucuccagaaauuguguaucacaguaaacaaauuaucucaagccuuaagcuaguugcgguagcaugggccuggagucccagcuacucagaaggcugagauaaauggaucguuugagcccgggaguccaagacugcagggcacuauggucaugccugugacaagccgcugcgcucccgcccaggcaacacagcaagacucuaucucuuuuuuuuuuuggagauggaguuucacucuugucgcccgggcuggagugcaguggcacgaucuuggcucgcugcaaccucugccucccaggcccaagcgauucuccugucucagccucccgagugauuacaggcgcccgccaccacgcccaguuaauuuuuaaauuuuuaguagagacagggguuucaccauguuggccaggcuggucucaagcuccugaccucaagugauccgcccagccucagccucccaaagugcugagauuacaagcaugagccacugcacccagccgacuccgucucuuaaaaaaaaaaaaaaaaaaaaagccucuugcaguucucaagucuuuuucauuguguuuacucaauaccauaaacccuaaaugacaccacagacccacacaaagugccacuagcgaugcuggcagugcucccaagaagcagagcucccaggaguugugacuuuaggaaaagcuaaacuugcgugacacgccgcagccugugcucugcuguggaugcuuuucaaaaucgauaaauccagcagaagggccaucacaaaaaaagaacaggacauccgugaagccaucaccgcagcuacagcaacaggcuugaaaauuuuuuugugaaauaccuuuuuaucucacugaaaacgcagcuuuaaaauuaauucccaaacagcacggauauaugaaaaugugugggugcaggauugcuauaagaaaggcaaauaccaauagacucuagucugauuccagaaaagugaagccauuauacaacaacugaaaguaaaaggaaggggaagcagcuggagaaguggaugccagcaaaggaugguuugacaguuuuagaacguuuggcuuuaacaaugucaagauaacaggagaagcagcuucugccaaccaagagguagcagaugaggucccagacaccaugaggaauaucaucgaggaaaaaggacaugugccugaacaggguuuuguuuuuguuuuuuugagucagacucuuguuccgucacccaggcuggagugcaguggcaugaucucagcucacugcaacuuccaccugcuggguucaagcuauucuccugccucagccucccaaguagcugggaccacaggcgcccaccaccaugcccggcuaauuuuuguauuuuuagcagagacgaggguuucaccauguuggccaggcuggucucaaacuucugaccucaagcgauccacccaccuuggccucccuaagugcugggauuacaggcgugcgccaccacgccuggcccugccugaacagguuuugaaugcaggugaaacuccccuauucuggcgaaaaaaauccuguaagaacauuuguuaguaagaaagagaagcgagcacugggauagaaggcaagaagggauaagcuaaugcuacuguuuugugcaaaugcaguaggguuuaugauaaggacugccuuuaucuauaaagcugccuaccucagaaccuugaagggaaaagauaaacaccagcugccagguauuugguuuugcaacaaggcuggaaagaaccccuuuuuccggacugcuuccauugaugcuuuguccgugaagucaggaaguaccuugccuugccaguaaggaacugccuuaaauguucuuuugacaaugaacaaugcccuuggucccccagaaccccgugaguucaacagcagaggcgucaacguggucuuccuguccccaaacacagcguaucuaauucagccucuagaucggggucauaggaccuguaaggcucauuacacacagcaugcuauggaaaggacugucaacaugggagagagagagagagagcaucaugagugucuggaagaugacaccaugaaagaugccaucauuguuauagagaaagccaugaaagcugucaaacccaaaacaaugaacuccugcuggagaaaacuaugucuggagguugugugugauuccacaggguuuacaacagccaaucaaggagaucaugaagagacugcggacaugugggccggggcaggagggcuggggggcggggagggaugaaggguuucauuucaaaacucaagagcuaagagauaccacaccagagaaauuagaagacaaccugguggugaugagugcuucugacccacaccaggugacgaggaggagguagcagcagugacagaaaacaaagugacaucagacacuccugcagaggggagggguucccacgacucccacccgcuuuuaacuucuuguacaacacacaccugucugugacaugggcacugaaacuaaagccaacagugagggaggacugugaccauacaggaacauuucuagagaaaugacaaagcacuucguaaguuacaccaaaugcgccugccucuccugccuccccuucuaccucuuccacccccgccccaugagaacagcaugaccaccccuccuccuucuacucaaugaaaugaugaggaugaagaccuucaugaugacccacuuccacuuaaugagaaguaaacauauuuucucuuccuuaugauuuucuuaacaacaccuucuuuucucuagcuuacuuuacuguaagaauacaguauacaauacauacgacauauaaaauaugaggggcaugguggcucacacuuauaaucccagugcacugggaggccgaggcggaaggaucacuugagcccagcaguuugagaccagccugggcaacauggcaagcgagacucugucucuuuaagaagcgggaaaaaaagugcuuuguauaugucaguguuggauuaaaauguguugacuguuuaugugaucaggaaggcacuggucaacaaaauuaaauacucgggguauaaaagguuauauguggacuugacuguaccaggggucagugccacuaauccccaaguuguucaaggaccaaacauauauaaugauuucaucaacguguaugucaaccauauugauuaggucaauauugauuuguaauucuugauaauaauuucaaaucauggcauugaagccuaaccacaaaaaccuccucagaaaauagcaaaaacguagagcuuuaaagauauuaagcuaaauguacgugcuauaaggcuacagauacagcaggcuggaaauagucuggcugagaacacacaacuggccagcaugacuagcaagugcucaaguagcuucucuuguuugaagacacugguguacacaaagauuucugccuccuggguucaagcaauucuccugucucagccucccgaguagcugggauuacaggugugugccaccaugccuggcuaauuuuuugucuguguauuuuaguagagacgggguuucaucauguuggccaggcuggucucaaacuucaggcgcugugguuuaaaacucuuuuauccauguuuuaagggguugauggguggggcgagguggggaagggcuuuccaaggcugaaaaccucuucagggguugguggguggggcgaggugggaagggcuuuccaaggcugaagaccuuuuugggucaagguucugacggcacacuggggagcgucaagacgccuccugcagucguagacaagccgggcugaggcauucacugucgcuuagaacugaaaacuuagggucguccaugcccagaacgucggcagugcggaccagccccaggaaggccuuucucacuggcuucuagaagguggggccggcccccaugccugccccggcacacggccauucugggagcugcuggcagccggcgggcuagaaggggugcacaccgucuguaugugcgucacaggcucaugcuuuuuuaauccuaucuugaaaacuuagggcuuucucacaaagaccuugugccaguuccuaaguggaacaacaauuuuauaaaauaauuuuaaauggcucaaaucaaguguuaccagugaacggggcuuucauuauaugucgaaagcugaccauggggaacaggcccacaggggccuccugcuccacacccugucagggcauccaaaaccagcucauguaacucugcuuuccaggaguccaacuugaacauuuuuuuaaagagacaaagucuugcucugucgcccagacagagcucagucacggcucacugcagccucaaccuccugggcucaagugacacuucugccucagccuccuggcuccaacuugagcuuacaguuuucugcuccaccacugcucucugccucccaccuccaggugacugggacgcgagcgccccaagcagcacggaagagcuccgugcagugcacggauuugcgaagaacguguugguucuugugauucacaaagaacuuggacugaguacaacgggcaaagaagaugucagcuguauuuuuaacauucuguucagcaagaagaguauacauaauaauuucccaaaaaauauaauuuuugaaaaugcagaaaaauaaaaaauuuagaaagaaauacauggcugcagacacugaccuuuucaguuuuccaaucaucauuucucaaaacacacacuuucaucucuauuuaccaaacacuauuuucugcaucuccaaaccccucaagcuucaguccagguccaaguaucaauggguauauaugaagcuccucugccaccagaaauucacuauggaaagauguuauuucugguaccccaguugcaaaacaaugaugccuguuuuuuucuuuuugagacagagucucauucugucacccaggcuggagagcgauggcgugaucucggcucacuucaacacccacuucacagguucaagcaauucuccugucucugccccccgaguaguugguauuacaggcaugugccacgacgccuggcuaauucuguauuuuuaguagagaugggguuucuccauguuggccaagcuggucucaaacuccugaccucaggugauccacccaccucggccucccaaagugcugggauuacaggugugagccacugugcccagcccaaugaugccauuuuaacuccuuuucuccuaaguggauuagagcucccugagccuucagauagcuuccuuggggcuacuccagagaacgaccagcagucuccaccugcauaagaaacgggacacagggcacgaagagcagccccaggaccugcccgcugccuugggacuugugaaagcauuuuuuguguaaugccaaacaggucuuuguuaaaagacaauaaccaauaggagacaggcuucuagaucugcagaaacucuagaaauaaaugaaggaaagccugacgaguaccugccugcuuuccagggaagagaagugagcaaaggcagagaagaagcuggaggccucguggggcaucuccugcacgggcagcagggcugcguaaccaccacgagcacuggggcuuaugggaggaaggagugugugcaguuccggccccaaaggugaccaggccuacacggggcaaugcagcucagaggucgugggcagaggacagcugaggcaggcagacggagcacgcaucccugcuucccagugugggcccacucugcugggcaagguucuaaggggcuccgagugaagccccugagcacacgguaaacaaucgauccaaaaagggaugagaagggcggcugggcgagguggcucaggccugucaucccagcacuuugggaggccgaggcagguggaucauuugagaucaggaguuugagaccagcccggccaacauggcgaaacccuauuucuacugaaaauuaaaaaauaaaaauaauaagcugggcaugguggugugcaccgguaaucccagccacuggggaggcugaggcaggagaauugcuugaacccgggaggcggagguugcagugaggcgacaaugcgccacugcacuccagccugggcuacagagcgagacucugcugcaaaaaaaaaaaaaaaaaaaaaaaggggugagaagggcaagcaagaguucagacuauuagaagcaagacaccaagaaacucccagacaccaacaccuaccaguuuaggguuauuguauaaggagcaagagcuuuucacauuguaacagccccaacauuaaaucaucaauaaaaagcaaaaugaggguaagcauucuaguuuauaaaacaugcacuaugauuuucuaauuauccaaacaaguaacuuacaugcgaugauacgcuuuccaacaagaggagaacgaugaaagcugucaacaucccccaacaugccugucacaaaugcgcaucacagaaacccaccuucagaacucucaucaggaaacagaugcccucugcuacucacauucagacuggagaauaccugucagcauauacaccccuccuuaccgaauuuauacacuuugugaacaaguguuccccgagcacauugaccccacgcgaauggggggaagagguagaggucagaugagacccaggagggcauaacuuacagccucugccacaggccacucacguggugaccacaguccagccgacugcacucucaggcugugaccucuccacggggcucagacuguaucuaguucuaucuucaauguagugugucugagaucguuuaacuaaaagugcuuuacaaaccgugcaagcagccagcacgacuguccaggcccagggaaggugaugggaaggagccagugaauggggcccaggcaggcgccaccagaacgggcgagggggacgcggccucccagcagcugggcacacccaggggacagagagucugcucccacccaucuccucuuuccccuggagcccuugaacccaucaaauggauuuaaggccacugaccagggcaggagugacccaagcaaaguuaaaaggugucuagaaauuccuugagccucuaacugcaucuuaaacuagacagccaggcacccgaagucuagaaauauauauauauauauuuuuuuaaagacagagucucguucugucacccaggcuggagggcaauggugcaaucucggcucacugccaccuccgccucccagguucaagcaauucuccugccucggccuccugaauagcugggaucacaggugcgugccaccaagccuggcuaauuuuuuguauuuuuaauagagacgggauuucaccauguuggccaggcuggucucgaacuccugaccucaagugauccaccuugauccauccacuucggccucccaaagugcugagauuacaggccugagccaccacacuuggccgacaaauaaacaauucccccccuccaguagauggggucucacuauguugcccagguuggucucaaacuccugggcucaaguaauccuccugccucggccucccaaagugcugagauuauaggugugagucaacuguguucagcugaaauaaacguuuaaccaccaccuugacaucauauccaagaaacaaaaguagaguuuccuuuguuugcccauuuuuugagacagaguuucacucuuguugcccaggcuggagugcagcagcaugaucucggcucacugcaaccucugccucccagguucaagcaauucuccagccucagccucccgaggagcugggauuacaggcgugagccaccgugccaggcuuguaaagcguaacuuuuaauaaagguaguuauucaauuaugccaugucauauaccucucucgucuggauucaacuuucacaccacuguaauauagguuuuaaaagcugggugugcuggcucaugcggacccacagccuaaggccaaacagccgccugugcugcugaguaaagggagcggugcgaggucaccucagggaggaagagggaggagccacaagagcaaaguguucagcuggcugaaagcucaagauaaccggcucugccagaagcacugccauuaggauuuccagggaaccccuccuagccaugccugccuggcugcucuggaggggcagcagcagccccauaccaacgcugaccuccugagagaacaagacgaggagaucugugccauggcuguccccacacucugggagaaugugaguucagaaaggcgcuguaucuacccucccugaugggcucauuucugucucauucaaaaccucggggccauguccaguggacgcugcugccuccugugucugcaagaaggaagagccaugaaguucccauggaacaaagcacggccaggaauggccaaagccgaagagccucccauggugucacgucgagccccugcccucggaccagcaacgcagcagacgucgagccccuacccucggaccagcaacgcagcagacguccagccccugcccucggaccagcaacgcagcagacguccagccccugcacucggaccagcaaagcagcagacggaaagccaagaaggcccaaugccaagagcccaaucaugauagcacccagagggcaaaggugcagacuccucccucacucccaccuuucccaaacaccaccuccaagcuccagucauaccucugucucacaaacacccgcuagggccuugucaaacucaccucccacugacgaaggcgcuucacaaaagcaucuagcaagauaaagaaucugaaacugggaggcugaggcaggcaggucaccugagcucagcaguucaagaccagccuggccaacauggcaaaacccugucucuauuaaaaacacaaaaauuagccgggcgugguggcaggcgcuuguaaucccagcuacucaggaggccgaggcagggagaguugcuugaacccagaagguggagguugcagugagcugagaugugcuccugcacuccagccugggugacagagcgagacuccaucucaaaaacaaacaaaaacaaacauuucucaaggcugggcacgguggcucacgccuguaaucccagcacuuugggagaccgaguuggguggaucaccugaggucaggaguucgagaccagcccguccaacauagcgaaaccccaucucuaugaaaaauacaaaaauuagcuaggcguaguggugcauggcuguaaucccagcuauguggggggcugaggcagagcagaacgggaugggaugaaaugggacaggacaagaugggaaugggacgagauggaaaugggacaggaugggacgacauggaacaggaugggaugggacugggaugggaugggaugggaaugggacaggaugggacgggacgggauggggcaggacagagcagggcagcuucugcaggaaggagccucugcacuggcaguggcacugacggcuucaaaggagcugcgaagacacaaacuacagaaagaauagaacucaauucuucccuccuuuuaccucaaucagguggccuuuuggucuuacuguauuuuuggcaaccuguauuuagcaccuacagaaaaagcaggcccacuagacagcccaacaacagaaccgcugcaggugagaacauacguguguaagaacaugugugugggagcacacaaugagaaauaguuuucuuuuuuuuuuuuuuuuuuuuuuuuuuuugagacuacguuucugucgcccaggcuggagugcaguggcacaaucucagcucacugcaaccucugacuccuggguucaagugauucuccugacucagccucccaaguagcuggaacuacaggcacacaccaccaugccaggcuaauuuuuguauuuuuaguagagacgauauuucaccauguuggccaggcuggucuugaacucuugaccucagguccuccaccucccaaagugcugggauuacaggcgugagccacuguacccggccuugagaaaugguguuuuuuuguuuguuuguuugagauggagucucccucugucacccaggcuggagugcaauggcccgucucagcucacugcacaggugucugccaccaugcccaacuaauuuguguauuuuuaguagagacgcuguuuugccauguuggccgggcuggucucgaacuccugaccucaggugauccacccgcuucagccucccaaagugcugggauuacaggcgugagccaccggacccagcagacagaaaugguuuucuauggcagagcagacugagcccguccacaagccagcaccgggcagagggaagggcgccagagacaccgagacccuguggguaucccugugucagagccucaagcugcucccuaccaauucuccaacucuacugagugagcaagaagacagucaccauauucccaacacaacacacucacgaugaugcauuuccacauuucacucaaaugcuuuaaagauuucaaaacuacgaauucacuuuagguacaguccaucacguacagucugcaaagaaaaccccacucagcaccacuuucacgucugacgacagaaggcuaacgugaguggcagugagaccgugccagagccugccugccucacccccgccgcugcgcagccagaggccggggauuaggccagacaccagcggcucgccaagagcuccauuugugaccguucccuccguaggcaacccggugguccccacucccaggaggucaccacacggaugccaaacuuagcacacagcggacagcaguccagaacucccuggcucaagccggccucccgcucagccucccagguagcugggaccacgggugugcgccgccaugcccgcaaacuggguccaauuugucugcaagagaagcaaaggggaugccagggcuucuccuauuccucagauuuucguuuuuaaguaaagucauuacagauuaagaaaauacaauaccggcuuccaaugaacaauucaucuuuuaauguaaguuuaaaacaaaauggaaauccacacuacaaguuuuccauuaacauaaugaccaaauaaaaaaugacuccauguuaaaaaucagucacuuuuuuuuuuuaaagcuugauuauuaagacagacaaugcacuaauucucccuucugagggcagcacgaccaauucccaacguuacucguguguccagggaccguccacacugcccugcugccccacccuuuacccaaggagacgccagaaacccagccacuggucccuagcaagaggcccucuuuucucaccagggacaguggaggauagaacccggcacacagcaugagggugugggggaaagggggcucuucucuggaaggauggcaguggcccgcaacgaccuugcauccugcaagaugcccgcggggaggaguguauccaaaagcacccuacaggacacgagucaagacagaaucacaaaucucuucucguccaggaaacuugacucccuuaccuucugcuagguggaaaagcagacacgcuuauaagcuacucaaguuuuuuauuaaaaccauugacuguuggauuucaucaauccaaaauagcacuguagaauccuuccagauggcacaaugacuuguaaacagcaucuccauaaagcagaagccugaagacucaguccuaucacagccagagcugugugcgaacagacaagcccugagaagugugccagcaagagacccugccccagcuccccacgccucgaccaccgagucaagggcaugaagggcuuggcagugagggcaggaggguggccccacccugggagcccuguaucgacugggugcucuggaggccgcccguggugacaggccagggcugcuuucagaccuccuggaaggugcaggagccacagaaggccccagugacauggaggaggugucugcccugccaagagcagcgagggugggagagguaggucacacagccaccaccaaacaauggugaagaaggcccacuaaggacacugcucagcaaggaaacacacaggaagaucuggagugccaaguuaaaaaaaaaaaaagcaucucucaagggagaggccugaauggugggagugccccucgaacagaaggaaggggcugcgucuguggugaggggacagcagagggauagucaggccucccacucugcaccacaggucugugaaguuucuauuaagacugugcuugggccgggcgcgguggcucacuccuguaaucccagcacuuugggaggcugaggcgggcagaucacgaggucaggagaccgagaccaucccggcuaacacagugaaaccccaucucuacuaaaaauacaaaaaaauuaaccaggcgugguggcgggcgccuguacucccagcuacucgggagacugaggcaggagaauggcgggaacccgggaggcagagcuugcagugagccgagacugcaccacugcacucuagccugggcgacagagcgagacuccaucucaaaaauaaaaaaagaaaaagaaaaaaaaaaaaaaaaaagacugugcuuggccgggcacgguagcuugcgccuguaaucccaacacuuugggaggcugaggcaggugaaucauuugaggucagggguucaagaccagccuggccaacauggugaaaccccgucucuacuaaaaauucaaaaaaauuagccaggcgugguggugggugguggucgggucuccccaacuacuggggagacugaggcaggagaaucgcuucuugaacccaggaggcagaggcugcagugagccgagauggugccaccgcacuccagccugggcaacagagcaagacuccaucucaaaaaaaaaaaaaaaggacugugcucaucuguuagguuccuuuuuuaaacuucagacuuacaaaaaaguugcaaaaauaguucagagucccuguacagccuuacccagcuucccuaaugcuaacaucauacauaaacauaaccacagugaaauuaucuaauuccaaaaucagcacuaacaccagacuauucaccaccacaaagaccugacuccgacgcaaucacccugcuccagggcccacgcggguggugccgggugcucucuucucuccaugaggcugauuuuuuuuuuuuuuuuuuuuuugagacggagucuugcucuguuggucaggcuggucuugaacuccugaccucgugaucugcccgccuuggccucccaaaguacugggauuauaagcgugagccaccacgcccagccuccaugagguugauuuuuaaugucuugaaaaucgacacggaauagaaaauaagcaagauuugcguuucccuguggugcugucgaacgcacacacgucacaaaaaagcccacgagaugacaaaaaagccugaaugcugcaugugugucucugacugggaauaaggaucacuggaaaauauuugcaccugagaagauggggcugaaggaggcugcauagagcaggagcccugcgaugagccggggacccccuuggagguuuagcggacaggacgucauccacacaaagaagagccggcaggucccgggcucacacaggucuggaauggugccacugcccagccagaucccuguccgcagcccugggaagaagguucuggaaggcacugccacagcccggggaaugaugaacccaaaacugaaccaagcuccagccugucucacaaauccuaaaagcaacagcugaaagggacaaaaagguuccaaggaacuauguggaucccagaacaaagcccaagaugacuuacaggaauauacaauuauccagcacauaaugagguaaaauucacaauguccagcaucccaucaaauauucucaggcauggaagguggaacaauuugagcaaaaaauaaauaggacagcaauggauuacagugcuggagugcagugguacgacagccuccagggcucaggcaauccucccaccucagccuucugaguggcugggaugacagauacacgccacuacgucuggcuaauuuuuuuuuuuuuacuuuuaguagagaugaggucuccuuacguugcccagucuggucucaaacuccugggcucaagcaaucuucccaccuuggcuuccuacagugcugggauuacaggcgugagccaccacacccgaccuacaacuuugcuguaaaccuaaaauuuuucaaaaauaaaaaguauauugaaaaaaauuccugggcauguaaauaagaaaauaugauuacauaggagaaaaaaaagucaaucaaaagcuacccagaauugacacagaaggcaaaauuaguagauggagacaugaaaucguguaacucaguuccuccccacggucaaaaacuaaaaacacggaagcuaggaaaagacacuggaaugaaccucuagagaugaagaugacgcugugugagacgaaaaucacacugggugggauucacagaagaacaggcauucagaagaucugugaacucagagaaacggcaugucaacaacucaaacaugagcaaaaacacugaguguggcagggagcaccgagagagaagaucacuggggcaaacaccgaguguggcggggagcaccgagagagaagaucacuggggcaaacaccgaguguggcggggagcaccgagagagaagaucacuagggcaaacaccgaguguggcggggagcaccgagagaaagaagaucacuggggcgaacaccgaguguggcggggagcaccgagagagaucacuggggcgaacaccgaguguggcggggagcaccgagagagaagaucacuggggcgaacaccgaguguggcggggagcaccgagagagaagaucacuggggcgaacaccgagugugacggggagcaccgagagaaagaagaucacuggggcgaacaccgaguguggcggggagcacagacagagaagaucacuggggcgaacaccgaguguggcguggagcacagacagagaagaucacuggggcgaacaccgaguguggcggggagcaccgagagagaagaucacuggggcgaacaccgaguguggcggggagcaccgagagagaagaucacuggggcgaacaccgaguguggcggggagcaccgagagagaagaucacuggggcgaacaccgaguguggcguggagcacagacagagaagaucacuggggcgaacaccgaguguggcggggagcacugagagagagaagaucacuggaucaaaccccgaguguggcgugggugaggugcaggagccuaaccaacgguaaggggugcucccaaaggagguggagggcagaaaaaaauacgugaaggaauaaagccugaacauuuccacauuuugaugaaaacuguaaacucuagugauccaagaagcucaacaaaucccaaucacaaaacauggagaaccugaccaaggcacaucacagaggugaaaagaaaaucuuaaaggcagucaaaggugagaaacuagguaaagaagaacaggcaaaagggacgacagguucucggggaaacagugagcacacagccaggggccagcacccguaaguccugcagaaaaacaccugugaaaaucuuucaaaaacaaugcugcugguaaugguugucuaacucuggggaggagguuccuggagcucugcgcugcuccccacaugcccugcccuccgcaucugacugugcauauccuuugcaaaauccuuuccacgacacuggugaacauguaagugucacccugauuugugugagccacucucauaaaauuauugcaccaggcugggcgccauggcucacgccuguaaucacagcauuuugggaggccgagguggguggaucacgaggucaggagaucgagaccauccuggcuaacacggugaaaccccaucucuacuaaaaauacaaaaaauuagccgggcgcgguggugggcgccuguagucccagcuacucgggaggcugaagcaggagaauggugugaacccggaaggcggagcuugcagugagccgagaucgcgccacugaacuccagccugggcgacagagcgagacucugucucaaaaaaaaaaaaaaaaaaaaaugauugaacccaaggaggggucacggaaccccagauucagggcaggucgcugagaagcacagccacaggaacccagggcuugcggugggugcuggagugcuggcagucuugcgggacucaguccucucccugguggaccccgugccgucuccagguagacaguguccaggcugcacgggauugugggacacccagcugguguccgccacagaacugacugccucccugcugcugggcagaaagcccacacaacuggucacagacgucuuuugcguuuucuguguugacugucgcuguggcaugagagcaaaggaaaaaucugaguuuucccccucagaaccccuacuaacugagcuuagaaauacaugaagucaagcuacacagacagauacacaaaaccacaaacucaguaaugauuuuaauacccuguucucaaucacugagaggacaagcugacagagaaucaguaagcacacuuguaagaaguaaagcagagguuccucuucaaagacuuuccuccccaucuaacuaaaaauaaauaguaacuucucuuaaaagcaacauuuauucaaagaccuguacugacauucuuaaauaucugcuagccuuaauaaagaaaucaauguacuuuauguucuuagcucccacaauuuagccuaaauaucugcccuggcaugcuuauacuggucgaagcaagcauuaggucacggccuguuccucuuccuuaguugaagguguuuuuaccuuucucagcauuccacaaauuacuuccuccuuccuuuguucuccucugccuuugccucuuuuaaaaaguucuaaguugcuagccaaucgggacaaauacagaaugugaggucccguuccagccaauggaaaccggacacagcaguugguauaaaaaaaccggacacagcgucagguuauaaaugacccuggucuccuucauucgguguacucucguggcaaaacugcaggcgaguguacccuuucugcagaagguauaaaaaauggccuugcugaggaaauuaaauuuacguucaagugcuauuucuuuacggcaccagggagcaagcauuucaaacacacugauggcccauuccugaaggaucacaagaagcuaaaauucauuaccuguauaagggaguuuaaguuagauuuucacccuuuucauguuuucuuacauuuucuacaauggguaaacgauggaaauaagaaaaacaauguuuauguuuugaaaaugucucaaugggucugccaguucauguuuuccaugagcagcacugugaugccacgcugagaugcuccaggguccaugcaguucaagaacauggucgugauguguugaagcagaccugucuugguugucccucagaucccagcuacagaaguuaacgaucaacucagcaucuguaaugcacuucggaugucagccuacaagagcagacccaaucaacaugguugaguucacagacaacgguaucuaggauguccggcacacccagaaccugcacuuaagcaaacucguggauaggaagucccccaaggcugcuuuucucuaaacacuagguuaggaaaaaagaaaacugggaauacauuuaaccgacuccaucaacuacauaagaaagcaccuuugagagugaacuugugucuaaucaccaccuugggaccugccugcaucugaaaugagugagugaucuacagucaccaaggcccuuucuguuuccccaaaaauuccuuuucuaaacuccagccuauuucuucacauucuacuucuuauucaaggccuaugcaaaugcuaacccucaguggagccuccggcaagcccaguccccaggaaacacggucucccucccucuucuucaccugcauaccuucucucacaggagccucuggaagucucccucaggaccuggcaccuucuugcuacaucauaaauaccuugagagcacgacgccagccucauucaccuguucccacaggugacauggcucccacccugggaccaagagaguccacuguacacauuaaacuuuaguuuccucuuuuuuuuacuuuuuuuauuuuuauuuuuuuuuuuuuugagacggaggcuugcucuguagugcgagaccacucaggcagguggaguacaguggcgcaauauuggcucacugcaaccucugccuccugaguucaagcaauucucccaccucagucccccauguagcugggauuacaggcgugugccaccauauccagcugcuuuuuuuuuuuuuuuuuuguauuuuuaauaaauagagacgggguuucaccauguugcccaggcuggucucgaacucccgaccucagagugauuugcccgccucagccucccaaaguggugggauuacaggaggaagccacugcgcccggccuaguuuccucuuagguggaguaaucacguccaccucagaggauuuguaaggguuagaaggggaagcagccgggccgauggaaacaugcaggaacuaucccagcugggccuauugcccuucauucuggaaucuggcagagcucugcauggcaucucgcaugaaacaggcucuaaguauuuaaugaauaggaggagacaugucagacagugggaauaaucaugcugaucugcaugaggaaaaugugucaaaaaacaaaagccaaaaagucacgaagaaagugcuuguaauagagacuaguuuacuugugagggcuacgaauaagugaagcucaaaccacuaggugccaaacaugaaaguggguucccagaccccaguguuugcugacugcaacacagcggugccugcagcucacagggugcuccuccccgccucccuagcccuccuggagacuccacccaucacagucccagguuccaggcaggcuucccaggccacucagcugcugcaagcacaauguccuccugaggucaacgggcagguggcaggagccucugaccugcuucccuccacgacaugggcacguucugggacugcaguuccacaguggucucccaugucccuggaaagcagccguccgccucuccuccacaccugccacacugcucucacucaucaggaaacuucucaucagaaaaacagcucgugggccaggcacaguggcucccgcccguaaucccagcacuuugggaggccaaggcgggcagaucaccugaggucgggaguucaagaccagacuggccaacauggugaaacccugucucuauuaaaauacaaaaauuagcugugcgugguggcaggcaccuguaaucccagcuacucgggaggcugaggcaggagaaucgcuugaacccaggaggcggagguugcagugagccaguaucgcaccacugcacuccagccugggcgacaaaagcaaaacucugucuccaaaaaaaaaaaaacaaacaaccuuuuguggaaaaacgaguguauuuuccacuccucgucucaauaaaaccugcgaagacugcuuucauauacaggagucguguuuuaugacaaaggcuccaucaaggaugcuguaaaauuacacacagccaucuccauaauauauggccccgagaguuacacacaugagguuauugaguuauuuuucaaacguccagacuccucauuuccaauuaaggcagguuggcuguagcacuguuggaaagccuaaagcuuuguuugcagccaauucagaggcgacaguuuuuccaaggcuacuuagagcugaugagagaacccccuguuaaaaagaucuccaaaccagcaaauacaucacgguaugauuuuaagucacugcaauccagaucaucuuaaaaguucugcaggauuuggaaaaacaaagacaaauuauuaaaccaagugaccaggcugaagcacaggacaagaugaaagagggccaagaacaggcaacaccaccacucaaacgauccaagagacuccuggucuaaaaaguuagaggcuuggucaauuuuaaggcagcgucuuaacagaaagaauuaugcaagccaaguaaacuggcugagccccagggaagggcugcguacugccagaggaaugggcuggacucuuuccagcuccguaauccugggagcagcgucgguguggaaggaacccugacggcaagcuguuacauaagagcccaguccugcacugcggggacaugguccgcuugcuacuggcaugcaaagaucaaagagaggagacagcgcugggaugccagcccacggcugggacacgugcugcuucugugagcaugcgcccaggaacagacgcacagacccacccgaacggggaaccgaaucuuacuuguccaugagaaucccaggaggggaccaaugggccaucacauuggaacccucugaaacugcacacacauuugcaagcauagguaucaggggagguaagugauacagacucuucuaagggugugaaauguuugaaaaguugucaauaagcacacagacugaccugauucauucaacaacauuuucucacccagcacacagacugaauagcuugguacacuugcuucccagguguaaaacuaccugcuuaauaacaaugccuucucagcugggugacaccgcacugaugagccaguucacuggaggacugcugggguggugcggcaagacuguuucaacgcacuacgucccgagcacgcagcauucaucuugugcauauccuucaugacaaaacaaguaugcacaaagcacugcugccgcacaccagacacagcggccucuggacaggaagcaccaaucuucagucaaagaaugaccgaccgacaugcaaacucugguuguucggacaugaguacuggcagaucauuucuaaaaaaugaaggaaagacagcugcaaguucagccagaacaccucaacaacuuguugucaaugugaaaauucaagcuuucaaagauaagaauuuuggaaaacuccaagagcagacagcuucugaagaacuaaaagucucccuggaagagacaggugcugcuuucugauguaguaaaaucaaguggauccacgucgggagaugcacacgagucccgggcacccaaucggcccuugggugcacacugugugcugaccugggucaccuccagauguggacacacaggcacacucccacacacacgcgacggagccgcacucgccgcaagagagaccaaagggaagcccugagacuccccugcugcuggaaacgcucacagcacaaacaccugcuggguuuuggugucguaucaaugaaaaucuccauaauuauaucaaaaagcuauuuauuaaaaauaugcuuccauuuucccacuagauuuuuuuuuuguauacuucaacuagaacaacauauuuaccacagacugaugcaggaacagcgaggagaacccugcugucuucuaugaagccacacauuaaugggguuuguacaauuuuaaggaaaugcuccucuaauugcuauuuguuguuguugcuguuguuuuugggacggaguuuuacucugucgcccaggcuggagugcaauggcgccaucuuggcucacugcaaccuccgccucccagguucacgccguucuccugccucagccucccgaguagcugggacuacagguguccaccaccacacccggcuaauuuuuauauuuuuaguaaagacgggguuucaccauguuggucaggcuggucucaaacuccugaccucaggugauccagcugccucgguuucccagagcacuggugggauuauaggcaugagccaggggacuugaccagaucacuaauuuuuuauacuggaaaauacaggauuuuuuuuuuuuuaaagaaugugcugcuuauaugcaaugggcuuauuauuccuguuguuaauuggaauugguauacagacauuuuccaauccuucagguuucaacuggcaaaugccagcagacauacccacagagccagagcuccucaggcuccuccacguccaacggcgucucacaguccugaggaugaggaccugggugaggggagcacgggagacacagccaucaaggcauccaccuccaggacagacaccagccaagaacccccucagggcaaggccucucacaaguccaacuccacggauuccaccguaagugcugucaacuggaugcgcauuuacaaaaucugaguuuucucaaagaagcugaagcuuuccguguccucagugauucuggacucccagcgccguaccacucccugccagccacacagggggacccacaggaagcaggccuuccccguggcgggccuugcugcuauccgcgcuccuuucugugcagucgucccugacggggaaggguugagcccagccaaguggaucccuggcugcaggacaaaggugugcauggcaaggggcccaccugccucaggcugaggcauaaacuuucccuuuucacucaggaaggguaagacacaguucccaguuuuacagugugcuuuuguggaugcugacccgguacugcucuuggaaugucaagaugaagaugaugcagaagccucuccucugagcaucuucugauugacaggcaagggacuggaguggagcccuuggcagcaggcgguggccagggacaagcggcccgugccacgucucccagcuagcucaccaccagcacacaaaccuucguccugggcaugggacucuccaucccuggucaaagcaggugccucggguggcaacacaggacccucagacacugaucuccuguuguugaaucggugcaauauucacccaccaaaaacaaccacaaagcgccugucaccagugacaauguagcacugucuaugugaauaaaauuaaauuguguuuggagaaucuggugacgcugugaaacagcugaagauuaccuguaaccucagcgcucugggaggcugacaagagggacacugugaaacagcugaagacuaccugugaccucagcacucugggaggcugacaugagggacacugugaaacagcugaagauuaccugugaccucagcacucugggaggcugacaugagggacacugugaaacaggugaagauuaccugugaccucagcacucugggaggcugacaugagggacacugugaaacagcugaagacuaccugugaccucagcacucuaggaggcugacaugagggacgcugugaaacagaugaagauuaccugugaucucagcacucugggaggcugacaagagggacacugugaaacagcugaagauuaccuguaaccucagcacucuggaaggcugacaugaggacugcuugagcccaggagugugagaccagccugggcaacacagggagaccccaucucuuaaaaaaaauuuuuuuuuaacaaaacaauaaaaaaacaaaaauagcuggguguguuggcaccugccugugguuucagauacucagggggcugaggcaggaggaagguuugagcccgggagguugaggcugcagugagcuauaugacugugccacugcacuccagccucagugacagagagagauuguguguccaaaaaaaaaaaucccaauacacuguuagugucucaagcccagguuagaaauuacucgucuagucucugacagaaaaaucaggugggcuaagcaaaggugcuuucuggcccaggaguacagaugcaguggcaggcacauggcucagcuggcugugcacagccacccaggauccuggggcagucucuggacaaggccucaaagaccccagacagacucccaucaucccucucucccaucagcaucaucaguuuuuuaaaauuguuaacaagcuccaugcucugugagacgcaguuuccaagcaaggcauuuucaguguugccucaacagaaacugcaucaucccugaacacugaccuccugucacagcccagguggcuccgaacacggagcaggagcaugaugacacagcacgaguccacgcaaggacaccuccucaucaagacaagucagaggcagaaccgaguucaggggccaguggcuggcuuuguuuauucuucauuuauccguaagagaagcccagagagacaacuacaagugacccaagacacucauaggugaguggauuaaacacccggcguccauccagacaacagaauauuaccaggcccugaaaagacaaaaaaggaccauagacgcaugcugcugagugaaagcagcccgucuccaaggacuacacgcuguacgguuccgacucugacauccaggaaagggcaaaaccgugcagacagcacaaagaucagcgaaugccaggggcuggggagagggagggacggagggaugugcagcaggaacacgggggaccuggggcagugaaacuacucuguaugauaccacaacgguggguccacaucaggauacguucauccaaccauagacugcacagcacccgguggacccugaggucgugcggccugugggugaugaugacacugucuccagggcggucgcgacuauaacaaauggccgcucuuguggggaugcugagcccaggggugcgggggaacccucuguaauuuauguucuauuuugcugugaaccuaaagcuaauauaaaaaauaaagucuacuuuuuuuaaagugaccauccugucagaaagacaaaauggucccagagcacagggcuuggauucacacagcacagaaucggcucccagagcacaggaagguccagugcaccaggaccaagaagcagaguaagccgagugacacaagagagggcagccucugccccaggcuuccugcgcugggggccggucaucugcugccccaggcuucccugcgcuggaggccggucaucugcugccccaggcuucccugcgcugggggccggucaucugcugccccaggcuucccugcgcugggggacggucaucugcugccccaggcuucccugcgcugggggacggucaucugcugccccaggcuucccugcgcugggggacggucaucugcugccccaggcuucccugcgcugggggacggucaucugcugccccaggcuucccugcgcugggggacggucaucugcugccccaggcuucccugcgcugggggacggucaucugcugccccaggcuucccugcgcugggggacggucaucugcugccccaggcuucccugcgcugggggacggucaucugcugccccaggcuucccugcgcugggggacggucaucugcugccccaggcuucccugcgcugggggacggucaucugcugccccaggcuucccugcgcugggggccggucaucugcugccccaggcuucccugcgcugggggauggucaucugcugccccaggcuucccugcgcugggggccggucaucugcugccccaggcuucccugcgcugggggccggucaucugcugccccaggcuucccugcgcugggggauggucaucugcugccccaggcuucccugcgcugggggccggucaucugcugccccaggcuucccugcgcugggggccggucaucugcugccccaggcuucccugcgcugggggauggucaucugcugccccaggcuucccugcgcugggggccggucaucugcugccccaggcuucccugcgcuggaggcuggucaucugacgggaaccccugcagccaccuggaccagcugcacacaccuuggacgccugucgcccuccacccucugcagacacccucucacaggcuccacccugcucggguucacagacacaucccccgucugccccggggcugccuggcauggcacccaagaccaagauggaaagggaggccccgcguguggguggacaaauccacaacacgcuggcccucaaguugucucaguaauguuauauauuucucucucccccccacccgcccucccccuccccagagggagucuuguucugcugcucaggcuggagugcaauggugugaucucgacucauugcaaccucugccucccaaguucaagcaauucuccugccucagccuuccaagacggccgccaccacgcccggcuaacauuuggauuuuuaguagagaccggguuucgccauguuagccaggcuggucucgaacuccugaccucgugauccacccaccuuggccucccaaagugcugggauuacagcacgagccacugcgucuggcauuaaauuucucucuugauuaugcagccacuaaauaucacgcugggauaaugggaaauuaaugcuaagcuuuaaaaugcagaaugugaagccuuauauccagaguaauccuuauuuuguaaaaaguacaugauauauucaacauuuuagauuuacauguuuuaucuuggguggaaggauuacaggcgauuuuuacuuucuucucuaugcuuuauuuacugguguuaugaguugaaaugugucccccaagaaugguauguugaaguccuagccccccaacaccacagacgauggccuuccugggaaacauggucuuugcagaugauccaggugagaucgcuagggugggcccucaccccacagaacuagcuuccuucuacaaagggcagacguggacacugagcugugcacgcagggagaacgcugggugaagagggaggcggagaucguggugaugcgucuacaagcccgggcgcaccagagacucccccaucccccagaacccgccgggcacaccagagacucccccaucccccagaaccuggagagaggccuggagcagaugcccgcccccaccccuccagcaccgcagaaggaaccggcccugcagacagcuuggucucagagccgugggagaacagauccuugcugugaaagcuccuggucuguggugauuuaucacggcagccccgaaagacccccacaccaaguuucacucucuguccauggaccucuuuaauggaaauccugacuuuuccauaaggcacugaaucuguguaacuuuuagaguaaggaggacgaccuacaguucacugcaugaaagcacagcccuuccaacaaaggcaggcgaaauguggaaccaauuauaucugggugccuacacgugacguacgccaguucuuuguagaaagaacgaggcuugucucagcgauacuaauguacaguucacaugaacuccuaaccuuagccagccacaauaagguaucugggauugagcgcuuauuuaaaucgguaggcacaucaauuuaaauuuagguaguagcucagccuguaccuaacacaugaggaagccgaggcgggaagaucgguugacuccaagaguucaagagcauccugggaaugacagggagaccccgccucuagaaaaacauuuaaaaauugcugcguauggugccgcacaccagcagagucccagcuacucgggaggcugaggugggaggauugguugagccugggaguucaagccuugagugagcuguggguggggggggcagcacugcagggugaggugaagggggugguucugcgggaggaggugagguggcucugcgagguuaggagagggggcaggggcucuguggggugagauaggggguaucugcagggugaggugaggggacagcucugugggaugaggugagguggggguucugcggaaugagguugggggggcggcacugcgggaggaggugggcgggguggggccugcagacccuccaggcucucccgggggaaggagccccaucagggccagcacugcgccacucccaacaaagcaggcaaccuagccugccaguggagaccucuuuuccgccugggcuccagcucuagagcaaggccagucaccucagccccaccaucaaacaccaggcuccacaugggcacugccucgcucaacugcgugguggcggguggccuggaacgcugcugucaucacugcacguggacacaucaucaaccucucagcgugacgugcccucgugcuuucagguaaaacacuacagagaaacuuccuguuggcagguggaccccgcacucccuagggccugauccgcucccucucuucugcuuuacgggcacugacaggaaguaucugaugcgcacucacucacaccagccacgcacauguugugagcaauccuguguggccugcuccccccuccugaccggccccuccugacuggccccagcaccgcguggaagaacauggaggagcucaucugucugaggauaggaagcagcagagcacacgcaggugagggcagagcggggaacccaagucccgaggaaguuucucaguaagcgaggccccgcgcucugggagggcacccccaggaagcccacacauaaagcaacuggacacacgcucaacuacgacugggcaaugacaguagcuuaaaaaaaaaaaguacaccaccaaacagacaaagaccagagaccacuuacauaaaagcccugcugccuccccgggaagggauuucaaaacacuucuuuaggugagcacgacagcacgugccuuuaaucacagcuacucaagaggcugaggcaggaagaugacuugaggccauaaguuugaggccaaucugggcaacagagcaagcccaccucuaaaaaaguaaaaauaaaaaaauuaggcggguguggugacaugcgucuggagucccagcuacucggaaggcugaggaaggggcaucauuucaguccaagaguugaggcugcaguaagccaugacugcacuccagccuggucaacaaagcaagacuugucucuuaaaaaagcaaaacaacaacacaucuuuauauuauagggcacagaaaggagcaagauuauaaaacuaaaauagggugaaagaaugcaagagacucagaacuauggcaaacuuauaacuaaaauuccaaacuacaggaaacucucagagcaaacgcugcaucacauaagcugcuagcccggcacaugauugugaagaaucaggaguccucucagcaccaacagacagucauggacacagcccacagguggcucgacccaccagccucaggcagcaugggguugagaggggaagcccaguuuggccgacuguagaacccuguucuagucuccuauccacccucaccaaggcacuaaaucaccagcaaagacucugagaacaucaacaucuguguaacuaaggaaaauggaagugcaggaaggaauacauuuuuguaaucaaagggcaugaaaaaaauugccuucacugaaaacacugaaaagguacaacccuauuaugucuccugcuaggaaaaauuuuccucugcuuuuaaaggauuaauagccacaaaauauuauuuuguuauucugguguccuccagaaaaugagccaacaguuugaaggguaugggguaaagagaagagaaggaaaagcugcuuuugaaaacacuguugacucgcaaaguuaccagcacucuaucaggcuaaugccuaggucaggagaagacagacgcagucacuacuauggauccugagggcgagaaacucuggaugccacaaaguggcauguucaaccuuccuacaagcacacagaggugaagccuggagaacaggcagggacaggcccagcuggccaugugcucagccacgccuaccucgcaaggucauucugaggaugaaggcaucauggauccaaaugccaccuugacgcugaauguacuacacaauaaaagaaccacuguaaaucacacuauugacucuugcuugguugauguucuuuccuuuacaguaaagugaacucguggacaaacaucguguccacagaccaccauaaauguaguuuguuguuuuaaauaaaacugaaaucagacuuccaaaaagaaacaucuaaaaacuucuccucucccaucccaccagagccauggcccacaacacagcccgacgccccgucacacgcucucacaggacaacugcccacaccaguuaaccuggugucacgguggaggcgagguugcggugaguggagaucacgccauugcacuccagccugggcgacagagcaagacuccaucucaaaaaaauaaauaaauaaaaaaucuuguggaaggagguaccacauaugcggucuguuguggaacaaaaugccguuacguggggcaugacuguauucuguagggcacauuugcaaaacagcuccucuagucacauagguaacuguuuuugagacaaguucuggcucugucacgcaggcuagagugcaguggugugauaugagcucaccguagccucgaccuccugggcucaggcgauccucccaccucggcuuccccaacuagcugugacuacaggcacgugccaccacaccuggcucauuuuuuuuuuuuuuuuuuuuugguagagacaggguucucacuauguuguccgggcuggucucgaacuccuggguugcagcaauccucccgccucagccucccaaagugcugggauuacaggccugagccgccaugcccggcuuucuagguaacuuuccuaucagccuuccugacugcugcagauaaggcauguucucacagggacaauucaggaaaugcaccaaagcguccucaaggccuguccacgaagcuccuccuuccagccagacccuggggcuuaggggucaaauuccucacaccuucccccagcgcuccucacaaaggaugcacugcagucaaucccaacuuagcuccagcaagaauaaucccagcacuuugggagccaacgccggcagaucaccugaggacaggaguucgagagcagucuggccaacaugguaaagccccgucucuacuaaaaagacaaaaacuuaccgggcgugguggcacacaccugcaaucucggcuacucaggaggcugaggugggagaaucaccugaaccccgaaggcagaggcugcagugaaccaagaucgcauaacugcacuccagccugggugacaaagggagauuccaucucaaaaaaaaaaaaaaaaaaaaccuucagccagaaaaucaccaaaguccuaagucugguuaugcccuuuguuuucuauuucuuaauaauaaaaacacagcaagggguuuggugcugugagcaaggggcucucugagagucggcacccacacgugcuggucuccaggacagacaugucucaggccaacggcacugacagaagcacagacccucacugccaggucacggcgggcacgggaaacccacaccugggccucggccacacuccugagggcgacaaaacaccagccggcgcgcucugagacuugcggucaguccuagaggagaagcagcagcugcugagaaggccgcacgggcaaaggagccaccgugcaccgugacaagacaacauguucguuggccaugcccggugucagcacgcagacacacaggcaccagaggcugcagcgaggaagacagaugugcuuccccagugcuuauggucuggguggggacagaaaagagacaaggaaggcccagggcaggacaucagacacaggguuuuaguuaaccaggacugugaugccggcaucugccuggaggaaggaaggacagacuucugaagaagauggaccucagugccuccuucacgcugauaagcgaucccaccaagcaugacccacagcacaggacaaagccuuguguccaggacagggugcccuccgggaggcagcagaaaggacagcuguggaauauggaaggggaaaaggaaaagggaacaggagacaaaucagcaacauuaagaacaucaggccggacgugguggcucacgcccauaaucccagcacuuugggaggccaggggaagggggagcagaucacuugaggucaggaguuugagaccagccuggacaauauggugaaacccugucucuacuaaaaacacaaaaaauuagccggacaugguggcaggcaucuguaaccccagguacucgggaggcugaggcuggugaagcccagguacucgggaggcggaggaggcggugaguugagacgugccacugcacuccagccugggcaacaagagcgaaaccccgucucaaaaagauaaaaaaaaaagaacacgcagacagaaaagaaugaccuaagaaggcacacgaggaacaucagcaaaggacugacagaaaaagacucauauuuuuauauaaggaacacggggggaaaaagaaaaaaaaauuaaaaggaaaagaugaauagaugauauggccagagguuuaaagaaagagacaacgagauaaaagcaggaagccccagcaacacugggcugccuccccaggcccuucccagcauuuccugccagcagggccccugccccaagccaaaaaggaaccacguucgccucgucagggcuguugcacgacagccgcacacaccuaagaaacaaacuccuucugggccgcgcaacauggcucacaccugcaauccaagcacuuugggaggccgaggcagguggauugcuugaguucaggaguucaagaccagccugaguaacacggcgagacgccgucucuaucaaacacacauacacacacacacacacauagacacacacagaauuagccaggcauuguggugugccccugcagucccagcuacuugagaggcugaagcaggaggaucgcuugagcccaggaggcagaggcugcaaugagccgugauccggccacugcacucccaccugagugagagucagauccugucucccuccaaaaaaaaaaaaaaaaaaaaagaagaagaagaaauauuaacuccuuuguccacauaguaaaacucagucuuccauuaacuucaaaaagccaaacugauaaguuuuuaaguaaagaacaaacacaucuauagcgaaguguggaaaaucacuguggucacuccccagcuacagcugccaugcagugguagugccccugcccucaagcuggucccagacucaaacaggaagccacugcacaugugugaccacuggccaggcaaagagaggccaagacagcucgaaggacuugcgcauggccccagaaggcugcacuauguggcaagcacuggaugcauacagauacucggccaagaaacucccugagagagcucacaccagcgcuguucccucagaagcccaguucuccacccuagagaaguggcagcccuuccacauucacuuuagccuugggcuaccacagacauggugaccaggacaaagaggcgugaagcuggcaaaaccaccagguuugaugcacagaaaggccagcaucagcacccaguugccugggcagaggaggaagaggauggcagguacacaggccguuagaaacggccucacccugacccugagcgugguggcaaguggccgacccagauucccucacccugcucuggcacaccgcaggccagcugcaucuggcaggaguguaacagccagugcccaggcugacgagcgugagcacugccccacacacacucagacccucaggaagagcaugaaagacgucccagccgugcccacagcuacagcagccccuccucgcacccccugccacccucccuagaguccagcgcuaauacaaccaccucuggccucagaguccccgggacucacucacucacuucacugaucagccguggaauccugaauucaaacccuacuuccuaaacaucuuuugaggccuacauuccucuuguaauaaaaauaaggaaaaugcaauuuucugggauuuuguaggaaaaaaagagaacauaagugaagauaucuagcagagcaugugccucucacagaccuuaggaguuacugggaaauacaagugaacaggccgcuguggagugcgguuucuaaaaguaggaggaauacagaaaaggcggccccaacccugccucugggagcaaaaccaaaaagagccacagccacagcagagaauucagaaaagccaccugcacaaaaggccagagcagccaagggaagcugggggcccaggccagugagcccuggggccagguaucaggccccucaaagagcagaaaacagauuuuuuaggugaagccgacggucugaggaaaugagaugagcucacacaccugaugacagcuucccucagcaauuccacccgccuccacaggacucagaccaaguccugguguuagaauaaaucacuaggcuacaagaaagcucaaacccccacagguucuagcacuccuagccaccaacacaacucuguucaagauccaccuaucaacagggguggggugggaaggcgguccccauccucaggccauucuuccuccguggguugcagccaggguuuccugugggucgucuugugcacgucacggcccugcccacagcauaaaaacauacaggugugagggagaugagcaagacagcuagcuuuucacaagagcaggaaaggcugggugcugcgacucacgccuguaaucacacagcguugggaggcagaggaggaaggacugcuuaaggccaggaguuccaggccagucugagcaacauagcaagauccuguuguaccaaaacacacacacacacgaaaacugguugucguguuacuaaaaguuuccauuacaacacugaaguuuagaauacaguauuacuaggccaaaauauccuggcauuuuauaggauuucuuuaacaaaaucugaucacaucuaaacuggcaucuuucugcucacuucucaauuucaaucuaaauuuauuuauuuauuuauuuauuuuuugagaugggagucucgcucugucgcccaggcuggaguguaguggcacaaucucaacucacugcaagcuccgccucccggguucacgccauucuccugccucagccuccugaguagcugggacuacaggcgcccgccaccacgcccggcuaauuuuuuguauuuuuaguagagacggguuuucacggugugagccaggauggucucgaucuccugaccucgugauccgcccgccucggccucccaaagugcugggauuacaggcgugagccaccgcguccagccucaaucuaaauuuaaaacacaguuugcuguucagcuacagggcagaauuucacacggagcaggcaccucacagaugccaacccgguggguacggcccuuugagugucaccuaaagccucauaacaucaucaccaagcccauccccaaaagcuguaguuaguaagccaccaggauuugauauuuagaaacuuuucccacuaacaaaaaacaagcaagaauaaauuuuaaacaaaggcugacuguaccaaggaaauggagauaauaaacagaaaaagacucauggacacugguguugggagugauggucuuagcccucagaccagacuaagacacccugcagagcugaggcugucaggaaccacgcagagccacggaagggaaacaccugcccccgggcuacaaaggccacccucugcccucugcuuacugcucugguucugcccuccagacacaagcaggucccuaaagcaguugcuauccugcugacgugcugacaccaucagauaugaacaagaaucccaguuuuauuuuuccuaauaaauaaaucauccauuuagcaaaacgucaacgauaccaaaagcuaugaaagcauccuuggauuuacaaagaacccucgcuucucauuucccuuauuuucccaugcccaggcagagagcccucuaagcccaugggaagcuuaacagaaggggguggggaguggccaacuguggccagggcaagacagaaaccacaugugcgugaacacguguucuacacagagccuuauguacugggccacagaauaagcagagcugggcagcuccugcugccaaagucaacauguucaggcugcccggccuccacaggcgcuuuccugaaagcugccugcagagagaaggguggccagggcaggaggcaggauccugaagcugccugcagagggaggggcggccagugcaggaggcagguuccugaagcugccugcagagagaaggguggccagggcagaaggcagcagcacaggggcucgggcccacgcuggcuguccacacccagggccacgccuccaugacggugcccuccaccacauccccucucgugugugcuggugccaccacgggggcccagggaccuuuuugcucuacuucucuuucaaacuugcagcccugugccagcagccagcacugccuucagaaucccugcacacagcggugggaaaccuugacugcaccggaagaggagcaggcugcccuggcugggccagacgcuacacaucuugcugucgagauggucuacauuucuuccuuuuuucuuuuucuuguaauccuucugucaccuagagcuggagugcaguggugugaucauagcucacuacaaccucugccucccgagcucaagagauccuccuaccucaaccuccugaguaaccaugacgacaggcacacacaaccacgccuggcuaauuuuuguauuuuuuggagagauggggucuugccacguugcccaggcuggucucgaacuccugaccucaggcaauccucccaccucagccucccagagugcugggauuacggccaguuuacauucggaacccaccacuauccccuuguugacaguaagcacaucccaaaucauuuuucccaauggacaacacaaauaaauaauuaagauccuuauucuagaguggggaaaaaaagagacuagaauucucagcagaacuugaggaauccaauggccaguaacgaagaugccucccagagucuccuggccauguuccaucccuccccucagccagguacuggggugagaugccucccagagucuccuggccgugccccaucccuccccucagccagguacugggcugagaugccucccagagucuccuggccgugccccaucccuccccucagccagguacugggcugagaugucucccagagucuccuggccgugccccaucccuccccucagccagcuacugggcugagaugccucccagagucuccuggccgugccccaucccuccccucagccagguacugggcugagaugccucccagagucuccuggccgugccccaucccuccccucagccagguacugggcugagaugccucccagagucuccuggccgugccccaucccuccccucagccagguacugggcugagaugccucccagagucuccuggccgugccccaucccuccccucagccagguacugggcugagaugccucccagagucuccuggccgugccccaucccuccccucagccagguacuggggugcucaggccacaccggacccuccaucuccuuccuccuaccuuccucuucuucucaacaaaaucuaagcaaguuguaaaugggccuucugguggcaaugauguauuaagacacgcagagcccuuaccccauuugcuacaggaacccaauuacaucugggaagaaacaagcaggacaggaaaaagguacauugguguuuuugcauccauaaaguucacuucaauuuaaauagaacuuacugaguacucuuuugcuagauccaggcaaaauguuuuucacccucagauacaaaaacauagaggaaaaaauucccuuaagccagcuguaaaaaaugaugguauuaaaaaaauaaaacacuggccccaugagaaucacuguaguuaacaaaagaaauacaguaaccgcaauauuauaaccuacaaacaaaaagccauucucagucccccagcaggaccucuccaugccucccaggucagcagaggacagaggacagcagaggucacaggucagcagaggucccagcacucagagccggauuccagcuaaaagcacacaugagggaaaacagcugacagccagagcucccaauggggagcuccaauguuccaaacccucccccaggcccugggacucucugcccaucaaccagagccuggagggggagggaguaggagggggcgccgcucagccacaagugcccauuuucacaugaacaggucuaacuuaaaugacacagcaucuucuauaaguuacugcaguuuaaagaugccuagccacagauaauuccucagaacucuaaaauaaaaacugauucuacuaaacaauggaguuauuuaucuuggcauaauuacuacgcauauuuuuuugauaauaauggaaguaugguguuaccuguuucuaaaucuuaacaaaaacuuauguugaaaauggaaguggacugggcgcaguggcucacgccuguaaucccagcacuuugggaggcugaggugggcagaucacgaggucaggagaccgacaccauccuagcuaacacgaggaaaccccgucucuacuaaagauacaaaaaauuagccgggcgugguggcgggcaccuauagucccagcuacuugggaggcugaggcaggagaauggcgugaacccgggaggcggagcuugcagugagccgaggucgcaccacugcacuccagccugggcgacagccagacugucucaaaaaaagaaaaaaauaaaggaaauggaagugaacucacaguggcaccuacaaaucccuuacagaccugcaaaccuaguccuguggcugucagcagccgccaggaaccccuggagcauucuacggcaggacacagaaacagccgacaagcuccccaggggugagggugccagggagacucugcacucccacaacgcccuaggaugcagaggggccugcccagaaagagccucucucugcuuucaaggccagacuggggggaggcaggagggugguaccaaaaacagcagcccuuccccuccccaccuccaaccuggccacccagacagggaccccagcacagcaacagcaagcggagggggcucggcucuggcugagcugacuuccagcccagccaccaccacgggccugcacacccuccgccacgggccugcacacccuccaggaugccacaggcacagcugcucggacugcgcacucggggacacugaggcgcacgaucgcaccugccuuacaaguucaacauuucagcaagacagaaccugauuacuuuuccaucuuaaauggagaugucaauuaaaaauguaaaacauuaaguccaagccucuuuucauaugaacaacacugccuuuguuaucauuaacaaaccacuuucaaaacccccaauuuuugggaaagguaauuugaaagucccauuucacagcaagcacaaauggaacacccacauguugcaagggucagcaguccgcugucacucacggccacacucacugggaaccgcgugcuggggucaucgggggucacgcagccgcaccgccugagaggacuaacccuucuguuuugccaagaaagaugucagcuucaacuacuuuuauacuggagaaacaauuuacaaacuaaaauuguuuuaaagccucuauuuucaugcaguuuuguuucuguaaaguguuauuuaaucuccaaggaagucuuuacaguagauacgaccgugaccacuguccuggguaggagacugaggcucggagaguggaagggaggggccagggccacagagcuagcaccagucagcccaucacacaaggcugucggggacccuaugucacugcggccacaccuggcccaaccucagggcaggaccagccuagaauccauccaagcugggcaccuaagucacgcccagaugggagagaagagcacagcaccguguacugaagaagcgacuguggaucucaucucaacggcucacauuccaccccaaggaaucaaagugaaacacgggaaugacacaaauaccaacaugaaaaauaucagagcaccuguaacauucuuauucuucuuuauuugggacagggucucacccugcggcccaggcuggagugcaguggugugaucauagcucacugcagccucaaccuccugggcucaagugauccuuccuccccgcucagccuccccaaguagcugagaccacaggcgcaugcaugccaccaugccuggcucauuuuuuuauuuuuuguagagaugcggucucgucauguuacucaggcuggucucgcacuccugagcucaagugaucuacccaccccuuccucccaaagugcugggauuacaggugggagccacugcaccuggccagcuauucuuuuuuuuuuuuuuuuuuuuugagauggagucucccucugucgcccaggcuggagcgcaguggugcgaucucgguuuacugcaagcuccgccucccagguucacgccauucuccugccucagccucccgaguagcugggacuacaggcgccugccaccaugcccggcuaauuuuuuguauuuuuaguagagacgggguuucaccguguuagccaggauggucuugaucuccugaccucaugauccacccgccucggccucccaaagugcugggauuacaggugugagccacugcgcccggcaagcuauucuuuuuuuaaacccugcauuuuaaugccagauaaaacaauggagaacaggcauucaagaccagccuggccaacacagugaaacccuaucucuacuaaaaacacaaaaaucagcuggguguggugguggguaccuguaaucccagcuaguugggaggcugaggcaggagaaacucuugaaucugggagguggagguugcagugagccgagauugcaccacuacacuccaggcccugcacaacaaagcuagacucugucucaaaaaaaaaaaaaaaaaaaaacaauggagaaccagccucagugagguccucaggaggcccucacaugcccaugugggucacggcgccucuggucacacugcgcccaaccucugcucagcagggccucucuguagcaacacugcagucucccugaugggaggccacaacagaccucaugcuaagggccuuccucguauucaaucuaaccaccacaggcaaacaaaagacaaaaucaauacugaggaucuauaguucacaaaagugacaaauggcauuaaacaccuuagauuauuacuguggcauggucaaaaaugccaacauuuccuaugucaucaaaccuaaguaucaguacaucuauuguucucaauccacuagagugcuagacauuuaggccaauuccagguccugucagcagaguugcugauagcuugcuccccuuuaaucagagaagccuguauuuugaauccaucgauuuuuuuuuuuccccagagacagagucuugcucugucgcccaggcucaagugcgguguugugaucuuggcucacugaaaccuccgccucccaguucaagcaacgcuccugccucagccucccaacuagcugggaucacaggcauucgccaccacguccgguuaauauuuacauuuuuaauagagaugggguuucaccauguuggcaggcuggucuggaacuccuggccucaagugauccacccaccuugacaucucaaagugcugggauuacaggcgugagccacugugccuggccacuaauugcugauuaauaauuuuauuuuucacacuaguaagcagcauuuuggccaggugugguggcucacaccuguaaucccagcacuuugggaggcugaggcaggaggauugcuugagagcagggguucaagacaggccuggacaacguaacaagacucuguuucuacaaaaaaaaaaaaaaaauuaaaaaaagaaaaugcagcauuuugcuuuuccuugucauacauuaaggucagcaguauccuuuucacaaagaggcacagcucagacccugggguguggggugcucccucaucgcugccccccuuuucccauguaccuggccccuccauggcaccccuuuuaucacaaccaggcucaguccaccuccagaucuugaaaaaugucucaccugaucacaaacaugcccacuacccaggcuggcuucauucuaacuacaaaccaucccacagauuaagagaagacaauucuagaccuauuuucaaggauaucucagauucccuuuccuucaaaccucaccucuauuuccaaggaaagaauucagucauaugaaagaaagcagucagguguauuuuaaaguggccugacuccaggcgacugagauaaggaacagauacaccaaacuaugaagcucccgaaagaagcugcaggaaagguucuuucacguuugcugggaguaacaacacaaaacagauuauguauuuuuggaauguucacuuuaaaaccaugacucacaccuggccaaaauaugaaaauuuaauuuagccaaguuuucucuucaacugcugucaauccacauaucagagaaaauaaccugccaguucaccaugcgucucuggaaggagggaggacucugcccuacagcgacacgugcuugcucagagccaaggccaaagucuuuuuggagacugcugccgcuccucucaaaaaacaugccagugacucccaggaggaggcaaggagucagggcuggcgaaccaggcucccacuccuuaccugccaaccauacacacuggucuccagcuccuaggaaaagccagaauagccaucuagaggguucagcaacagcacuaugcccagaagcacaggacagcccggcgagaccaccaggaaccuaacaagagcacaacagcucccaggauacagaauccucauccaaggacaacccagcaagaccaccaggauccuaacgagcagaacagcucccaggauacagaauccucauccaaggacaaccaggcaagaccaccaggauccuaacgagcagaacagcucccaggauacagaauccucacgcaaacuguuaacacaacaugcucagagcacacaacacacagcacagggugggggucucagucaucaccagaccaucugaggaugaagaaaauuaaaggaggacaagaggaaauaaacuucuuuuauaggcuauuaacaaccuauuuaauuuuucagcagauuucuucucacugugacaccaaggaucccauucauuaauccaaaaaugcuuaccuguuaccacucugaauacacucuaagugaaauccagaacaaaauucacaacauuucgacaaaacucuaucaaguccaagaaaaccaaccuggacacucacgcauuauuuugauacuuauuuuuacaaaucaaugacaaaaacauaaauugauagagaaugcagugaguauuuaccgauuccauagcugaaagucagugcugacgaggacugucuuuuaaauccaauggaggugugucccagagcagggcuguauauauucugaaacaagagagugagauuagcucaugucaauaauaauuucagccucaguucuuucaucgcucucgucucccuccauuugguccacacgguuuauuccaucgcccuuccucucccaugacccacugcucagcuccuggucacugugccaaggccaaaacuuaacuucauucaucaaauaccuuuacgucacaaugcagcaauugcaacaacuuaaagguaaauccaaaguccagcacaaaaaagaguagaugacacugauacaaucuugugaaaucaccauaaaaccagauuuuagaggcucuggggcuuuuuauacguaagaaaccaaauaacccaagugggcaaucucgccacagaaacaaaacauuaccaguaagcuaaguuuuuaaaaggccuuuuuuuuuuuuuuggagacagaguuucacucuugucccccaggcuggagugcaguggcgugaucucagcucacugcaaccuccaccuccccuccuggguucaagcgauucuccuaccucagccucccgaguagaugggauuacaggcgcucgccacccacccccggcugaucuggaccuccugaccucagguguuccaaucaccucggccuuccaaaguguuaggauuacaggcgucagccaccaugcccagccuuaaaaggcuaauuuuaacuuuaagaagcauauuaaguuuuaaacuacauaaaaggugcaaaaaaagauaaggugguuuucauuuccacugaguauuuuaagaggaaaagauuauacugcaguaccauuuuuuuaaaaagcugaauaaagccaugcaugguggcucacgccuguaaucccagcacuuugggaggccgaggugggcggaucacuugaggucaugaguucaagaccagccuggccaacagggcaaaaccccgucucuacugaaaauacaaaaaauuaaccaggugugguggcuuguaccuguaaccccaacuacuugggaggcuggggcaggugaaucacuugaaucugcgaggcaaagguugcagugagcugagacugcaccacugcacuccagccugggugacagagcgaaacucgucuuaaaaaaaaaaaaaaaaggcagcugaauaaaacuauauaauuucccugaagagcucuggggacuccaagaauaaaacaaaccagucuaaaugggggaaaaaaaaucuauacccauguuacuucagucccauccaaacaucaggcucuccuccaacuccaaacacuuccgugugcagaaccagggaaggaagcacagacaggauugaaggcagcucccaggacagggcuugcuggugcaggguuccccggcucugcacuuagcauccgagagaaucgcguguuuccugagcaacacuccuggcacaugcguuuugcaaagauggagugagguuuuuccuccuuacacuccuggaagauggagugagguuuuuccuccuuacacuccuggacaggauuguucaaagcugccauuaaccucaaggaccauuaaaaauaagugugugaugggugcgcuggcucacgccuguaaucccagcacuucaggaggcugaggcaggcggauugcuugagcccagaaguuggagaccagccugggcaacacggcgaguccccaucucuacaaaaaauucaaaaaauuagcugggcaugguggcgugcgccuguagccggagcuacucacaccacugcacagcagccucaauccaucaaucaauaaaaauaaaugugaauacgcagcuucuagucaccacacagccugguuucagugaaaagcagcaagugugccacgaagcuuuccguaaaagagcucagagaggggaagagcaucagcagcaggaagccagcgaggaaccccagcaucgaccuccagaguccugagagcacucaaagcaucaugaguccaacgauuugcaagcucacugccacuggcauuuggguucagcgcgccaacaggguugagcagcgucggucuucuagaugccaguaaggccacccagcaaauccuggcaaccaaaaaugucuccagacgauguccgcuaaagggcaaaacacgccggugagaacugcugcuuuaaugcagcugcuguuucccauguaugaagaaacugggcccaaaucaggugaaagugaaaaacaucaguuaaaagugaaacaaaacucaguuuucuguugucuuagggucccacaggguauggaaagcaaguugggaagagaaaauucuggucugaaggucuuuucuuucugacugacagacaaucucaguaacugaucccauuaucucuggaagacaguaccaauccagagccucuaaaauauuuggaauaaacauuacagauuuuucuuaagagacagggucucacuguguugccaaggcugggaauggaguggugcaaacacagcucacugcggccucaaccuccugggcccaagggguccucccaccucagccucccaaguaaagacauuuucuaaggugugaaaaaaagcuucauuuagaauacauguucacaucaaaaccaccaccacgacuauaaacaagcuauguugucaaacagaaaagcaccaggcuacacuucuuacugucagcuccugccuacagcaacucaggaaucaacaggccuguggaggcugagugcagacagagaccauggagacaugaagggucagugugugaugacggagucagggagucagggaugggaccaucacccauccaugucuggggguggggcugagacacgaagggucagugugugaugacggagucagggaugggaccaucacccguccaugucugggggugggggugagacacgaagggucggugugugaugacggagucagggaugggaccaucacccguccaugucugggggugggggugagacacgaagggucggugugugaugacggagucagggaugggaccaucacccguccaugucugggggugggggugagacacgaagggucggugugugaugacggagucagggaugggaccaucacccguccaugucugggggcgggggugagacacgaagggucggugugugaugacggagucagggaugggaccaucacccguccaugucuggggguggggcugagacacgaagggucgguguguggugacggagucagggaugggaccaucacccguccaugucugggggcgggggugagacacgaagggucggugugugaugacggagucagggaugggaccaucacccguccaugucugggggcgggggugagacacgaagggucggugugugaugacggagucagggaugggaccaucacccguccacgucugggggugggggugagacacgaagggucggugugugaugacggagucagggaugggaccaucacccguccaugucugggggugggggugagacacgaagggucagugugugaugacaggaccacugcccauccaugucuuggggcagggguggggguaaccaaaaccagaauccaguuaaaacaacagggaguugcuucuaccuauggaaauggcaacaggacaagaugauaacccaggugcuaaggagucggcuacacgcauucuguguuaggaaacccaggagguacuaauggcggcucucucugaaugguggagcaaugugagguuuuaaaugcucuuaccacucuggacuccuuacucucaucaaccccuuuaaguggguuauuugccacguuagggauagggaaagaaaauuauuuaauacaaucaacggguaaaaaguuaaaguuaccuaagaagaaagagcucuaggccaaaccuauaaucccagaacuuuaagaggccgaggugggaggaucacuuccgcacagaagcucaaggcugcagucaguuaggguggcaccacugcacuccaccugggcgagcgacugagacccuaagaauauccaaaccauuaaaagaauuuuuuuacagaauuuuucuuuuaaaaaaagcaauuuuaaaaaaaaggaucuuggauguuaucaccaaaaagaagugguauuugaggggauggacacaguaaccacccuggucucaucgguaaacaaggcauccacggacugaggcauccuaccggacuccacuaacaggugcgacuaugggucaguaauaaacacacuuuucaauaugucaaguaauaacacgauauucgcgcugacccaaucgcaccccaccucuuucaacgcccugggcucuccccucgcuuuguugcaugagagcugcuuuacucacugcucucgacgaacagucacagccacgagcaccguccgaaacagaaucacagccucccugggaaggaagcugggcagaccugaugcuuauuuuuggaaaggaacggaaguucaagauugcucauguuuuuauuacagucucccuuuucuccccuaagagaaucacaaguuucaggagacucugacugacacaacuguauuaauguuuaauucacucccacuuuaaucacuuuuuucuuuuuuucuuucuuuauaucaaagcacaucaauaaucacuuuuuucaaucaggagaucuacaacugcuugcuaaccauagucuucaauccgcuaagaugagcaauucuuucuguccacacugacuaaccccaacugacagcagagaaaaaccacgaggccuguggcugccccacaccgcugcuccuucagacaaccaagggccacggugguuucacagcugugagcucaggccccucagcucccucccgugagccaccuucccaacacccucagagcccaggaguccauguuagcaaagacaggucccuacacuggccuuggucucaaaacgcugcuagccagagcuaugaccuuaugcaaacaaugauuuucauucgcguuaggcugggugggaggguccacaggggagccacugacgaugggcaucugcccccgacacuggcugacuaaccagcaccauuaacccugggcuccgaacggcagucacaccagccugucucagggccaggucugucuuuucccugcuucccacagaacggcccgcagugcauuccuuucaugaguacaggagcauacggauggguuuuaagagacuagugcggagcuguggcuuucuugacaaauacuuuuucaguaacuucaaauacaugcacagagaaggcaugagaugugugguuagaguuaaccugaaagcacaagguggugccugcagcagcaggcacucagcaccugacccaacucaacucaaacaugugagcccaccauuacuagaggucaaaaaugguccaauaaacuccacucaguuguucacagcuguuuuauucauaagcaccagaaacuggaaucagcccagaugugcuucgaugguguaagaaaacguuuuaaaugguccguuuuccaggcaugauaaaucuacgcaauggcagccagccugcggauguaacaaaccgcacggcucgugcaccuagaaggucacaauaagcgaacaaaauguagaagaggggucagcccauaaaugggaagaaaguuucaguauugggaaaucaaaacuuaagcggguaagaggacaggguacaaccuuguaagcggguaaggggacggcguacaacgggauaaugaaacucaggcgaccuccgggaagauuguaaccccauaguacucgaccagugaggaacugggggagggacuugcauuagaggagauaaacuaccugcugugacugccccggguguaccugccuaccaggcaccugaucuugcaagacugccauuaaaaaucuugcuuccuggcugggcgcaguggcucacaccuauaaucccagcacuuugagucaggcagaucaccugagguugggaguucgagaccagcguggccaacauggagaaaccccgucuguacuaaaaauacaaaauuagccaggcgugguggcgcaugccuguaaucccagcuacucgggagacugaagcaggagaaucacuugaacccaggagacggagguugcagcaagccaagaucacaccucugcacuccaggcugggugacaagagcaaaacucugucucaaaaaaaaaaaagagagagaaagaaaaaagucucauuucugcuguucugugugucuccaagcccagucuuuggguguggacgggugaauguguguuucucaccauggauaaauaagcugaguccacccacaccacggagaccacucagcaacaaaacagagcgaacauuacgcugagcaaaaaggccaaucgaaaagguuacauuucuacgacuccauuuauaugacacucuuaugacaaauuuuucaaauggaggacaaaucagugguucucagggguuagggaccaggguggggagaugggcuggaaggggcaaauguggcuagaaaagggcaaagggccgauccuugcgauuauggaacuauucagcaccgcaacacggcagggacgggggcccccaguggugaacacgcacagaacucaaaucaaucaaucucucucucuaacacacacguacaaguaaacuucaggcaaccugaguaagaccggucagcgauaccguguccacauccuggcugugacguucuauuaaggccacaguucuccaauguguuaccauucgaagagaggaggagacuggccgaaguguacaaagggcucucaaggauuucuuacaacaaaacacaagcucaaacuauuuaaaaaaaaaaaaaaaguccaaaaaagaaagaguccaauauugacaauuucauaugguuuuaucuagcaccaacucacuuuauccucacaauaaucccacagaguagguaucauuauuaucuccccuuugcacaugagaaaacugaggcccuagaagugugagaaauuuagucaaggucacauuuuaaaugguggggccaagaccugaaaccaggcuggcuggcuccagugcccacacucuucaccacgaucagucuugaaacuggaaauggaaaacauggacaugaaucugcuauuauuauggcuuaaaaaucuuacaauguaacuuuagaggacuuaaagggaacacuaaagaccuaccauccagccucaucucauuuuaguucucaaucaaaaaaagacacagccaauuggauuccacucccacaauggugccaggagccccacaaucccaaggccagcuggugcagacaggucaccuauccacucugaucaaaccauucuccugaccucggucggucuccuucguuuuuucagguugggggcggacaaggugggccgguuauuucgauuuuuucgggcugggggcagagaaggugcaguuauuuguuuccuguuucugguguuucuuuuuuaaggguggggugcuauucauuucguuuucucugauuuaaagugaaagagaaggcuccagggaauaaaggcaacuacgcaaacuucagaacugaggugagccugaggaggaacuagaaggaaaaccaggcuuccuucuucagugcaaauguuucuuuuuacuacaggaaaaaacgaaacaggaaacaaaaugaauguucccaaacaauucucuuuauaccauuuagcagaaaaaggugcaaaguggaugaaugcagaacgagaacaagggggaacgauuucacacaaccguucuucccuuuccauaaugccugcccugauaggaaucaaacuccucugcuaaagaacaaaagccaacuauggaaggcaggagaaccuucaguccucagaggaggcauccgacuccugccaaaaccuucccuuccucaccggauccaggggaauggcaaaaacaauucguguuugaaaguaaacagauacacagcuauaacaaaaaaaacaaaggaagcuguagaucagaaacugggaaauaccugaaaauuagaggaggacaaaggcaugaaaucaaacuagagaaagugacacaaaagccaacagugaaaacagccccaauaacacacaggagaagguggaggaaggacagugcuggacugugcaauaccugccucccucccgcaggaggcccggcuccacaagaccccaaccagcgccggccgaguucacaagcucccugagcaacaaacaccaacucccugcguggcuucacuaaaacaagccuugaaagggaacaagaggcucugauggucacuuaaacaucacacacacacacacacacacacacacacacacacacaaaucugaaauccugaccaaugaagacauaagaccaaccuuucagaaagccuaaaucaggcgcauauagaugaccaauuuauuucuagcucuuaguaaacccacagaauuccaaaucagcaucacagucuaauggcaaaacucaaaaggaaacaugaauauacugugaucuacuugucuugagcucacuguuggccucaccauuuuaugaucggcgucauggacacugggaaacagaaaagacggagaaauccgggaagcggcuguuucacuucagugugaagcuccuacucaacaaucgcuuaguuauuugugaccucucacaacacucaucuguucuguuucuacaaaaugaauaauccaaguggcaguagacaucaggacaccuguuaccagccugucuuuugccaaguaggaaccucagaaugagauacaacuccaugaagaaccaucucuugguaugcaacaaggucuucagucagucagucaaucaauucagcagagcugcaugauacaagaucaauauacaaaagucagcuguaucaucaucauacacaagcaaugaacaaucugaaaaagauuaaggaaacauuuccauuuaaaacagcaucaaaaagaauauuuagcaacaaauuuaaccaaagaaguguaaaacuugcacccuguaaccacaaaacacuguugaaagaaaccgaagaccuaaauaaguggagggaaaaaaucccauauucauggaucaaaagacacagugucuuuacgacagcaacaccccccagggugaccugaugauucagugcaguaacuaucagaauuccaacggccuuuuuucaaaagugauccaaaaaucuagauggaauuguaaaccucuuacauacuacaacuuacagaacuauacaacuuuuucuuaaaacuuuuuucagaguagaaaagacauaauuaaaaugucuaggggccggggugguggcucacgccuguaaucacagcacuuuaggaggccgaggcgggaggaucacuugaugucaggaguuugagaccagccuggccaacauggcgaaaccccaucucuacaauaaauacaaaaaaauuagcugggugugguggcacaugccuguaaucccagcuacuugggaggcugaggcaggagaacugcuugaacccaggaggcagagguugcagugagcugagaucgugccacuacauuccagccugggagacagaguaugccucaaaaaaaaaaaagucuaguaaucguaugaugccagguuuuucuaaaaugauuauuuuuaauuauuaagggggcaaaauaaaacaagggcacugauuugacaguuuuuuuaaacucuuuaguuugaaagguuuaaaauucuucaauaaucuagugccucuaaucccagcacuuugggaggccaaggcagauggaucacuugaggucagcaguuugagaccagccuggccaacauggugaaacgccaucucuaauaaaaauacaaaaauuagccagacaugguggcgcgcgccuguaaucccagcuacucgggaggcugaggugggagaaucacuugaacccaggaggcagagguugcagugagccaagaucgugccacugcacuacagccuaggcagcagagcaagacuccaucucaaaaaaauagauuaauuaauuaaaauaaaauucuuuggccgggcacggugguucacgccuauaaucccagcacuuugggaggccaaggcgggcagaucagaaggucaggagaucgagaccauccuggccaacacggugaaaccccgucucuacuaaaaauacaaaaaaauuagccaagcgugguggcgggcgccuauagucccagcugcuggggaagcugaggcaggaaaauguugugaaccugggaggcggagcuugcagugagccgagacugcgcccuacacuccagccugggugacagagcgagacuacaucucaaaaugaaagaaugaaugaugaaugaaugaauaaaauucugcaauaaccaacauaacauuauuuccuuuaaaaauacaccacugucauaggccaggcaugguggcccaugccuguaaucccagcacuuugggaggccgaaguggauggaucacgaagucaggaguucgagaccagccuggccaacauagugaaaccccgucuccacuaaaaauacaaaaauuagccaggcaugguggcaggcgccuguagucccagcuacucaggaggcuaaggcaggagaaucacuugaacccaggaggcggagcuugcaguaagccaagaucgugccaaugcauuauagccugggcaacagagcaagacuccaccucaaaaaauaaaaauaaaaaaauaagaauacaccacugucccugaaugugcacuguucuuuuaauuuagaaugugagcccacaaugauuuguacagcccaacaucuaagaugcaaugaacagaauguaaauggggguuggggggagggaagggacuacacagcuucugagagaacagcaacgucccugcagcgugggauucucaacucucacgcucagacguucuaguacacagcagggacucucaacucucgcgcucagacguucuaguacacagcagggauucucaacucucacgcucagacguucuaguacacagcagggacucucaacucucacgcucagacguucuaguacacagcagggacucucaacucucacgcucagacguucuaguacacagcagguacucucaacucucgcgcucagacguucuaguacacagcagggacucucaacucucgcgcucagacguucuaguacacagcagggacucucaacucucgcgcucagacguucuaguacacagcagggacucucaacucucgcgcucagacguucuaguacacagcagggacucucaacucucgcgcucagucguucuaguacacagcagggacucucaacucucaggcucagacguucuaguacacagcagggacucucaacucucgcgcucagucguucuaguacacagcagggacucucaacucucaggcucagucguucuaguacacagcagggacucucaacucucgcgcucagucguucuaguacacagcagggacucucaacucucacgcucagucguucuaguacacagcagggacucucaacucucacgcucagucguucuaguacacagcagggacucucaacucucacgcucagucguucuaguacacagcagguacucucaacucucgcgcucagacguucuaguacacagcagggacucucaacucucacgcucagacguucuaguacacagcagguacucucaacucucgcgcucagacguucuaguacacagcagggacucucaacucucgcgcucagacguucuaguacacagcagggauucucaacucucacgcucagucguucuaguacacagcagggauucucaacucucacgcucagucguucuaguacacagcagggacucucaacucucacgcucagacguucuaguacacagcagggacucucaacucucacgcucagacguucuaguacacagcagggacucucaacucucgcgcucagucguucuaguacauagcagggacucucaacucucaggcucagacguucuaguacacagcagggacucucaacucucgcgcucagucguucuaguacacagcagggacucucaacucucaggcucagucguucuaguacacagcagggacucucaacucucgcgcucagacguucuaguacacagcagggacucucaacucucacgcucagucguucuaguacacagcagggacucucaacucucacgcucagucguucuaguacacagcagggauucucaacucucacgcucagucguucuaguacacagcagggacucucaacucucacgcucagucguucuaguacacagcagggacucucaacucucacgcucagacguucuaguacacagcagggauucucaacucucacgcucagacguucuaguacacagcaggugcgcuguccuuuaacaaggacaaaggucaacaaacgccccuuggaugaauggcugauuggcaggcauuccacacugcaggcucuguccccgcccagcagacuuguccccuaucuugaaacacuacuuuuccauuucauuaaugcaaccugauggccggccacuguaacaaaagaaacaucaccaaaaugaauuguuucuuucuuaagacaaaagggaguuugcuccucacauaugaccuuacgcaguuucugucugagaaucaucauguucgucagcccugccugugcucuccucuucccacugugcuuccuccugcaucacaaaggaaaccccugugagccugggaagugggugcgcaggcggagaaacagaaacggccacuccaggcucaaccuauccaucccggccucuuccuaagaccaaggcgcugcugacucaacccugcuuccagaagccuaggguuaacaucugcuccuuccuccuguuugcauucagugaaauccucuccucucccaggaguuuccacauaaaaccugccucuuuguuuauuaagaauuguuuacagaacucucaagcagcaaaggcaaaguacagaagauaaauaagagcaagcuggccggugcgugcgacuggauggacaacaucuuuacccacaugucugcaucagcucugcguuguucaccgacaaaucccgugucuggaagaguccuggcaggcugcacgggcuggagagagagcgagcuggugaguggcugccccucccaucaccaccacuggccacaccaugaugaucacacacccaggcacacccacucugugcucuccacgcaucgccucauucaacccccacgacagcccuuaacagaugccaccucuguguuucuugugagaaacauggaacauaacuggcacucaucuagcauggucucgcaguagcacugaaccuacaaaccacucucuucccaggcuuccaccccaccauucccgguuucucuugugaacuuuguuuccauuuuguuucacuugcuacaucuccuuccuccaccuccucccucaauguugucuucagccacugcaggggcacucucaccugccucuggcuuuaacgacgugcugcugaaucccagcucugccaaucagaguugaacccacugaacccacugcaacaauguccaacuagagacacugucaaucagagacaauguucccaccuuacucggcucuccucacacaggcugugcacauacagagcccucaccccacuccuuccuguauccccugccuugcugcagggcaccacugucuaacccuccaaggcagaaaccagcugccuccuccucccuaucaaaagcccacuuauaaauccuguccauuuccagcucccccccaucacugucacuccucccuacugcaaccgcucugacuucuaguucaagagugucucaguauuucuuuaccuacaucaucauaacaacuuaauuaucuccaccuccagccacacacaccaucaacuuauuccccacagugcuaaggggagaauuugccacaucuggucacuuauuuacaccucagucuggugugcagaagucacugggcuaacaaggaauauauucauguuguacaucgugaugcaguacacacacacacacacacacacacacacacacacacacacaccccuggaaaauaaaagcuucacaggacgaaagcuuccacuccuacaugggacacacuccaguguuuccccaggcuggcagccgcuguuugugaccucaggacccaucgccguggcagccgccucccagagcccguggcaugcacuguguugaggggugcugucuggcugccuccccagccucugagcaaccgcaaacaccuuccaguuuaggagggucccucuccaucuuccuagaaugcccuuuucuacuguguccagcuggcaaacuccuauucauucuucaaagucaagcucaggucuugacuuucuuccuuauacuucucaauauucuucaaauucucuacggagauauguauugcuuuuauauuuuuauacuaugucaccaccauacccgagaccuuaccagucacacacucacccccauucauauucuaucacgguauaaucuugagcccaggaguucaagaccagccugggcaacacaaugggaccccaucccuauaaaaaauuaaaaaauuuggcauggugguacacgccuguggucccagcuacucaguagaaucacuugagucucuacucaggagaaucacuugagccugugaggucgaggcugcagggggcuuuaucacagccccacacuccagccaugggugacagagacccuaucucucucucucucucucucucucucucucucucucucucucucuccucucucucacacacacacacacacacacgaaauauauggacacaggccacauuauauacaagcauugccauaauaaaaacagcucucccuuggccucugagcauuuuacccuuuugauccauucagcuucuuuagaacagauggauauucaccauaagauguaguuuauggacaagaguaauuuggaaaugaaaaaggaagacaguaaggaggccuccccuucaagaggguuucaugacaaggcccaguugaguggccaugacuggccggauccuuuggcccuaacauauggaucccuccaggcucuuucagucugcuaaccuacaaguuaauuaguccauuucuaggaagaaaguguccguugucuccucugcagacuuuccacuuccugacagcacaggaaccuaacagcaugccaaguucagacuccuuuuucuuugcaccucacuaccaccgacaggcuuucaaacauacuauucagaacagagacacggcguuggccaccagucccagcuccagcaacacuaaaaggccucccuaaaggagcagcaggagcgcaacagagaagaacaggguuggacgugggggcugggcacaccaccuucaccagaguaagagagaaggaacgggcuuggacgcagcagggcugggcacgccaccuucacgagaguaagagagaaggaacgggcuuggacgcagcagggcugggcacgccaccuucacgagaguaagagagaaggaacgggcuuggacgcagcagggcugggcacgccaccuucacgagaguaagagagaagcaacgggcuuggacgcggggacugggcacgccaccuucuccagccccagagccccacuguggagagaaaaggggcugcucucugccucagaauccaagaacuccugagaaaacagcuacaucgacaucugguauuaacauuugauuguuuaaccacacuauaagggagaaggggacauggacacuggcuucuaaauacagaaguuuccagcucccagcugguuacucugagaagaugccccuagugugucaccuacagagaagggaggaugcccaccuacccugccuggccugcaccacccacuagaaauaaacaacaggccccaaaugcaaacaggaccaagagaagggccauacggcagcagcaccccagugccuccaagaugccacucacccauggugcacccuacacacacucaccuccucaagacacuauggauucugugugucugggggugaacugcaauuuuuuuaauguuuuccaaguaaaucuaauuuaaaaaaaaaucacugaucuagcccuuccucacccaaacucccagucauacaguugucgaaauaaugaccauaaagcaauucuucucuaacuugagaauucucauacucuucuucuccacgcaagucggaaagaccuagucugagaaagaaagccauaaaaaugagagaauccagcgaagucgcugcagccaggaggagcagcaccgcgcaguccugugccucaccccugcccaggccaccugagccccaccugucacaguaaggcugcagaagcaugcggcuggucagcagcuaaucagcagaaggaaagcuggcccgacaauccaugccuauaaauuccacaacagaugucuccugagguccaaaaucugcucuuauuaaagaguggcgugugggaugggcagagacucacacagccacaccacacacacaaggucucaggacucuagccaaggucuucuaguuuguaguggccucauguuugaugagcaucuaauaacaaagacaggaaagcacuggauggagacgcggcgaggacacuggcugucuggggcagccuugcccugaggaaguuaugcucuaacuggugagacugcaccaaggcacaagaaaacccacgacaaacugaaguguccaugcggauggcuaggugaagcagggcgcaggcccaggugugaacacucaacugcugggagcccaagaccaacugauacacccacagccaccagcucuucaugagaggugaagccagcugggcuucugggucggguggggacuuggaaaacucuucugucuagcuaaaggucuguaaaugcaccaaucagcacucuguacaaaugcaucaaucagcgcugucuagcuaaagguuucuaaacucaccaaucagcacucuguaaaaacgcaccaaucagcacucugugucuagcuaaagguuuauaaacuaaccaaucagcauucuguaaaaauggaccaaucagcacucuguaaaauggcccaaucagcgcucuguaaauggaccaaucagcaguacgugggcagggccgaauaagggaauaaaagcuggccacaugagccagcagcagcaacccacugggguccccuuccaugcugugggagcuguguucuuucacucuucacaauaaaucuugcugcugcucacucuuugggucuguacuaccuuuaugagcuguaacccucagcgcgaaggucugcagcuucacuccugaagucagcgagaccacgaacccaccagaaggaaaacacuccagacacaucugaaaaucugaaggaacaaacuccggacacaccaucuuuaagaacugugacacucaccgcgaggguccacagcuucauucuugaagucagcgagaccgagaacccaccggaaggaaccaauuccagacacauucacacgcagacguacuuucguucuguccugcugggaguccaagaccaacugacuguccacucaaggaacagaccaacugacgcacccacagccaccagcucuucacacacacacacacacacacacacacacacacacacacgcuuucggucuguucgcucaaggaacaggaagccuuuuucacuucaacuucugcauucaguucaaugugcuggugccgcccaucaccucuaaaucaccgcaaguuucaagaacagccaguuguguccuggagcugugcugagcacgcccaccagcccagcaggugcugcugagagcagaggguuuugcagggucacacauucuuccaacaauaugacugcagaccccccagcaaaaggaaagauuccccauuugggaaaguagacuaaaauuuucuucuauuaaaacaugauaauucggccgggcacaguggcucaugccuguaaucccagcacuuuaggagacggagauggguggaucaccugaggucaggaguucgagaccagccuggccaacucggugaaaccuaucuguacuaacaauacaaaaaugagcugggcgugauggcucagaaccuguagucccagcuacgugggaggcugaggcacgagaauugcuuaaacccaggagauggagguuacagugagccaagaucaugccacugcacuccagccugggcaacagagugagacucggucucaaaaaaaaaaagauaauccaaguuucuccugacagaugacauucaucaacaagagauucaagcagaaaagaccacugucucuaacagcaaguauuauacaagagccucaagcgacgucugccuuggguguugggacauagcaaacaggacggcuguuccgcaagagcaggacugaagcaggcggaaaugaagacgcaggggcaucagccaucagagcucuucuuccuggaauaacuauuccucuaagcugcuccuucagauacaaaauaaaaaguaacucucaacacugacaagucaacggaggacacgcgaaaaaccaaaaaacuuuuacuauauuuuuguuuuaauaaaguuauucuaauccccugagguaacugugagggaauuaauaacuagagaacuguuagagaccccugaagguuggacaaugguauugccgaagcuuuguguuuugcucuucaauaaacuuaucuacuuucuuaagcuaacugaauaaaauuuaauauacauuuaucaaccacaucuuuuaaaaagagagaaaaguaggaaacucaaaguaguuuccuuuaaacaaaagauggucaaaguugaugaauuuagaacauuuguccccaauauccuaaaaagugacauacgaggaaggagaugucacagaagaaaacgacaacacacacccaaacggcaucagccugugugugaccauuuucacaacagggaagggaacgaagcgaacagauccaucacugaaagcgcagcacacaccuucuaaccuggaaauggagaaggaacguccacuuaugaagagggccaacaacaguggccucucauuccaugaaccaagcaugaugcuaauaugcuaauaugacagagaauuuuuuaaaaagccaccaaaaaaauaccaaaaagugaaagacuguauuguuugccccaacaucuguuuucuucacucuaauguucccaaaccagugcagcaaacaggcuggcucuucccgccucccacugacuccuccacaccccuacuuccucucuccucauucaccucuucuucuuucugcucuucugugccucccacucucucacugagcagccccucacuucccagcaugccaccaucuccccugagcaaacaguccuccagagacaguccuccagagcucucuccaaccugacaucucucccaagagcccacucaccagauguccaagggguuuaugaaagccauggauucaaggcuagagacgcugucccucagaccagcucucuccggcucuuccugucugguagggaggcuguggugcccuggccacucucauuucucacuggccucugcaccucccaugcauccgcuccuccgccaugccucuccacuacuccuaaugccacucccagcuccagcaacccacccuccagggcaccucgacgcuaugcccaguucaaucuccuaugggucagugcagggcaaugcauaaugcaaacuaggcccgggggcuguggaguugggcagccaugguuaaaaucauucuuaguuuccucaucuguagaaagaaaaauuccuggauacaaaauauaagaugaauauacacaaguccauuguauuucuagacaccaacaccaggcagaguccaccaugaaggcaaguggcagugucccaaggagagcccgcuggccaggagggcaccgcaagcuuggacacagcaggggcacuggagauggguccacgaaccgcgugcgcagcccaggaggcuggcacaacuggugucugcaugaagacuaggaacagcuggcuucuuaucucacaccauacacaaacaucaauuuaggauacauuaaagguauaaaugcaaagggcaaaaguacaaaaugugcagaaggcguaggaagcuaucuuuauggccuugggauagggaacauuuuuuuuuuuucaacacagagucucacucuguugcccaggcuggagugcaguggugcgaucucagcucacugcagccuccgccuccuggguucaagcaauucuccugucucacccacccgaguagcugggacuacuggcgugugcuaccacauccagcuaauuugugugugugugugcguauuuuuaguagauacaggguuucacuagguugggccaggcuggucuugaacuuaugacuucaggugauccacccaccugggccucccaaagugcugggauuacagguaugagccaccgugcccauccaagaaaauuuucuaaaaaaagacauacugggucaugauggacaguuuggaaggcauugcccccaagaaccaagcacagucccuucgaagcuaaaguauucaaaucucaagucaucaaauguuacugcauuuaggaggccgaggugggaggacugcuugaucccagaaguucaaggccaaccagagcaacaugugagaccgcaucucuauaaaaaauuuuaaaauaaacuagccaggugugggguugcaugccugugaucccagcugcuggagaggcugagaugggagacugcuugagccaaugaguucgugaucauaccacugcacuccagccugaacgacagagcaagacccugccucaaacaaaaacagaaacaaaaacaaacaaaaauuuuaaccuuucucuuaaaaaaaacaaaaccaaaaaaaaaaaagaacuguauucuuccauucauauagaagauaaacaucacaaugggaaacucccucuguguggcacguuguucaaauccacaugcaugcacagucccagagucuucuuuccuacccgcagcacugaagguucaaggaagucccacuguuuucaguaaacugaaaacuuuuuuggaaaaugcuguuuuccaguauagacaacugaauccuaagcacaaauauauaggaccucugaauauguaaaaauuuaaaagcagacaacacuaaauuaaugauuuuacuuuuaaggagauaaaauguuccuugacuugcaaugggguuaccucccaauaaacccaguguaaagucaaaaauccuaagucgaaccaucauuaagucagggacuaucuguauacacuuucagugcuaaaaacuacaccaaagaaaaaacaagugucaaaguucuccauguaaaacagugauccagggauaugggugagaaaacccaucuaaaaugcaaugugauauuuaggauaaagcugaaacacaccacagcgccucagcaauugaggcugugaauacaaccacacaaucagcaaagaaaagcuuguucuauucuucaucuacaccacucacacacaacaccaaagguguucucagcacaccuccauccaccucagaucuauucuucaucuacaccacugacacacaacaccaaagguguucucaacacaacuccgucccccucagaacucuguggaacguuuucauucccaaugaucaccaacagagccagcuguaagcucaacucuaacacuacccacagugcagcugaccuagacugaugggcggccuccggagaagucaaagacuccagcucuacugcacacacccacagcaggagaggccugugucucucacagguguggggucugagccgcagcccacuaccuuaacuccauaaucugugacuuggcucuuaugaggaagcugacaaagaaucagagacucagaggagaucacagccuuucaggacugaggucuaaaacacagaaccucuagcccagugcucacccgcaaccauuucccugccucuuccuacuucuccaguccucaaggggacaauggcaggguucacaggauucuuccuccggaagaauucagugugcuguaauuagaaaugaacauuuuaucaauauguucacguaaaauguacauguuccccuggggggagggauaaauaacaguggaacuaggaaaagcagaccaccagaaaaugucucgguccagcgugguggcucaggccuguaaucccagaacucuggaaggcugaggggggaggaucacaugaggccagaaguucagaccagccugagcaacacacugaaaccucaacuuuguaacaauaaaaacagaauaaaaacuuagcugggcauggaggugugcaccuguagucccaggcacucaggaggcugaggugggagaauugcuugagaccaggaggucaacacuacagugagcugugaguaccaaugcacuccaaccuggaugacacgacaaaacucugucucaaaaggagggggaggaggagguaagagggaaaggaagaaagcauaagaaaauaucaagcacaaacuaagggccccaaaaaauccaacucacagcaacgugggcagagcccuggagaagccagaggacauccaggcaccacccagcaaggggcuacagaaagggggccaccugccuccaagccugccgggacugaaaauaaauccauguggcaucaacaggaacaucuguggcuguguggcaaugcgugugagugcgcaugaauccugguguggcuggugugugucacagucaaaacggaaagagagagcgcaucgugguuuauaaaaaauaaguuuccuugcggccagacacaguggcucacgccuguaaucccagcacuuugggaggccgaggcgggcagaucaugaggucaggagaucgagaccauccuggcuaacaccgugaaacccugucucuacuaaaaauacaaaaauuagccgggcgugguggugggcgccuguagucccagcuacucgggaggcugaggcaggaaaauggcgugaaccugagaggcagagaucgcagugagccaggaucgagccacugcacuccagccugggccacaaagugagacuccgucucaaaaaaaaaaaaguuuccucgcuaugcaugcgcuaaaacccucuggagugaaguccuaaaauauuuaaaugaauuuucauucugaagagacuacagaacuucucaacacaggcucucuuacacagacucuauuacacagacuuuuuuaagaucuugcacauccaaugucagaauauauuccaucacccagcaacaaaagcagucaggaaaaaaacuucagaaaaagaauuauuaaaaaauacgcaaaccuggccgggcgcgguggcucacgccuguaaucccagcacuuugggaggccaaggcgggcggaucacgaggucagcagauggagaccauccuggcuaacaugguaaaaccccaccucuacuaaaaauacaaaaaauuagcugggugugguggugggcaccugcagucccagcuacucgggaggcugaggcaggagaauggcaugaacccaggaggcggacuaugcagugagccaagaucgugccacugcacuccagccugggcaacagagcgagacuccgccuacaaaaaaaaaaaaaaaaaaaaaaaaaacgcaaaccugacucuuaaaaaauuaaacauacccugcauaacugaacaguguccacaagcaggaaucucucuggauggcaagguggcagccgacuauggcacucaccaaaaaggcaccuucccccaucauccaugcaaagaccuuucccaaagccaccagaccuccguucaaacaacucaaauccggucuagaaauuaaaaauccuuguacugaaagcaaaaucaggguuagcugugacuaagauccaagaaauaaacuuuuuaaaaaguaauaaacaugaauucaucaguaugaaaaaggucugugcacagugagcaguuggcacaccgaugcagugcaccgagggccaaggcgaaggccgcagggggaggaggcucagcagagggaggacaccccagcugacaacgcacgcccacuggugccagugcuuuggagaacaugccaggucaugucuacgcuuuccucacuaaggauuuaauuucaguauucuacaaucuaacucuacacucucaaaacauaauuagaaacaauguuuugaaugugauggagggaugcaguagagcuucucuagaaaaugcuuuugaaucugucucagaaaaccaccuguuuuguagagaccaagacucuuccuccauuuuggcucaagcuggauccugaguaaaagacaaucccacaaacgccccuuuaugcacagcuucccccacacgcuguuugucucuguuucucucucucucaauaccccuagauuuuaggucaaaacaaaccuguuuccaccagcuggacaguaucauucaggaacgguuuuacgcaucaaagacucauuuccagauaaagcugaagcuccagggaggaggccugugucccacaaaggccaggugcugacacgguuaguccuuuccuccccaccacccaccaggaauguugcuggaacccagacacgcacagcaagguucugcuguuuacccugcuccccgguggcaggaaggugugugcccuauucucacuccaaccccaucacggccuggugagccuccggcgcuccugccccuuacagcacaagccggccaccaccucccacgggcccugacacugucacucaacaccucaccacagcacccagccucugccucuuucauuagacauaagcaaggauuuuuccucuagccaggaaguuuuucaaaugugaaguauuucauuuuuuucuucuuauuuuuuugaaacagaaucucgcucugucauccagacuggagugcaauggugcaaucuuggcucacugcgaccucugccucccaggcccaagcaauucuccugccucagcccccguguagcucggauuacaggcaugcaucaccacgcccagcuaauuuuuauauuuucaguagagacaggguuucacccugaccucaagugaucugcccgcccuggccuccaaagugcugggauuacaggugugagccaccucacccggccucaaaugugaaguauuucaaaucgaacuuguucacagucaaggcaagcauggcaugcuugcuuuggccagcacauguacuaaaaauucgaacaacagagacgauuaccauagccccugugcaaugaugacaugcaaauuugugaagcauuccauacuuuaaaaaaaacacacacagauugggaccugcucugcaaggcaucagaugccuuccagucaguaagagacaagagauacacagggugcucccauucccacagcaagcaccacccugcaccacuaguauuagcaccacccacauggaagggugccagacacauaccuacuagcugccugccacgcauggaaaauucuuuaggcaauacccuccgcacccagaaggcuaccagaccuguuaagccuuuucaaccaguuuuugcaagcaagagaaaugcaauucuuaagagcgggaacaccccuuuauuacauguaaagauacacaagcuggaugaauugaauaggggugaacagugaugacccaugaccaagaugcauuaagaaacagaucugcacaggaagguggaacaaggcccgugagugcagagcaagccugcugggagggcaggggcuugucuuggaggaaagugccaacaaagccugugccaacuacagcugccgugccgggccggcgucaacaccgaaggagaggugugcagagacaaagcggccugucaggcugaacagggaggcagaaacuccgcagaccaagaauacaguuuccauaguacccuguaacucaccaaggcugggacaaagguuaaugaaaaguucaaaucugaaauaaauaacaacucacuucgguauuuuacaaaaaagguaguuaaguauuuuuuuuguguuccugcauaaaauacuaguaagacucaaaacagguagauacugauaugcaaguuuuaaaaucacaagcagaagaaacaacacucuguaugcccuuccagguggaaaugcagucagcagaaaacugucuccaugagauaaaugcuccugcccaaagcccacucuagcaaugcuuccucccugaaccacaacucugaacaggcugccacucacugcaacuccuugcacaugacagacuugcugggaagagcaggugcguacuaaacauuuucuuugggcuccagaaagcacuaacggccuacuuuugcaacggggcggucggggggguggaguggagggagggggguuguguaggguuugccaucagcguuacccuggagcuaguccagcccuggacuucgauaucaccugaaauccaaucaucaaacuuugcccacuguuucuucuccaaaagcaaggaaaagaaaagcuaucaugagccccuucagggucuagcagcauacaagacugcuuuuagaaauucuacuccaggcauaguggcucacgcuuguaaucccagcacuuuggaaaacaggaaggaggauggcaugagcccaugagcucaagaccaggcuggauaacacagccagaucccgucucuguuauaaauaaauaaauaaaauguaaaaaaaagagaaauucuaccaaauaaagaucaacuaugauguaacaaccaaguaacccuacagugugagaaaugcaugaggggcuuaagcucagggaaccaccaccuaaagagagaggcagagaccucagaggacaucaccacaggagcaggcaggcucccacccagacaguggcacacugccacccuugcaaaccuaccacacagacccguucagcaccugcccuugcaccacccaccuggaggcucagcauccaggugugcuggccccuugggugagggugcccaggcacucaccaacugaaguccccaucucuccacggcaggcccaccucagaggaggcaaauguuaacggcugauuucuucccauaaagcuaagcccuuauccauguggcuuguuuacaaaaguaaaacaggcuguuuggacauggcauuaaccaauguauuaguaagggaaggggagcaagcuguuuucuuuaacuaauauauauagguccaacccuaguucaaccacugcucagccguuucgaaccacuggcugagcaaauucagccucucugagguucagguaaacuaagaggucaucuccuuggggcguaagaugcuaccccugaagcaacaucacaccucucauggacgucacuaucauccuccaccccaaccugcaaacauaccuaggaccagugccccagccccaaggagccacagaggcugaggaugauccguccuccaaaugcucaggcuacucugaagcaggaaacaaagacagcaauaaccacaagcacagggacaauguccugccugacaccugaauucuuacucugauaucucaacauccucuucaauaaaaucaggaaauaacuguauuuuuuuaaaaaaacgauuuugagcccgggcacuguggcucacgccuauagucccagcacuuugggaggcugaggcaggcagaucaccugaggucaggaguucgagaccagccugacccacauggagaaaccccgucucuacuaaaaauacaaaauuagccagguggugcaugccuguaaucccagcuacucaggaggcugaggcaggagaaucacuugaacccaagaggcagacauuguggugagcggagaucgugccauugcacucuggccugggcaacaagagcgaaacuccgucucaaaaacaaaaacaaaaaaaaaaauuuuuuguuaaaaaaaaaaaaaaaaaaaccagccuaguauauguuccugccuaagagaauaugaagcuuuguuuuguucuucagauggauccacacuuagaaccaccaucuuuaaaaaaaaaaaacuguuuaaaaaggacuuccaauugcauuucaugaaggcaguggguagaaaauccuugaucagucccuaauuggguguguuuuccaugaaugagcuauugggauacagagugucgagaacaagaaaacagcuucuaauaugaaaacagaugagguucuccuaaagcuucugugacagcugcaucuaaacaguuuaacacugagguggacgggcgcaguggcucacgccccuaaucccagcacuuugggaggcccagacaggcagaucgcuugagcccuggaguucgagaccagccuggucaacauagcaaaaccccaucucuacaaaaaacacaaaacuuauccgggugugguggcaagcaucuguacucccagcugacagggaggcuaagaaggaaaggucacuuaagcucaacaggcagagguggcagugagcugugaucaugccacugcacuccagccugggugacagagcgagcccccgucucaaacaaaaacaaaaaccaaaaaaaacccacagacucaauucuggcugccaggccaucaagggcugugaagugaagcccugagauccuuguggcaggacccuggacacacaaugacagugccaccagccacagccaugcccagcaagcagcuuccuguccagugagcaccaaggggcccuucucacacacagccucccacucaaaccucgagcauccgcuucucuccuccuccacucuggggcacagaggcucucgccagcccccacagcugcuucuccgcuugucacccugccacacacccucugucccugcaguuccagggacagccgagguguucucacucugcaccaagugccucacgggccagguccugcuuaaagccugaaugaagcaaagcuuggaaaggacccaacacaaccugccaccaacugaaugccugccaucccuccccacccuacgaagacacugcaugaaagccaccgagcacgugacugcaugacccccacacaaagggcacguccaucguuccaacuacaaagcuccacguccaacaccaguggccuccucacccccaaugcauauuugcaacccauuaguaccaaaaguuuaaucacuauugcugcccugucuccuacuaccccauuccuugcccucauuaaacuccuaaagacaguggucccuagaugccucccucucuucccuauccagcgacuuaucacaaacaccccaacacccuuuccucuccaucagauaucacugaaccucaacaagggggccugaggugccaaagaaacaucacauagcacgaucuagaguguagcaaccacacagcuaacacccaaaucagaggguccucaugaucccauccaugcacccacaucccggcugucguccacaauccuacgaaucagaggguccucgugauccccauccgugcacucacacucccugcugugguccacaauccuacaacaaugcuccacucuuggccucguacccuaaguguccacauuccaccuguucucacuccuccuacacagccaccuuuggcccuaagaacacugcauccggacacgcaggcccucggccucccaaagugcugggauuacaggcgugagccaccgcgccuggcccaacaucauguauuuauuacauguaccagcauuuaucuaauauuuuccuaaaauacaauaacuuuuucuuuuuuuuuuuuuuuuuggagacaaagucucacucugucacccaagcuggagugcacuggcacaaucucagcucacugcaaccuccacuucccagguucaagcaauuguccugucucagccucccagguagcugggacuacaggcgcccaccaccacgccuggcucauuuuuguauuuuuaguagagacaggguuucaccauauuggucaggcuggucuccaacuccugaccucaggugauccgcccaccuuggccucccaaagugcugggauuacaggcauggagaguugggccaucuauucucucacugaagcagggaugacuuugucacaugcacccuugcagacacugggcaccuugcagacagugggcacccugcagacagugggcaccuugcagacacugggcacaggaauucaguaagacugauaggugauguuuuuaguuagggagaauauaugugcaaauuauuuccauguaauauaaaaagaaaaagucucaacuguaaaaugagcauaaacaguccaauggugaaaccuuuucucaaaaaucugaauugaaaggacaaguuauauuagugcucaagaaaaacuucucccugaucugucagaauucacaccaugaguuccaaaucacacgaaaguacucaaagucuuggccaaagcaaaccuacuacagcaccuaaacacaaaucuccauuuucuuuuuucuuaaauuagccuuacuacuauauuauuaaaacucucaaaccaaaaguugaaacuaaaaauugaaguauuuuauaaaggacauaagcacaaaaauaccuuccaaauaaucuucaaauacgccuaauuaaaagcaggcauuuaauugcacaaauuuaaugaauuuaacauuuaaaaguaaaguuaaacugcuucugaggccuuacaguacccuaaaaucauuuucaaaguccaagacgagacggugcuggacuagcaguccuagaaaaacccucaccagcaccgccccguccaccggagcgcacgugagucccggcaugcgggcagggcaggagagcucuuucuauccccacccaccucuggcucacuccaugagcacaagcaaagcagugccccggaccuggcaucuguucauguuuuacuugcccauaucaccauuguauuuaguucuugguagcagccaucaaccaucauaaagcagcuucuuuuauucuuugcuacuucaaaucacacaugaaaaagaaaaugcaagaauagaaacacagaaauggaaaugggccaggugugguggcucacaccuguaaucccagcauguugggaggcugaggccggaggauugcuugagcccaggaauuuaagaccugccuaaccaacacagugaaacccagucucuacaaaaaaaaaaaaaaaaagaaaaauuugcaggcaugaggaauguuggugcaugccuguagucccaacuacuuggaggcugaggugggaggaucacucgaggugggguggucgaggcuacagugagccgugaucccaccacugcauuccauccugggugacagaaugagacccugucucagaaaaaaagaaacacagacauggagagagaaggcagcuaucauggggcaaauuuaaaccaggaucucuggaaaugcguuauuuuuuuuuuaaauuauacccacacaccccuuccacauucuucuauacuuagaaagggggugugcaggccgggcgugguggcucaugccuguaauccgagcacuuugggaggccgaggcaggcagaucaccugaggucgagaguucgagaccagccugaccaacauggagaaaccccgucucuacuaaaaauacaaaauuaccagggcguggugguacaugccuguaaucccagcuacucgggaggcugaggcaggagaaucacuugaaccugggagguggagguugcagugagccgagauugugucacugcacuccagccugggcaacaaaagcgaaacuccaucucaaaaaaaagaaaagugugcauaccaaccuggugagcuagguaaggugcucacauacuggcaacagaaagcaggugacaugaucaaagucauagacaggcagagccacacugaagaaugcaguccuggcuacaggucccagcuccugcuucacugagcacccugagggagcccuuccuaagcaaggggagcccugccuaagcacuggggagcacuuuaucucacaacaggaaaaggcauucuuuccccucaguuucucagagacccagugacuucaggauuugcaaacaauuguguuacugaaugugucacacucugcuccagcugcagggaagaaccugagugaugagaguacaugauucugacucugacccugacuuccucuuaaccuccauacccaaaucaagaccugugcauggagcuggcucagaccggggagccagaugcugucugaaaauaugccaucaauucuuucuacucacuuaaaauucaaguaccuaagacauucaccccccauuuuguaaaaaagcaaacaaaaacauaagacucagagacagaauguaagaauacaacgaaguauaccuggcuggaagaacagcuuuuacagugacagcaacacccuaaugggcccucaagacaaacuugugccucccuccgacgguguacaaggaguuaggacuuuccugugacccucaacaaauacuugcaaguauaaaguucguuuuaacuucuagacccgcuuuguuuuaguacugauugcagaagagggcugacaaucccaagcucuaagccuuucuugugauuaucauucccaaauucucuuucgcuaugcauacauuccuaaacuccuacuuucuccaaauucucaaaacauucuauuuuacagagagagacagggucucacuaugguguccaggcuggucucuaacuccucgccucaagcaauccuccuaccccagccuccaaaacuggcgggauuacaggcgugagccaccaugccuggccugucaagacauucuaaauucuauuuuguucaauuuaauaucacacagaaacuaaauaugccuuccaucagccaugaaaaugacuaaugaaaauguaaaugaccacguggcccaauccugguuuccaugggaagaccagcuggcucaccacccagcuaagaguuauggccuaaaucagaggugaucggggugaucagaggugagcaaagcacuguuucuguaaaguuuuaguuuuauuggaacacagccauacacagccaugcuuuugcuucaauggcaaaguuaaguaguuucaacagagaaaccuauggcuggcaaaguucuuuaccacuugguccucuguagaaaaaguuugccaaugccuggccuaugucagaauucuaacuacaucucuacagacuagccuaacaagugggucaagugcuaauaguuuuaaggguguuucggguuuuuguuuuaaaaguuaauuaucuguaaagacaaaucaauggagacagauaguagauuaguggcugccuggggugugaacagauuaacugugaauugacaggagggaucuuacugaagugccaaaaauuuucuaaaauuggauuauggugaugauuucacaaauuacuuuuuuuuuuuuuuuuuugagacgaagccucacucugaggcccaggcaggagugcaguugugugaucucagcucacugcagacuccgccucccgaguuuucaagcaauccucacaccucagccucccaaguagcuaagauuacuaaaggcacaugccaucaagacugguuaauuuuuguauuuuuaguagagacagaauuucgcaguguuggccaggcuggucucaaacuccugaccucaggugaucugcaagccucggccucccaaagugcugggauuacaggcuagagccaccgcaccuggcccauuucacaaauuacuuuuaguaagcaaacuuaacuaaaaaucacugaacggcauacuuacaaugcaucaauuuaugacggaaaaaguauuucagugaaucuuaaaaacugaaaaagaaaagucaacuaucuguauaauuguacuuugguaaucuaagaccuaaaguuuaggguacaagcugaaauaaaauccuaaaaaaucuuuaaaacaugugucuagacguucaaaauuuaaccucugguaucaaauagcucauuugcgccgggugcagugucucacgucuauaaucccagaacuuugggaggccgaggcagguggaucaccugaccucaggaguucaagaccagccuggacaacacggugaaaccccaucucuacuaaaauacaaaaauuaaccaggcaugguggcacacgccuauaaucccagcuacucgggaggcugcagcaggagaaucgcuugaaccugggagguggagguugcaguaagccgagaucacaccacugcacuccagccugggcaacagagugagacucugucucaaaauaaaacaaaaaaaacucauuugcaauuuagagacaggaauuacagccaagugcaccccuuaccccacuccccuggagccacaagccaagagggcaagguagggaggaccaaccaugccugguguccugccaccaauggcuccaggaaccccaaguucucucccacacccugggcgugauuaaaacuaguaacaccuuucuguuagaaaccacagcgggugaggacacagcuguuuacuuuuuuuuuaaucaagaaugcugcucucagcacucugggaggcugaggcggguggaucaccugaggucaagagauugagaccagccuggccaacauggugaaaccucaucucuacuaaaaauacaaaaauuagccgagugugguggcgggagccuguaaucucagcucaggaggcugaggcaggaggcaggaaaaucuccagaccugggaggcagagguugcagugagcagagaucaugccauugcacuccagccuaggcaacagagagagacucuaucucaaaaaaaaaaaaaaaaaaaaaagaauacuuugaugguaucuuugaaaguuaagagguccuauuccccucacuacuuuuagauucuuguuuucacauggucuucuugaaagaaacugcacacgcccgcuuuuucauacaaucacacaugcguggauaaacacauaccaucuuuuauuuuauuuucuaaauagagacagggccuccuuauguugcccaggcuggugucaaacuccugggcucaaacaauccuccugacucggccucccaaagugcugggaugacagauguaagccaccacgcccggcugcacagaacaucugaagcacauuucuuuuuuguuguuguuguugccguuuucauaauaguauuuaacaagauaaauaucuuggcuccuuuuuguuuuuauugcccugcccuucagggauuaagugcauuucuuagauacucacuacuucucugacauuaaauuuuguuucaguugcuuacaucaacguuucaaaacccagaaauaagaaaauuauuguucgaggucaauaaccauguuuauaacaacuuccaacuuaaaauggaagaggaaucccuuggagaacacacauuuccuuauggaaguuuccucaaaauuucuaauaggaauuucaacuaaguuaaaguacuaauuuaaguaggacaagacagaauucucuuccuucccagacacuauuacaagccaaaccacguuucacaggaacacguccugccugcuaagguguccccuaggacaaagcugcuugccagcugaccaucacuuguauugcauacuuuaaaaaguguggcuaacagaaaggaggcaagacagauguuauuuaaauaaaagcacaaagcaucuguucaagcacgaaaaaacauaugggaaaauacaagcacaggacacucaggacaaugugaugugcugaagacacagcggcaaacaaaagagaccggaugccacugaccuguccaagaagaagaacaggaaguauuacaugaaggagaacaggaaguaaaacaugacuggagacagaacuugugaauucgaggcaggacucuggagccagccugcccaggguccagugcuggcguccacucccaacuucuaacuucccugggcaaguggcccaacuuccuugugccucaacugacuuaucucugccacaaggggcagaggagcacccgcaccucgggaguucccaagacugucugaguggaccuacauggagcacacagaagagcacccggcagguaguacauguuucacaauaauccuuccacaaugcaaaugacauacacucuaaacucaucaugggggagugcuucacaacacccccuggcacaccacagccaacacaaccacagccaacacaacgacagccgcgccacaaccaagagagccugaagagcugcucucagucacugcccagcaagugugggcagcuguagcuuacagaccaaggccacagaccacaacuucugcaggcuugccugggacacaggggcagauaaggagagcaccugaggccuacgcugagucccacagcaaggauccgacccacaugggcacagaagacuucuacugcagguugcaaaucuuacauccuugaccuaguggguaaaaaaacccuaagaaaaggcaacuuucuaaaacaaucauacuacacucauauaagcaauuaauuuuuaauaagcacugcucauauauuaaugccaauuuucuccuucacaaauuauaacucugucuuaaaccaagccacuaugaaagcggcucuaggccagacucucagcagcuaccacugcuacgguuccucaagcugcuccccugggugcuuccaggguuccucaagcugcuccccugggugcuuccaggguuccucaagcugcuccccugggugcuuccaggguuccucaagcugcuccccugggugcuuccaggguuccucaagcugcuccccugggugcuucuaggguuccucaagcugcuccccugggugcuucuaggguuccucaagcugcuccccugggugcuuccaggguuccucaagcugcuccccuggguguuucuaggguuccucaagcugcuccccugggugcuucuaggguuccucaagcugcuccccugggugcuguuaggguuccucaagcugcuccccugaguguuucuaggguuccucaagcugcuccccugggugcuucuaggguuccucaagcugcuccccugggugcuguuaggguuccucaagcugcuccccugggugcuucuagcguuccucaagcugcuccccugggugcuucuaggguuccucaagcugcuccccugggugcuucuaggguuccucaagcugcuccccugggugcuguuaggguuccucaagcugcuccccugggugcuucuagcauuccucaagcugcuucccugggugcuucuaggguuccucaagcugcuccccugggugcuguuaggcuuccucaagcugcuccccugggugcuucuagcguuccucaagcugcuucccugggugcuucuaggguuccucaagcugcucccaugggugcuguuaggguuccucaugcuaucuccccuuaagugcuguggcagcagugcagagcccacauagcuauauaagcuacucaguaagaaaaaccacacaggagcuacacgcaccacaucauggacaaaccucaaaacacaccagguggggaugucacugaaaacagccccaaaacucacuccuuccaacacugcaugaguaagcugcaaaaacugucagaaucaacucuucagaacuguggagucuaauaaaaaacuucuaacaagcagagaacgccuaaugaaaaagcugcucgauuugggcaggagagagcuguggagaggaacuuaccugcucacacaccucauccuuggagacagcagcccccauugcugguacaaaagagugccgcagacucaauucucaaagaauuggggcuguacauuuugaccuaucugguaggaauguaaaauggugcagcuguuguugaaauacuuuggcaauuccucaaaagguaaacacagaacuaugauauaacacagcaauuccacuccuugguauaugcccaaaaaguguucaaauggaaaccugugcacacaugcucacagcacuauugaaaacagaaagguggaaacagguagggcgugguggcucacaccucuaaucccagcacuuuugagaggcugaagcuggccaaucaccugaggucaggaguuugagaccagccuggccaacaugcugaaauccugucucuacugaaaaauacaaaaaguagucuggugugguggcgugcaccuguagucccagcuacccgggaggcuaaggcaggagaaucauuugaacccaggaggcggauguugcagugaaccgagauugugccacuauacuccagccugggcaacagaacaagauucggucccaaaaaaaaaaggggggguggaaacgggggccaggcaagcuggcucaugccuguaaucccagcacuucgggagggcaagacaggcagaccacuugaggucaggaguucgagaccagccuaaccaacauggaaaaacccugucucuacuaaaaauagaaaauuagccgagcgugguggcaugugccaguaaugccagcuacucgggaggcugaggcaggagaaucacuugaacccgggaggcggagguugcagcaagccgagaucacgccacuccaggcugggugacagagcaagacuccguuucaaaaaaaaaaaaaaaagauggaaacaagccaagugucaaucaagacaggauggguaaacacccugccuacacccagacaaugcagcauuauucacaaguaaacaggaauacaguuccaagacauacaacauagauggacuccaaaaacacguuaugugaaagaagccggacacuaaaggccauauauuauaugaacucauuccuaggaagucuccaaaauagacagauccacaguggcacagagucaacaguggcugaagagcugcggagaaguggagcgcuuccuucggggggaacagaaauauccuggaauagacauaauggugcuaguugcacaaaguuguaaaugugcuacaggccauggaauuguacacauucaaauggucagaguggugggguguucguuaugugagucuuuuuuuuuuuuuuuuuuuugagacggagucucgcucugucgcccaggcuggagugcaguggcgcaaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccgagucuuaccucaauaaaauuaaaguaguaugucagacucaaaagacuacaaauuccaggccaggcgcaguggcucacgccuguaaucucagcacuuugggaggaugaggugggcagaucaugcggucaggaguucaagaccagcccagucaauaugguaaaacccugucucuacuugaaaauacaaaaauuagccaggcgugguggugggcacccguaaucccagcuacucgggaggcuagggcagaagaaucacuugaacccgggaggcggaggcugcagugagcugagaucgcgccacugcacuccagcaaggcuccgucucaagaaaaaaaaaaaaaaagacuacaaauuccauucauaugaaauucuaaaauaagcaaaacuaauccacaauaacagaaagugggcuggcagugcuuggggcaguggaggguucugguuacaaaugggcauucugcggugauggaaaugucugugucaagcuggugcuuaauaccugggguaucaaaacugucaaacucauccuacuguaccuucuaaaauggcugcuuuuauuauauaaaguauacagguauaaacaucacugaagaaauccagguacaugugaaacacacaaguguggagcugaauggagccacgcgaaccaauacacaaucgucagauucagacccagaccccagcugagacggcaccucgcaaugacuugcucccaaagaaagauguucuggccagagcccuggagaccccacaccuggggacuggagaccgcagccauccaccugcaacucuguucucagacaccucugcugugcgguggccccaggaaagcagugacacaaaaagaaaaaaaaaagcuuucugaaacggugcuuuagagguuuaaccaaaauaaaacucaaccaauuuucuucaaaacauaaacuccuguucuuguuguacuuuagcacuugcuuuacguaauuucauuucuuuuuuuuuuuugagacggaaucucacugugucacccagguuggagugcaguggcgcgaucuccgcucacugcaagcuccgccucccggguucaggccauucuccugccucagccuccugaguagcugggacuacaggcgcccgccaccacgcccggcuaauuuuuuguauuuuuaguagagacgggguuucaccauguuagccaggauggucucgaucuccugaccucgugauccgcccaucucggccucccaaagugcugggauuacaggcgugagccaccgugcccggccacguaauuucauuucuuaggaauaacauuuuacauuaaagaaaauacuuugccacgcuuucacucaugauuuugcaguuccacuggaaggcugaacaucacucuggcaaguucagacauguuccauuaaucaucuccaaggcugcuugcuacaaagaagcuguuucauucaacagcaucuccuuaaacaaaauccaagccugcuuugccuuugguaaccaaaacuugauuuaaccucccaaagagggagccagccugcugcuggccacugcgugcccuaggccucagcuuccugcugcugacuggcugccugcaucuccucugcggccccggccucaugaagcugcccacugguccugugguuccucagggguccuggcacuggcaaggggacgcagcaaacccacaccgucgugacccuggucacauacaccugucuucaggaaaacuucucugugaugaaagaacccagauucacaguggugaacucuucaaaaacuauacuaaacaagggaagacugugcuagaugaaauaaccauacaugcauuuauucacaugggaaauggaucagacaauggcugccaaugcuaagaauaaauucuugaugaguuucuaagaaaucaagacaaccuucaagguugggccaagagcauggaugggaaaggcagaugugcaucugguucuguuuucugaccauaauaaugagaucuacaugaaaggaugucuugagaggagggaacagugguaagagugaagccagcagagagagcuuggaaaagagaauucagacccaucuucaaguuaacaaaaacaauuacugacucauacgaagaaaucgggaaagucaauaaaacggaugcuucuaaaccuguugaugaaguuuuucugaaguugugaaaauuuccaacaaaaaagacuaacucuaagccugaaaguauccuuuccuuucuuuuugagccacgacacccggccucuuacaaguuuuuuauuuccaaccuuaagugaauuuguggaccaaauuucaaaacaacuuuuugugaauucaguuccugcauaauauguuugguaaacaacuaaaaaacugauuccuaguacuguuucaguauuuaucaaacaacugaucguguucuauaaaaagguuuaaaaaaauaaaauucaggaacaguggcccaugcuuguaaucccagcacacugggaagccuaggcaagaggauuucuugaggcgucugagaccagccccaugucuacaaacaauaaaaaaguagcugggcaugguggucgugccugcagucccagcuauucaggaggcugagccuggaggaucgcuugagcccaggaagucgagauugcagugagccaauuucgugucacugcacuccauccugggugaccaagcaagacccuguauccaaaaaaaaagaaaaaaaaaaggccaggugcgguggcucacaccuguaaucccagcacuuugagaggcugagguagguggaucauuugagguccggaguuugagaccagccuacccaacauggugaaacuccgucucuacuaaaaauacaaaagaauuagcugggcgugguggugugcgccuguaaucccagcuacucgggaggcugaggcaggagaaucauuugaaccugggaggccgagauugcagugagcugagauugcgccacugcacuccagccugggcaacagacuaagacaccgucucaaaaacaacaagaacaaaaaacauuaaaaaauaaaauuaaaauuaaaaaauaaaaaucacaugcuuuggucauaaaaauaauaaguguauccuauaaauguccugaggucaggaguucaagaccagccuggccaauauggcaaaaccccgucuccacuaaaaauacaaaaaauuagccgggcguggugccaggugccuguaaucccagcuacucaggaggcugaagcaggaaaauugcuugaacuugggaggugggggaugcagugagccaagauagugccauugcacuccagccuuggugacagagcgagauucugucucaaaaacaaaacaaaacaaaaauuaaauuugacacugggcacagcagcucacgcauguaaucucagcacuauggaagguugaagcaggcggguuguuugagcccaggaggucgaggcuauagugauccacgaucacaccacugcacuccagcccgagcaagacagcaagacucugucucaaaaauaaguaaacaaaaauugaauuugaccugcaggggguagucacaauugaggaaucugagcuguggggcaaacuguucaaaugaagauucugacccacaggaacaaacugauccaaaagggaaauaugccagucacgaaaggacaaauauuguaugaccccccaccccuuacaggagaggugccuuggacagugacauucauaagagaagaaaggacaaauaucguaugacccccccccccaacaggagacgcaccuugaguggugacauucauaacagaagaaaggacaaauaucguaugaccacccccccgcaggagacgcaccuugaguggugacauucauaagagaagaaaggacaaauaucguaugacccccucccauaggagacgcaccuugaguggugacauucauaagagaagaaaggacaaauaucguaugaccccccccccccccuuauaggagaggugccuugaguggugacauucauaagagaaagcagauugguggucagggguuauggggagagucgagguuauggggagagggaugaagaguuaguguuaauggguagccggugucgucugggaagaccaaguucuggagagggaugguggugauggcuuugcaccgugugaaucuaauaccagagaacugcacacucaaaaaugguacaaauggucaauuuuauacugcugggcucagggaauccuuccccucagccuccugaggagcugggaccacaggcaccugccaccacgccuggcuaacuuuuguauuuuuuguagaaacaggguaucuucauuugcccaggcuggucucaaacgccugugcucacguuaucugcuucccucggccuccgaaagugcugagacuacaggcgugagccaccacaccccacuuaauaauuccauuuuaauaccgauuuacuaaacaaggaaaagcucauagaauuacuaacuaugccaucuuauuuaggcuaccuaaauucucugaacuucaucuucuaaauaaauaagaagaaauguaucuuuuaacacuaauaacuauggucauucccauuaaaacauuaaguuuugaaaacuaggguucucauuuaagccugucucacagcagcucagcucucagaauguucagaagacucugacacugcccucuccccuccucuggcacucauuuuggaaaccugcagagcaucuauugaaaaagcccaucccagcaucuucuuaaucacugguauacuuccgucugucacgagcuucauuuaaaaaaagcgucacgcucccucucccucccccucucccucucccccucucccucucccucucucccucucccucuccccauggucucccucucccucucuuuccacggucucccucucaugcugagucgaagcuggacuguacugcugccaucucggcucacugcaaccccccugccugauucuccugacucagccugccgagugccugcgauugcaggcucacgccgccacgccugacugguuuugguggagacgggguuucgcuguguuggccaggccggucuccagccccuaaccgcaagugauccgccagccucggccucccgaggugccgggauugcagacggagucucguucacucagugcucaauggugcccaggcuggagugcaguggcaugaucucggcucgcuacaaccuccaccucccagccgccugccuuggccucccaaagugccgagacugcaaccucugcccggccgccaccccgucugggaagugaggagcgucucugccuggccgcccaucaucugggaugugaggagccccucugccuggcugcccagucuggaaagugaggagcgucuccgcccagccgccaucccacuuaggaagugaggagcaccucuucccggccgccaucacaucuaggaagugaggagcgucucugcccggccgcccaucgucugagauguggggagcgccucugccccgccgccccgucugggaugugaggagcaccucugcccggccaccccgucugacaagugagaagacccucugcccggcaaccaccccgucugagaagugaggagccccuccgcccggcagccaccccgucugggaagugaggagcgucuccgcccagcagccgccccauccgggagggaggugagggggucagccccccgcccagcugccccguccgggagggagguggagguggggggggucagcccccccgccaggccagccgccccguccgggagggaggugggggggucagccccccgccaggccagccgccccauccgggagggaggugggggggucagcccccccgcccggccagccgccccgcccgggaggugaggggcgccucugcccggccgccccuacugggaagugaggagccccucugcccggccaccaccccgucugggaggugugcccaacagcucauugagaacgggccaugaugacaguggcgguuuuguggaauagaaagcggggaaagguggggaaaagauugagaaaucggaugguugccgugucuguguagaaagaaguagacaugggagacuuuucauuuuguucuguacuaagaaaacuucugccuugggauccuguugaucugugaccuugcccccaacccugugcucucugaaacaugugcuguguccacucaggguuaaauggauuaagggcggugcaagaugugcuuuguuaaacagacgguugaaggcagcauacucguuaagagucaucaccacucccuaaucucaaguacccagggacacaaacacugcggaaggccgcaggguccucugccuaggaaaaccagagaccuuuguucacuuguuuauuugcugaccuucccuccacuauuguccuaugacccugccaaaucccccucuaugagaaacacccaagaauuaucaauaaaaaauaaauaaauuaaaaaaaaaaaaagccucacacuggauaaguguuuuucaauaauuucaacguaguauuccacagcaaauugucuaguucacauuuaauucaaaauuaauucccuacguuaccacacaagcaauagacuguuaaguuuaaugcucccauggcuuucuacuuaugcaaaaaauuaacuucuucaaaacaccuaugguggaaguucuuccuguucagacugcaauucuauuuacaaaaaacaauaguacuguaguacuauuagaccacaacgcuaacgccaggcacagugguucacaccuguaaucccaacauuuugggagggugaggugggcggaucacuugaggucaggaguuaaagaccagccuggccaacauggugaaaccccgucucuacuaaaaauacaaaaauuaaucaggcaugguggcgggcgccuguagucccagcuacucgggaggcugagacacgagaaucacuugaaccugggagguggaggcuguagcgagcgaagaucgcaccacugcacuccagccugggugacagaacgagacuccaucucaaaagaaaaaaaaagaucacaaugguggaaucuaacccucuuaucuaaaauuucuuaaaguaacaaacauuuugaaaagaauaaaucuggcagagcgugguggcucacgccuguaaucccagcacuuugggaggccgaggcaggcagaucacgaggucaggaguucaagaccagccaggccaacauggugaaaccucaucucuacuaaaaauacaaaaaauuagcugggcguggggucagacaccuguaaucccagcuacucaggaggcugaggcacgagaaucgcuugaaccugggagguggaggcuguagugagccaagaucgcaacacugcacuccagccugggcgacagagugagacuccaucuuaaaaaaaaaaaaaaaagaaaagaaaagaaaaagaaaaaaagaaaagaauaaaucuguaacagcacuggaaaacagaagaaugacaugucaauaguugaccagaauuaagcaccuaaauuaacagaaaguaaaugaaaucagacaaauaacuuaaguuuagagaaaacagagaccaaacucuacagaaggaagaagccgcagagaucaaacucuacagaaagucaggaccacugcagaggaaaagcaagcuucaaggaugaaaaaccaauaaagcuacacaguuccaaguucaucuacuaugauuacuaugauggggaaaccaccugggggucaggggccgaaucuggcccaaugucuuuuuuagacaguccacaggcuaagaaugagguuuauauuuauaccugguugaaaaagaaaauaacauuuugugguaagugaaaauuauaugaaauucuaauuucaguguuaguaauaguuguaacuggaaaacagccaggcucguuuuaaguguggccccgguuccuuccaugauacaacagcagagcugaagagcugucagagaacaugcggccacaaggucuaacuggcccuugacagaaaaacugagauggaguuaaaaagacaagucugcauauuaaaagagcuucaagaugcuaaccaauauaaaaaagucacaaucuaaacccuaaaaauagcaaaaugucagacucccacauaucaacagaaaauccuacaaguuuccacaaaauccuaaaaagcuuaacuaaaaaagaaucaugaauuagacuggcguuggacuucucucaucuuuacagcagaggccacgacagagaacaggggcagcacacucuugccgugaagagcagacaguccaucgaggccuuucugugccacaccgcccgcccgcacacauccgcggaaagccugcuuucagcugcucagcaggugggaacacuugcuccuccagcauuccaccaugagacaaaggaaaaagucgcuucuguguguccaccagcacacgacucccauguacuccugcacgucacguggacgagcuaaagaagacuccucugcuccacagccaccaucacacuuucuuguuuuuguuauuuuuugagacggagucggagucucgcucugucgcccaggcuggagugcagugacacgaucucagcuaacugcaagcuccaccuccugaguucacgccauucuccugccucagccucccgaguagcugggacugcaggcgcccgccaccaugcccggcuaauuuuuuguauuuuuaguagagaugggguuucaccguguuagccaggauggucuugaucuccugaccucaugaucugcccgccucggccucccaaagugcuggaauuacaggcgugagccaccgcgccuggccaccaucacacuuucuaaaaggucagggugccaaucacaacagggaccaguaaaaggagauugugucauaaacucaacaagcugcccagaaaaagaugcuggcagaaccugcugcacuggccgugggcucaggcacaccagguaaacaccagagcgcaugcagcccacccccuacaagcaacgagcccccaccugcugacaguucaauucucugaagaagaaaugaugaucuuauuuaucuaaaacccaaaagacuuaauucucauuuaugggaaacauucacaauaggcaaauccagagagauagaaaagagaguaccaguugucagggaaagggggaagggggacaaggacugaugacacaggggaccgcaugaggauggaaacuugcuggaaugugacaguggugaugggugcacaauauaaugaauauacuaaaaaucacuaaacugugagcuguaaaugguaaauuuuguauucugugaaccagaucucguucauuuuucaaaagaaagucaucacccaacgggguaaaauuccuaaugccuggcauccaacaaaaucacuaggcaaagaaggaaaaaauacaagccucagaaaacgacgauuagugcucaaaaaaacacaaauacaaaccauaaugagguuaaaagaaauaaaccaacauagaauugaaacagguguuaaaauuaguagacaaagacauuaaaagcuguugaacuguauuccacauguucgacauggaaaauauaaaaaagacaacucgguagcagcaaacaaaagaugcaaagagccaagugugggcggcaggggcccucccgcaacucgggcauguucgagaguuuuuagagcuccaucuucagcuccugcucccuucccuggaggucaguggccggagaugaaagcccuagcccucuaauaaucaucuggucuuccuggugaccaccccuacccugucaguucauuagcuuaaacucuggugugaucugaaaggagcuaguuaugaauaacaaaugacauccuaucauauaagaaauuccaaugguugcaggaacucugugccaggagugagaaggcgcagggagaaaaagaccacauaaucuuuuauugaccaaaguugccaaacccacaagcugcaaucaggccaggagcggcggcucaugucuauaaucccagaaccuggggaggccacagcagguggaucgcuugagcccaggaguuugagaugggccagggcaacauggcuaaaccccaucucuacaaaaaaaaaaaacagaaagauuagcuggcuggguaugguggcacgcaccuguagucucagcuauuugagaggcugaggugggaaaacugccugagcccaggaaguugaggcugcagugagcugugauggcaacacugcacuccagccuggaccacagaguaagaccuugucucuaaaaagaaacccugggcucaaguggccauccagccucagccucccaaguagcugggacuacaggcacaugcuaucacacccagcuaaguuuuauuuuuauuuuuguagagacggggucuugcuaugcugcccaggcuggucuugagcuccuggucucaagugaucccccgccuuggccucucaaagugcugagacuacaggcguugcaucugacccuguaucacucuucaacacgcaggaugcacugcacagcugaucccaaaugcuguugugaaucuaaucaagauaccguaagacauacugcauauguuuuuaaaaaucagauaagacgacugggugacuugcuacccacaguguuuuguuuuguuuguuuguugagacaaugucucgcucuguugcccgggcucaaguggaguggcgugaucucagcucacugcaaccucugccucccggguucaaguguuucucuugccucagccucccgaguagcugggacuacagaugcgcaccaccauacccagguaaguuuuuuuguauuuuuaguagagacgggguuugguuauguuggccaggcuggucuugaacuccuggccucaagugaucugcccaccucggccucccaaagugcugggauuacaggugugagccaccacgcccagacugcagucuuuaucacuuuaugacacuguaaucaugaacuuggaaagaagggucuauuaacuuaguguuaacuugaaaaggaaaaccaaagcagaaaucuaaacaauuauuuggaugacuacagcaaaacuaagaggauuuggguuuaaguuguuguaguagcuaugccacauggcacagacucuaucaccuucucacccacaccugcaacgugagugcagcuccuccaaucaugaggucggggggaaagucuauuuugcaccccuugaacccagucucacucaccgauuugcuguuaccaacagaaugaagcaaaaguuggccaggugcaauggcucacacuuguaaucccaggacuuugggaggcugagacagguggaucacuugaggccagaaguuuaagacuggccuggccaacaugucgaaauccugucucuacuaaaaauacaaaaauuagccgagcgcgguggcacaggccuguaauguuagcuacucaggaggcugaggcuggagaauugcuugggaaccugggaggcagagguugcagugagccgagaucgcgccacugcacuccagccugggcaacagaguaagacgcuaucucaaaaaaaaagaaggacgaagcaaaagugaagccauguggccccugcuucugcugcccuacuguucuuggcagccccaauggccagccugcuggauguugaaacguacagggcucagcugacacccugccagccaauguauccuacaggaagaaugauacacugucaccaaguggguuuaacccaggaauacaugauugguuaaacguucaaaaaacaaaaccaaaugauaaauaaauguaaaagaaaacuauaaaauucaauguccauuccugauacuuagcaaacuuguaauagaagggaacuuccucaaccucauaaagugccuuuaugaaaucccacagcaaacaucaugguuaauggugaaaaaguggacacuuuucaauuaccaucagaaauaagccugugucagagccugcagugagccaccacugcacugcacuucagcuugggccacagggcgaggcucuguuucaaaaaaaaaaagaggaaaaaaaagaaauaagccugugauauccacucuuuuuuuucuuuugagauggagucucacucugucgcccaggcuagagugcuguagcgcaaucuuggcucacugcaaccucugccucccagguucaagagauucuccagccucugccuccugagcagcugggaauagaggcaaacacugccacguccagcuaauuuuuuugcauuucaguaaagauaggguuucacuguguugcccaggauggugucaaacuccuaaccucaggugauccacccaccuuggccucccgaagugcuagaauuacaggcgugagccaccgcaccugguugaucuccacucaucacuucuuuugaacaccguacuggagauucuaguccaagagaaaggagauaaaacguacgcaaauaagaaaggaaaaaguaggccaggcgcgguggcucacaccuguaauuccagcacuuugggaggcugaggcgggcggaucacgaggucaggagauggagaccauccuggcuaacacggugaaaccccgucucuacuaaaaaugcaaaaaaaauagcugggcgugguggcgggcgccuguagucccagcuacucgggaggcugaggcaggagaauggcgugaacccgggagcggcaguugcagggagccaagaucgcgcccggagacagagugaggcuccguuucagaaaaacaaagucaguuguacuuuuuccuuuucuuuuguuuuugacggagcucacucugucgcucaggcuggagcgcaguggugcgaucucggcucauugcaaccuccacuucccggguucacgccacucuccuaccucagccucucgaguagcugggacuacaggcgcccgccaccacgcccggcuaauuuuuuuguauuuuuaguagagacgggguuucaccguguuagccaggauggucuccguguccugaacuugugaucugccugccccggccucccaaagcgcugggauuacaggcgugagucaccaugccuauaaugucaccggccuauaaucccaauucuuacaagaaaaccaaaagcgaggaaaaaugaaguaacuuacucauggucauagcuuaucacuaagauucaaacccuuucuacaaauccugcccuguagaaaaagcgcugaaaugggaugcacuauuaggacaggcacacaaggggaaacacaccccucagaugacagugaggagcuuauccagguccaggucaacgcaggucagucugaggagaggcagccauggguguuuuguguacagacuaaacguagguagggaauacugguuaacaccauagacugagaaaggaggguaaauacuaaaguauuagucucuaagaaaucucaugaaagcagccaggugcgauggcucacgccucuaaucccagcacuuugggaggcaaaggcagguagaucacaaggucaggagaucgagaccauccuggcuaacauggcgaaacccagucucuacuaaaaauacaaaaaauuagccgggcguggccgggcgcgguggcucaugccuguaaucccagcacuuugguaguaccaggcggguggaucacaaggucaggagaucaagacuauccuggcuaacacggugaaaccccgucucuacuaaaaaauacaaaaaaaaauuagcugggcacgguggcggacauuuguagucccaguuacucgggaggcugaggcaggagaguggugugaaccugggaggcggagcuugcagugagcugagaucaugccacugcacuccagccugggcgacagagcgagacucugucucagaaaaaaaaggaaaucucaugaaagcaugggagccaaagccuuccuuccuacauccucaauuuaaaagcaugacugaggcugggcgcaguggcucacuccuguaaucccagcacucugggaggccaaggcaggaggaucauuugagcucagaagcuggagaucagccugacagcagagugagaccccaccucuguuuuaaaaguaaaaaaaaauaaauaaauaaaacuaaagcacuauugacccuccaaacuaguuacuaucuggaaauucuagcgauuuccaaaucacagcuuucgaggaacugugugcaaaaccuaaaagccugcugccccgaaguccuguguggaguggugcucucaccacucaggaauucacgagacggcaagaacucaucaaguuacccugcagcccugaaggaguccacaggaagugauucucuuugcuagaggcugcucugagaaaaagcuucagguaacaaauuaggccaccauggagacacuuaagauaugauuucaugaccagguguggugccucacgccuauaaucccagcacucugggagguagaggugggcagaucaccugaggucaggaccagcuuggcccacaugaugaaaccuccucucuacuaaaaauacaaaaauuauccgggcgugguggcggacaccuguaaucccagcuacuugggaggaugaggaaggagaguugcuugaacucaggaggcagagguugcagugagcugagaugaugccacugcacuccagccugggcgacagugagacucugucucaaaaaaaaaaaaaaaaaaaaaaaaaagauaugauuucauuuaccacccaaaucaacucacauacaacucacagcaaagaggaaacaggaaaacauguaccuuaaguccuuacucccccaguuaccagguccugaacaucagggacaauggcuaugacccucgaggcaugcagcccugccaaacaucacaugcucauuuuaucuccagacacaucuccuagaauaaaaugggaagcuguuguacccauccuugacccucaggugacuacuuuuaaaggugcucuccaccgggcagaaagagcaucaggaucagggcagaaaccuaauuccgaccaagcuuuaggguuccgagucugagagcaacuucccauccuuuuucugagacugaagcugcugucaacacugcccaauaaacacucgcaggacacagcuaaggaagacagaaaagugagaggcaaauggggaugcugacuuugcaucuucauguuccaaccugaguaucaccugugcuuuuguguuuguguggaucuguagggacgguaccaagaucucuaagucaggugcaauaucaggagaucugcacauuuacuaaggggaaggggaagggagaaaaaaaaccgucucagacucaacaauaaaccuaggaaugaaaagauccaaagcaaaggagcagcaaggcuggaaaagcuccggcggcagagcaggacccgagucaccagcacaucacacuccucugacccauuuauugauuuauuugagaugagcucuugcucugucccccaggcuggagggcaguggcacauucaugugucacugcaacaucaaccucccauuccacugcgcccagcuuauuccauucuaauggcugugcacaccguuuaaauacugaccacagagguguuacuguuuuauuagguaucugcccuaagugugccaagccuuuuauuugaggauccaaugaauaucacuuaguggaaaggaaguaaaagauaauuacaacacaacaauaaauuauuaccacagaggggagcagagagcaccgcaagaccaaaggugagaaucuaaccaauggcagaagucacaagugaaaaaagagcucaaccaugagaucaagaggcucacugggggccagacauaguggcucaugucugugaucccagcacugugggaggcugaggcaggaggaucacuugagcccagaaguugggagaccagccugggcaacacagugagaccccgacucuacaaaaaguacaaacauuagccagguguggugguacacaccuguggucccagcuacccaggacagcuuggcuugagcccaggaggucaaggcugcaauaagucaggaucacaccacugcccuccagccgaggcaagaaagcaagacccugccucaaaaaaaaaaaaggaucauugggaacauggaggccugaaggaugaguaggcaucagucagggaaaggagagaagggaauuugaggcaggaagcaaagaccucaagaacucugaugaguccauacuuacuacugaaaauaaccaaucucugccuagagaauagagguggagaaagaggcagacuggacuagaguagaauuccaccaggcccugaccagcugcuucacugaccacauccaucaucucaucucaccucauccucaccauaagccugagaggcaggcaggacagugggaaaugcaaggcauagggcaaacagccugauaguaccagggcaagcccaagugucccauccacccaaacuguggccacgagucuugauucuacuuccguucuacaaguggguccgggaaugcaugcaaauggaggagagagaagagacgcaccgcucucccacagacugauacgucauggaggagagagagaugcaaccaauucccagagacugacaugucaguauccagggaaugaggguucugaagaacaccccaggccagcagacagacccuaggugagccuggcaaucuccccacccaguguccaugccuccuuguagccaccuugcccggagugcaaggcgggugggaccugugacgugcuucuaacccacagaauguggugaaaacaauggaauggcuuucccuugacuggguugcauuagguggcaaaguugcugcgcugucacucccaugacuacauuauguuacguaagacuuagucuacugaagcagaagacucuuugcuguuuugaagugagcugccaagcugcaaggggccaugcgccaagcaaguacagggggccucuaagagucaagaggagaccucaagggacagucaacaagaaaacaaagacuugcgucccacaaucagcaagagauaacuucugccacaaccugaaagagcucaaaagcacaccaucccccacucgagccucugauaagaucacagucccacccaacaccuagauugcaaccggaugaaacccugagcagaggaucccacuaagcugugcccagacuuccaacccacagaaacugugagauaauaaauguguugugugucaauuuguuacacagcaguagaaaauaaauacacuggccuggcauggugacucaugccuguaaucccagcacuaugggaggccaagguggaaggaaugacugagcccaggaccuugagaccagccugggcaacauggugagacccugucucuaccuuauguaaaaaaaaaaaaaaaaauuuaagaccagaaauauacccccacacaucaucccauuugaaagaaaagcuuucauccaugcuacuuccuuccaugcacaaauaaugacugguugccagaaaggcagcacaggucacucuucagaacuccaaaugcucuuuccaaccuaccaccaacacacaugaugccaaccccacugagaccaaggcagccucccaagcucagagagacuccgagaccaaguucuucauaacugaacucacagcuucaauuauuucauacucaaucacuauauuccaaguuuuuuauaauuaacaaaaugcugccuucaagguuacauaugccaccaacgucaauccucagaacacugcauaacaucccaaaacuuacacauguaucauccaaauaaaaaaauaaaauguaaguuaaaucuucaaacgcaaauuugugcugaugaucuagaaggaaagcugggcccugccuggccgggagcugccuccuuucuuccccagcuuugugcagggccaccccugcccucuccucaccccugcuggugcagugagaugaggaccucaaguaaggggguggcagccgggacuuccacaauucagggcaaucucuggcaucuguuguucagucaguaauuuuccaacagacccucuugacugugacgggcagagaaaggcuggggagcucuugggucgucaguggguuggagagauggacuaacucacagguaggaaaaaaggcaaugaccacuccacuggagaacaaagcccacagcauuuaagcuggagggacaagaaaauccaaucauucugaugaugcagcuccugaggcuccguggccaagcugggaugugaaagaagacaauuccauuccccucccucaucaccaggugacugcugccucccagagagcucccucaugaaagccccguaacccaccacgcugcacuguuucuauagcaaccagaaagaaaauauaaagcaagcaguuucacaugaaaauuauucucuauuaaaaugaaauauugcagucaggaaaagaauuuugauaaagaacuagguagaagacaucgguaacauuaaugcuaauuauuuauucacuacccacacaaaagauaauuuuuccuaaaauuuuaagauaaucuuuuaucguucacacuggaagucugaaaacaguacuacagcaagucaacaacaaacaauuacaaucaaaauucuguucuaugcugugauaucuccacgaaacacaaaaugcucucccaaguuuaaagagggauaaggaacacgaaaacaacugaccccggccaggugcgggggcucacaccuggaaucccagcauuuugggaagccaagguggguggaucaauugaggugaggaguucaagaccagccuggccaacauggugaaacccugucucuacuaaaaaaauuuaaaaauuaaccaggcgugguggugggcaccuguagucccagcuacuugggaggcugaggcagaugaagugcuugaaaccgggagguggagguugcagggagccaagaucacgccacugcacuccagccugagugauagagcgagacugugucucaaaaaaaaaaaaaaagaaaaagaaaacaacugagccaaacaauggagaaaacacagaaaauaugcaaauuaugagaacaaaaaaaauucagccaaugccuucucacaucaaaauaccaaaacuacaaagccaauuucagguauaccaacccauucucaaaagaugaaaucaaauucaaaugaaccuaucuuugccuaucuuugacaucccuaaagccaccugugacuugucacagccuuaauaacccaccacaaucgggauggucauauguccccugaagucacagaaacagaacucucaacuagcagacuguuaacguguccuauuauccucagguucuuggguuauucguagaauagcaaagcaaacuaccugcuuuguaacgauaucauuuacacaucaacaucaggaauaaauacaaaccaaaaccuggccaaaccaggagaggugccuggaccaggacaggcagacccaacgccuacgcuugcuucuaaccagccugggcaggugggcagguuacaacacacuccugacucagccagguggggcucugcagccuggcaguuacagacacugagaccucaagccgcaggcacuagccugccaaaaaagacuucuccuccuuggucucacagccaacaguuuggacacauauccuagagguauacuacacuuccagcaaagagaugggggcccaaggcccaccccaaaccacuucauccuccccucaccacacucugaaucugguucucucagaggcaugaugagagcugggguggagagguguggaaaagacacaguccugacuucagagucccucugggcagacucaucucacaguaucgcguaacacacaacacacguuuauacacgggcacagacuggaacacaugauaugguaacaaucuauaauacgaggagcucguuaagcucagagaugaaaggggaagugaguggaagaccacaccgugagcaucuauuaauaaaagcagacggaguaagaaacagagaaaaagguucuccuuuggucuugucuuucuuugucuacuauuuaaaacacgagagaauuagcuaguuaaauuuauaucucagaaaacaggcacaauagaaguauaaaagccaucaccuuuaagucauuuccccuuuuuuuuuuuuuuuggagacagagucucacucuggugcccaagcuggagugcaguggcgccaucucggcucacugcaaccuccaccucccauguucaagcgauucuccugccucagccuccucaguagcugggaugacaggcaugggccaccacgcguaauuucuuuuuuuucucucugagauggcgucucacucugucacccaggcuggagugcaguggugcgauucuggcucacugcaaccuccaccuccuggguucaaccgauucuccugccucacccucccgaguagcugagauuacaggcgccugccaccacgcccagcuaauuuuuuguauuuuuagaagagacaggguuucaccauguggcccaggcuggucgcgaacuccugaccucaggugauccacccgcuucagccucccaaagugcugggauuacaggugugagccacugggcccggcaguauuuagcauuuuaauaauaaaaauauuggagaggccgggcgcgguggcucaugccuguaaucccagcacuuugggaggcugagcagguacaucaccugaggucaggaguucaagaccagccuggccaacauggugaaaccccaacucuacuaaaaauucaaaaaucagccaggugugguggcaggcaggagaacugcuugaaugcaggagaacugcuugaacgcaggaggcgaagguuucagugagccaagaucacgccacugcacuccagucuggggacagagcaagacuccaucucaaaaauaauaacaaaaaauuaaaaaaucagaccuaauauuuguuucuugguauguauucuuucuauuccaauuuauuauggcuucaaaagaagcccaaaaaaucaaaaaagaaaaauaaaacaauggcuuaaugagaggagcgcuuaauaaacugaaauuuuguuuaacacuuucaggaacaguucccaacguuguugucagggcacagugacaguggcccagcugccucgccagcagcacacacaggccucuggggccagcagagaaacacucccagugccuucaagaaccccauuuucacauccaggguccaggaaacagacaugcacgucggacuaucacccuagugagaaagaaggaaagccacauugggguugguuuuuuuuuuaacguccuucaaaucuauggaagacauccucuucuacacaacucauaggaaaaaagaucccucugagguuaagcaacccgacgccuccacaccacaacugaacauccuccuacagcccccacccgguaacucauuacuuuccaaagagaaugggucucaaggucucaaggacccacugcccuccaaaaaagcaaccuggacauccugcugacaacugagcaucauacaaaugugucccuuucguccccgcugcccuccaacagucaccccccagagcgaagcugccuguacaggccacguccucuccuccagcagccggcuacgcgcagcucuccggcacagccaucaccugcaccacuaaagcggguggcaguuucugcccgugacauuucucauuaggacuuuccacaauucuugaggcuuaaugcaaauuccuuauucccaugacuaacaucaaagaaccacaccuccaaagacugacacugggauuauuccuaaauuucucaaggaugagguaaucuggagguuaaacaugccugaacugagcuguccucacuugggcccuccagaccuuucacuuguuggguguguaaauaaugacccaacacuuuuucuuuucuuuuuugagauguucucacucugucaccggggcuagagaccaguggcaugaucucagcucacugcaaccucaaccuucgggccucaagacccacaccuuuggcagcuguguaacuaguggguccuccuguuccuguggacagcagucccaucaacagcaagucacgccaccaccuaccccacaacccaacccagucccugaagauucaggugacaguuaacugacgucaagagagugcaacaucacuagaaaaacauuaaugacggccagacgcaguggcgagacuccacucaaacaaaaacaaaaaaaggaaaaaaaaaacacuaauuacaaggaaaguuugccuccuagauaaaacacaugugaccugauauaaaaaauaucuaggccuggcgcaguggcucacaccugcaaucccagcacuuaaggaggccgaggcaggcggaucaucugaggucgggaguuugagaccagccugaccaacacggagaaaccccaugucuacuaaaaauacaaaaaaauuagcugggcuugguagcacaugccuguaaucccagcuauucuggaggcugaggcaagagaaucauuugaacccaggaggcggagguugcagugagcugagaucacaccacugcacuccagccugggcaacagagcgaaacuccgcccccaaaaaaaauuaaauuaaauuuuaaaaaggccagacgcaguggcucacaccuguaaucccagcacuuugggaggccgagggggcggaucacgaguucaggagauugagaccauccuggcuaacacggugagaccccaucuccacuaaaaauacaaaaaauuagccgggggugguggcaggugccuguagucccaaccacucgggaggcugaggcaggagaauggcaugaaccugggagucggagcuugcagugagccgagauugugccacugcacuccagccugggugacagagcgagacuccaucucaaaaaaaaaaaaaaaaaaacuagccgggcgugauggcacacaccucuaaucccagcuacucgggaggcugaggcaggagaaaugcuugaacccgagaggcagagguugcagugagcugagaucgugucauugcacuccagccugggcaacagagcaagacucagucucaaaaaaaaaaaauuaagucuuuccugccaaguauuauugccuuccuucucagaccacaagccuuuuuaaaaauccuaacuuuuaggccaggcgugauggcugacgccuguaaucccagcacuuugagaggccaaggcggguggaucacaaggucaggagauugagaccauucuggcuaacauggcgaaacccugacucuauuaaaaauacaaaaaaauuagccgagccugguggugggugccuguagucccagcuacucgggaggcugaggcaggagaaucgcgugaacccaggaggcggagguugcagugagccgagaucacaccacugcacuccagccugggcgacagagugagacuccaucucaaaaaaaaagaaaaaaaaaauccuaacuuuuaagauuuccaaccaaauauuaauuagguaucuauuaauaugugcauagaaguaacagaagauauaaaacaaaaacaaguccaagaugagccuaaccauguauuugggcaaacagaauccccguucuucuuucuauacuccuucuagcagcaggcuucaaccuccaaaaucucuaacccccuucuguuuggacccaaaaccacuaucuuggcccacauuuuacacuguccugacaaaauaucugagggcaaauaccagucugccuuggccauuaaagucauuuaggcaacacaucugccgagcugagcagagccagcagguacccaucuaacacaaggcuccguccugggcugugccccucaagaauuccccagauagccauuuccuuuccucaacugagaugcccacuucucccuccagaaugugggcaaaucacaccagugacguccacaucugucaaauguccccagggcagagaauggagagugacacacaguaggcacaaaauaaacagcacccagcuucugccccaccaccccguuccccauuccugcuuucuuuucugucuccuuugcucuaucguuucacaaagccacucuccuaacuaauguuugccccauucccuccacugggaaucaauucaucuucucuuuuuccaagucuuuuuaaugaauaccaguuaacaccaugaagucuucacaauucaccuacacagugugcuuucgaguccccuucccuauuucaaguuucuccagguucucuuguagggaucuucuuaaggcugcaugugaugucuugugccugucaucccagcacuuugggaggcugaggcaggaggacuacuugaggccaggaguucaacaucagccuaagaaacauagcgaaaccccauuucuacaaagaauuuuuaaaaauuagcgcacgucuguaguucuagccacucaugacguugacgcaggaggcucacuugagcccagaagcucaaggaugcagugagauauggucacgccacugcacuccacccugagugacagagcaagaccuugucucaaaaaaagaaccauuuaggcaccaugguguugcaaagccagugcuuucaucuaggcauccaccgccugcaaacucugacacaucaucuucugccucaaaacaaguaagcaaaugaaauucaggucuaucauugcaaacccuacacaacccaacuccagucaugcuuccagguuaaucugcugucaucuuccaucuucuuggaugggcuuucguguucagacacgucuggcugacauucucacguuacaugcggccuucccagccuuuguccccagccuucccgaagucgaagaugcccuuacucugauuucugcagugacauucuacugauucuuuuuuuaaaacagaaacauagcuuacaguuaaaaaaaaaaaaaauagcacuucuucccuuaaaucucccaggucacagagccuuucccuccucugaucuaugaucucucuuuucauaagaaccaauauuuaaugcaagcuuuagucaacuaaaugcaucuuucucccagaucucagaacaggaggccacagcacugcacccagugagcagccaaugaacaucugugaaggaaaucagugaaacaucagaaaaagcagaguuugucuaguuucagaagucccuucuauaaaacauguagcuccuuccagcuaaaagaagacacaaagcuguucucccacuguagagcacacugcaccccauuuggaaaagcagucaggugagccacacgucagccacaccgugcuuuacaaacaugccaaugugugaacggucagucacaaagacauaaaaaaagaugacugcccucaucaaaacugccaaggucaugaaaaacagggaaacgcugagaaaugguugcagacgagauuaaggagacaugacaacuaaaugcaaugugggaucccggauggcaucugaggacagcaagggaacauuacuggaaaaaccuccagcuugcucaccccuggaaccugugaaugccuuagguuacguggaaaagggaacugagguuacuaaucagcagagagggagaugaccucgcagugcucgggugggcccaauuuguaaccacaaggauccaaaagugaaacaagggccaggcacaguggcuccaugccuguaauuccagcacugcuggggggcugaggcgggaggauugauugagcccaggaggucgacgcugcagugagccuugauugugccacugcacuccagccugggcaacagagccgagacucuccaaaaaagcgggugggcagcaggagucagagagaugccaugaggcuggcuuugaagacugaggaaagcacuacaggccgaaugcaggcagccucuggaacacggaaaagacaagaacacagauucuccccuggagccuccagaaggaaccagcccuaccuacccagauuuuagcccaggcagaucauguuaggcuucuaaucaacagaacuauaaaacaauaaaucuaagguuauggugguuaguuacagcagcgcuggaaaaccaacacgggcagcacugacacaagucccagcacuucuccaacgcccaagagcuguucucugucucccuuccacacccuccauuugccuucacucaucccccugaaccaauauauuuaugggcuuagaagaaagcuauuaaggaaaaggcacagauuaaguucuaagacagauuuucuccucaacucucuaaaacuucaccguaccauuagcuucuacuaaauguccuuuuuuacaagagucaguuucaacaucaucuucuuuuaaaagccagucaucuggugagaacccaaguuuagcagaaucagaucuaaagacuuugccaaagaaaaaucaagcaugaauguaaaucucauugaauaugcuuaacauuuuaccugaacuguaagugcaagcgugcaucacuuuucugaguuucacacuaaaagauaaaggauacaauucaaagauaccucucgcaugugucaggggaaaaaugccugugagaaaauguuuaggccgggcaugguggcucacgccuguaaucccagcccuuugggaggccaaggcaggcagaucaccugaggucgggaguuugagaccagccugaccaacacggagaaaccccgucucuacgaaaaauacaaaauuagccaggagugguggcgcgugccuguaaucccagcuacucgggaagaugagguaggagaaucgccugaacccgggaggcggagguugcggugagccaagaucaugccugggcaacaagagggaaacuccaucucaaaaaaaaaaaaaaagaaagaaaauguuuugaguguuagcauauuuaauauauuaagcucuaaagaacuucaaauuucagauagacuauucucaaaguaacaaaaauaucuauguauguaauuuaaauaaauuaggagccaaacauacaauuauagugaagaaaaaauccacaaagucuaaaaauuccuugaaauccgaaucaacuguggggcuguggaauacuaacacuacaagcucucgagacgcucuucggcugccugaaagcuggauuucuucuuugucaccaucagaaaaggcaaagguuauucagugcucugcacauccuuuaaucagccagacaucuuagucaaaaucauuuuuaaaaacuuaauccuuucaagaguggugcucugggguuuuuuugguuuuuuacuuuuauuuccuguuuugcaagauguaaaaccacaucuagaaacaugguggauacuaacaaagcuugauuucuuaagagaaaaauaagguccuucacugcgucuuaccuucucuauuuuagauaaguuuaaacaguacagccauaaugauuucaaguuuacaucaucauccagaauuaaaccaaagucuucuuugauugugucagauaugaaugcagcaguaagcuaauccuaacucuaguaaaaccucaggaaccaagcagccuacgcaaucuucccuuuacuuggaaauacugcauuccaaaauuuauucuaagccauuagcauccuaagucugaaaagagccauagggagucgaggaagggcaacuuacuaucaaugcaccaagaaaagagguuuauuugcuaauuuuacauaaaaaauaaccucugauaucauaaaguuauuaggcauuuacaaauaacauuucaauuucagccauucuuaaaagucacauuuuuuagaguuaaguaaugaaggggaaagucuucugaauuuuaccaugacaaaagaaauuuucauaugguauaaaaaugguuuguugagaaaaagccaacauuuucaaauaaugaacagguacacauugguugcuuuacacguggaaaaaagagcccuacagauuuccaggauaauaaauaauucacugcacagaugcgaaggacaggccuggaaacaggucucacccuccaccagccacaaggacgcuguaacugagacagcagcacccugacagcugucucaaccuugaccuccaagaggaagagagaaagcggguguggggaagcccagaagacuggauuuucacucaacaggauucgguccucuaggccccugaaaaaucucagccauacagacaggacggcuuacuuuuauuuucacacugaaaacccucuuaacccuuuauucacagagccagcuuuagcacugugggguuucuggcuaggcgcgguaguucacaccuguaaucccagcacuuugggaggccaagacggcuggaucaccugaggucagggguuccagaccagccugaccaacauggggaaaccccaucucuacuuuaaaaaaaaaaaaaaaaaaacacuaacugggaguggugguaugggccuguagucccagcuacucgggaggcugaggcagaagaaucacuugaauccgggaggcagagguugcuaugacccaagaucgugccacugcacuccagccuaggugacagagacucugucucaaaacaaaacaaaacugugagguuucuuagagcuagaauaguaucugaauguuuucaaccacaaucaaccaguuccccuccaccaaauacccuagccccuuacuguaaacccaaaaaucuaaaacaagucgcaaucucccaaauauacccacaauuagucuuuaaaaagcaaacuuuugccaauuacauaacaguuucauuuacaaagaaacuuugaaaaccuaaacauacagaaaaaaaucaauagggcacaccuccauuucguugucuuucccuccaaagagaucauuuuuucuucauuaaaaugcuaaaacuuucauaucacuccaccugcucagcuacaugugaccagaggggccuccggacaaacgagacacuuaauccucauaagcagcagcagcaaaccacacuuaguccagacugauuucaacccauccuuuacagucacugagaccuugauggaaacgaugaggaaaucugaauaaaaacugcuucuggcccuucuacucuggccugaaaacagcaguccugcuaaaagugcuuucacagaaagcacuuucuucccacaaagacaacucucccuuuauguuucuuuaucucuuguucugccuuaauugugaaaacugucuucccaccuuuaucuaaguuauaaaagcaaacuuguaaugaaaacaaaagggggcugagcacaguggcucaugccuauaaucccaacacuuuaggagacugagguaagccaaccccagaaggcugaggccuacacaacacaggaagacccuguuucuacaaaaaguaaaauaaauuagcugggcacggcggcacaugccuguggucccagcuacucaggagucugaggugggaggaucgcuucagcucagggagucgagacugaagagagccacguucacgcaacuggccgcugcccuccagccugagcaacacaccgagacccugccucaaaaaaaaaaaaaaaagacuuacuaaaggaagugauauuacacuaagacgcaaaggcugaguaggaguuaucuuggaguuuggggggaucugcaugagauggcagcgagguaugucgaggccaugccacaaacuauggcacauggcccaacugaggaaaggcaaggccaacgcagccagaaugacuggaagcuuggggcagggucaagaauggggcaugguaucagaguuaggccacagucaccauuugggacguuaucauaaaaauaacauuugaggccaggcaugguggcucacgucuauaaucccagcacuuugggaggccgaggcagguggaucacuugaggucaggaguuugaaaccagccuggccaacauggugaaacuccagucucuacuaacaauaaaaaaaaauuagccguguuugguaggaggugucuguaaucccagcuacuugggaggcugaggcaggagaauugcuuaaacccaggagguggagguugcagugagucgagaucaugccacugcacuccagccugggcaacaaagcgagacuccgucucaaaaaaaaaaaaaagaaaaaaacaauuucaaauuaagagaacacacacugaaaacauuucaaaauuucaagacaauaacuuuuauuugaauucauuccauuuuucuauaaaguuuaucaaacgggccacacugaauucccacagagcacugacuacacaagagucacaaacugacgcagccaccagacaagggaugcaccaucauuuucaccgauuaacuacaaauaccuugcuauuaagagacacucacccauuacacuuacgauuugaggaugaagggaguuacacagaguaauggacagaucaaaacacuuauuuuggcaacaaaaugcagauuauuuucugagccagcauuuacugauacucucuaauuauguuauuuaauugaugaugggcucucugcccauaugcaaaauaagacuccucuuauauuugaugaagcauaaccuuucuaugucaaaucuacuuaaaaaggcacaaaaagaggccgggcgcgguggcucacgccuguaaucccagcacuuugggaggccaaggcagguggaucacaagguuaggaguucaagaccagcguggccaacauggugaaaccccaucucuacuaaaaauacaaaaauuagccaggcguggcggugggcgccuguaaucccagcuacucgggaggcugaggcagagaacugcuugaaccccaggagacggagguugcaaugagccaagauugcgccacugcacuccagccugggcgacagagcgagacuccaaaaaaauaaaaauaaaauaaaauaaaaaggggcacaaaaacuucuuggaaaaauacuguccaacacaaacagcauaguuuccuucacucuauuuguagggaguucuacuugccaccguaucaacacuguaauuaccgcuaacauggcagccgcucgucaucaacagcccaucugggagggugugauggcacugcugguauggggugcccagcauggccaguccggagaaaagcaucuggcgguggcaaugcaagucagaaggcugacgcaaaugagagcugcaaaagaggaacucagguuuuaaaggugacaccuuuaaaaacaaaauucugguaaauuguguuauguauauuuuacuacagcaaaaauagaacagaagaaaaaaacugcugaaaguuucaaguuuaggucaaauuuagcacuaucuuguggggaacuuuucaacaaacuuaagaggcaucacgaagaacagagaaaacgucacagcaacuuggucuuuguucccucccauccaguuccauucagauggccagccuaucgaaggagauccugcucuucggggagaaacuacagaaagaggagaacaacagcugaauggaggguaggggaggccacaccaacuauacgagauccaaugcaagggucacaaugaaggcugagcaagacauccgccccccccccuuuuuuucuaguuuaacuacaguugcagaguaaaaucagaggacuucuguaaucauucucuaacagaacucgaagucuuccagggcagccaauacuuacuaagagaaaucaaggucucagagaaaccaaagaaacagccucagggucuccgauuuugaacguuaugccauagacuaggucugcacacaacaaaaacaguaacuguuucgauggcacuuuuuccacagguaauaucaucuuauauguuuggcuaagucucaacaucccaaaaaggaucaaaagauucucuaaguuuugcaguucaacaacugugcacacuuuuauuucucauuucaaguguuaaggauauugcucuaaugacugcauaaaacucucuccucauguaagaaagccugaaaucuaauuucucuaccauaaaacccuguucuugcaaaaggauacaaaacuacucauaaucuacaaaaacgaugaauccuaagcauguuacauagaaggaaaacaguuucaaagcauagggagcuguuagaccagcuucaucuucccaagccucuuccaaaacuucuuggaagcugauauauaacacuaaccuuccaaaaacacaacagaagcagaaaaucuuaauggggcaccaggaaaagagcaagccucgagaaaaaucaagacuccccccgaccaaccuucccaaauaacacaaacacaagaguuaacaguacaaucccucuuugagaggggacugaaucaauguggcagggccaacccuacacacacacacacacgcgcgcgcgcgcgcgcgcgcacacacauacaccacacacacagcuaccgcccugccaggggaugaugaaaugaggaacggaaauuaacauuucaggcaacgucucacauuguuccuugaggccaagggcugcuguugcagccgccaccgccaccgcuuuccucccagccaccccccacacccgcccgccuacccucccccuaacaccccccacacggcugcccgcauuccugccccuccucggccuacgcgcgccuccugcaaccccgacgcccccagguccccaguucgcccucccccuccggcucggagcccgagagccgccugcucucauuucaaaacagcgauaauaauagggacgcugagaauaacaacuacgaccagcacggcgaaggcgccccucucgcgggucagaggucggcgccccagcuccgcagaacccggcgcccggccagcgcccccuggcagccccucccggcagccucagguccccaagaccugcaggcccgccccgaagccccccguccgccccucacggccgcuccgagcccccgaggcccgccccggagcccccuguccgccucucacggccgccccgggcccccacggcccccaggcccgccccggagcccccaaucggccccucagagccgccgcgggcccccggccacccaggcccgcccggagcccccguccgccccuuacggccgacccaagcuccgccgaccucccaggccccccccggagcccccuaugggccccucacggccaccccgggcccccaaagacccccggcugccccgaacccggacccguaggcccgcuccgggacccauuauuggucccucacgaucgccccgggcccccaaagacccccgcccacccggccccgaccccccaggcccgcccggaggcccgcggcgcagcuccgucgccggggaaggccugcaggccgcaaggccgcgcgaaugccccgugcccgccccgaccaccgcccccagaccagcggcgccucucaccgugcuccgagggcugcgcggcuccgcgacggcucagcggcggggcgcgggcgcugcccaugcagcccgcggccgcguuucccgggccgcgcggcccgagcggcaaggcggcggcggcggcggcgcgggcucgggcccggcagagcugcgagggacggcgggaggcgagcccgccccucgggcgcgcccacggcucgggcgagagccgcggcucccggugcggacgcuacugauggggcgucuggccgcgggcucggcggcggcgccuccccggcuggggcccucgguccaucgcgcaccgucucagggcggccucu

SEQ ID NO: 191995 - RNA, 19381 nt, Homo sapiens
uuagaaugacagcacagguaauuuuaauguaauaauaagugcacguuuuuauuuacagcuauugguuuuccuuuucuucuucuccuugaugggccugcugucgucacaucugaccucaaauguaagucagaccuuaccagccaagguguccucucccacugugggccaggcaggggcaccaggcagccagcuuccaagucaggguuuccagacuagcucaggagcuccuuguguuugcggaagugugagugagaacucccaggccguggguuuuuuuuuuuuuuuuuugagaugggggucucacucugucacccaggcuggagugcaguggugugaucucagcucacugcaaccucagccuccuggguucaagcaauucuccugcaucagccucccgaguagcugggauuacaggcgugagucugucacacccggcuaauuuuuguauuuuuaguagagacgggguuucaccauauugccaggcuggucuugaacuggccucagugauccgccgaccucggccucccaaaguguugggauuacaggcaugagccacugcauccggccugugggccuuucuuuuaaugucuuauuugaggacguggugcagcagccuuggugugggugcucgaagucccuggccuccuaccugagccucuucuguccagaggcccaguauuaccuucuauagguaaaacugucaccaguuuuaagacuuacaauaagcaaagaggaaaugcccucuucugugcugagggcuguacccuccuacccaugggagcaccaggucggccauucucaggguuggucuccugcgguuuacagagcaccacagaccugccaaaggcuuuccacguuugugcagcaauccucgaguguuuagagaagaggaagauauccuggcuggcacucuuucaguugacagagagugguaagaaacacgcugcugaggcacaaaugcggagggccgcucuuuucagaggcaucuugcaaaugguuaagaacgagcccuccuugagguuccuugcuaaguaaguuuauaagcuccauuuuaguugggacagauuaagcacaaacuuguuuaaagcaauaagauaauuuacuggcucacuggucaaccccaggaccaaugggccuaucauggggacugccucucucugcaccacacccacccuccugcaagaggucgacccccccauccucucccagcugcugacagguaccuggguauccucagcucaggcuguucgccccacacuauccccacagccaggccucccaggguacacgucccgacccccagggguguccccagcacugauaauaggcagagauguccagaguugccugagccacuucuugguguugcagaccucaggcuggggcggcuccuccuccguguggccccggaucagcacaccaggcugcugccuuucgcuuuuuacagguaccuccacccacagggcuggucagggcugggcaguguuucccagacccccaucucagcaccucugggucccgccagaugggaaggguugucugugccucugcuccacagaugagcaguaucccuuggcaucaccugcuaccuuuccagcagucuguagccauuugucacuaugucuuuaccucuagucuucucuccuacuuccaugaagacgcggccaucagggaagaggccuuccugcauguugcuguggacauguacuugaagcugguccagcucuucguggcuggggauacaagcacaguuucaccuccagcuggcaggagccuggagcucaagggucaggcaggugcaagggccagucccaccuccaggggagcuccccccagccggaggcuccuucugccaaagaauguuccggcacagcaugcagacuaugggggacacaccagcccuguuucuguaugucuucuaaccugugaguuugccuguuuucucucuagggcaaccccguggaacugauaacaaaagcucgucuuuuucugcugcaguuaauaccucggugcccgaaaaagagcuucucacacguggcagagguaacgucaagaugcccaccuugggccaugugggggacaugagaauugacagcugccugggccaugugccugccuggcuggcaauacaacucgacuauuucugccagagccccuccccuguggucugaggccuagugggcggcaugggcugaggaccugcuccucucucacagcugcuggcugaucguggggacugcgacccagaggugagcgccgcccuccagagcagacagcaggcugccccugacgcugaccugucccaggagccucaucucuucugacgggaccugccacugcacaccagcccagcucccguguaaauaauuuauuacaagcauaacauggagcucuuguugcacuaaaaaguggauuacaaaucuccucgacugcuuuaguggggaaaggaaucaauuauuuaugaacuguccggccccgagucacucagcguuugcgggaaaauaaaccacuggucccagagcagaggaaggcuacuugagccggacaccaagcccgccuccagcaccaagggcgggcagcacccuccgacccucccaugcgggugcacacgaagggugaggcugacacagccacugcggaguccaggcugcuagaggugcucauccucacugccguccucagguggguucgggcuucaccgccuggcccucuguggucacagaggggcucgguggcccagguggugguuccgccuccaggggcagggccuuguccugggucugugucagcgggugcaccauggacauguguacauugagguugugggccuucucaaaccgccggccacacuggucacaggcaaaguccagcucagucucagccuuguguuuggucaugugguacuugagggaugcccgcugccugcacuggaacccacagaccucacaccugggggacagaggcagauaagaaggugcgagggccacagcccugggaggggguccugacucacacuuacugcaaaggcuuggcucccgaaugucgcauuugguggacgagaaggugcuuccgcugcuugaagguuuguccacauucgucacagauauaguuccgcaccucugagaggggagaguccagugaguccaggccccugaugcuccaaccucccggggggacgacgaugacaaugugaaaccaucacagcugggaagacauuucugcacaugguucaccaugcagugggcccaagcaaggggccuaugagggccucguuuauuaagaucuuuaaacugcuuuauacacugucacguggcuucaucagcugugugcauuucaggaugguuuuuaaagaaaccucagaaagcuauuuccuuaaccacagauucuugucuuuuuuuuuuuuugagauggaguuucgcucuguuacccaggcugcagugcgguggcgugaucucagcucacugcaaccugcgccucccaggcucaagcgauucuugugccucagccugccaaguagcugggauuacaggcgccccccaccacgcccagcugauuuuuguauuuuuaguagagacaggguuuacaccauauuggccaggcuggucuugaauuccugaccuugugaucugccugccucggucucccaaagugcugggauuacaugugugagccaccgugccuggccuacaaauucuuaaaggaagccguaucacuaagguuguauagaauacugauugucacagcuauggcuguucucuagaauucaucuccauaugagagggguccauacccagggucuggggguaugcauugcuguacuggcucuggaaaucuuucucacacccuugaacaaagagaucucacuugcuaguccacaaaugccacauguggacaugcagacccacucacccugugcugccuccacaucugucaagcccugaaacgcuucacaagacagacuuuucucuucgaagggaaacccuaucuuggcauuuuacucuacgcuguucuuuuuuuuugagacuugagucuugcucuguugcccaggcuggagugcaacagcccaaucucagcucacuggaaacuccaccucccagguucaagggauucuuuuuuuuuuuuuuuuuuuggagacagggucuugcucuguugcccagguugaagugcaaugguacaaucauggcucacuauagccuggaacucccaggcuuaagugauccuccugccucaaccucucaaguagcugggaccacaggugugcaccaccacacccagguaauuuaaaaaauuuggggggccggugcaguggcuuacacaaagugcucaaucccagcacuuuggaaggccaaggcaggcggaucaugaagucaguucaagaccagccccagcccaaucaauaugguaaaacccugucucuacuaaaaauacaaaaauuagccaggugugguggcacacaccuguagucccagcuacucgggaggcugaggcagcagaauugcaugaacccaggagguggagguugcagugagcugagauugcacagcugcacuccaggcugggcgacacagacugucccggaaaaaaaaaaaaaaauugggggcugggcacgguggcucaugccuguaaucccagcacuuugggaggccaaggcaggcaaaucaccugaggucaggaacucgagaccagccuggccaacauagcaaaaccugccucucuacuaaaaauagaaaaauuacccaggcgucauggcucacgcuuauaaucccagcacuucgggaggccgaggcagguggaucacaaggucaggagauugagaccagccucacuaacguggugaaaccccgucuguacugaaaauacgaaaaauuaguugggugugguggccagcaccuguagucccagcuauuugggaggcugaggcaggagaauggcuuuaccccaggaagaggagcuugcagugagcugagauugugccacugcaccccagccugggcgacaagagcaagacucagucaaaaaaacaaacaaacaaacaaaaaaaaacacccccggcgugguggcagaugccuguaaucccagcuacucaggaggcugagacaggagaauugcuugaacuagggagguggagguuacagugagccaagaucgcgccacugcacuccagccauggugauaagagugagacuguuuccaucaauaaauuaaaaaaaaaguuuuugguaaagacggccucacuauguugcccaggcuggugucaaaauccuggccucaagcaauccuacugccuuagccuccaaagugcugcgauuacaggcaugagccacugcacccggcccaauuucagguuuuuaaggaacugcugguugugaccaucagugaccggacagaugcagagucugaaggaccaaacccaaggaagugcugccaucaggagagaugucggagaacccaaaaaauaacaacccgcaugucgggagaugacccagcagugaaaagcaauccuaaugaaaaaauacuucaguaaauucaaguaagaauaaauaauucuuauucuguaauaaguucaaaaccaaggaaaacuguguguguaaggaucaauauacaguuguccucagcugguuccaggcccccccccaccccuuaccaaaaucugcucauacugaagucccgaaguuagcccugcaaagacccuacagaaccugcacuuaggaaaaggcagcccucugaauaccagggauucgagucccugaccauggauauguggguccacgugguucaaacaaguuuuuuuuuugagacagugucucacuguugcccaggcuggagugcaguggugugaucucggcucacugcaaccuccaccuccgccucccaaguagcugugccuacaggcgugugccaccacacccagauaauuuuuguauuuuuaguagagaccagguuuuaccauguuggccaggcuggucuugaacugcugaccucaggugauccacccaccucagccucccaaagugcugggauuacaggugugagccaccacgcccggccaaguuugucauuuugaaaacauauccuuguuggauuauaaaaguaacuugugcauuauagaaauugugaaaaauaagacgggcacagagacagcacccucagucauaauucccccauccgccuccggucuuaaugacacgaccuacacacaugugaaaaggcagaaccacacgugccucccgccuguccacgugggcagcuccccagagcuggugugccuucaugccuucugccuugccuuuuaagauacacuuguuugggccaggugcagugcucacaccuguaaucucugcacuuuggaaggcugagaucacuugaggucaggaguuagagaucacccuggccaacauggugaaaccccgucucuaccaaaaauuacaaaaauuagccaggcaugguugcgggugccuguaaucccagcuacuugggaggcugaggcgggagaauugauugaaccugggaggcagagguuguggugagccaagauggugccacugcacuccagccugggcaacagagcaggacuccgucucaaaaaaaaauuaaaaaauaaaaugaccaauuugcaaaaggacaccaagauugcuuggcuauuaguuuugacaaacugccuagauccuggggaagucaggaauuccuuccaucacagggaagggcagauucacacugacgcccuacucuagccuucaucuaccaacgugacugaguaccaaagaccccaugagccaccuucacgcacccccaacucuuggggcggggauggguaugaggaagacuggaaagcaggucacgugccccuggcugucacccgcgugggcgacacuggcgauaggcguaccuguguggaugagcuucacguggcgcugcagguagcggucgaucaugaaaaccuuguugcagccagggugggggcagggccgcucccggaccuccucguggugcuccuugaugugcuucugaaggagagacucggugagagacccucagagccgcacccgggccacauggcacgagcccucaguaggugacagcugaggccccuggaaggcagauccaacuccuccuccagcgacaccacuggcuccuucacagcuucacuccaagaaacuucuagaccccccggggggugucucaagugaaagucuggccucacaucuacccccaaggauggcacuggcuaggacugcuucaggucucgguuaaccuaggucaaaguguccuugggcgcaagucugaguuaggcugcagaaacaccugcuaccucccccagguucacacugacagcugccgggccugggucaggcacagccagugcucaccuucaugccgucagcgccucgguacacggccgugcagcccugguaaggacacuuguagauggugggaagcuccucccugcaaugaagagcaugcauggagccccggccccgacaggcagggcgagccucgcguugcaggcaucaccucucacaacgaagcuucuucuuccauccgggcuugggucccggcuucuuccgaauucuugguucuucagacuucuuggcuucuuugcuuucacucuucuuaccagagacucugaaaaaaagagguucccaaauucaaugguuucugaucuccauuugcaaaauguuuuuugucucuccaaccugagaaauggucuuuucugaagcuucccugaguugcuucugugcugacugacccucagaaucuaccugaagccaccaaagccagagcaacucuggacaggaggccucaggggcgagcacagcagagggcaagggcgcaggacacagcagggucaggggugaacacagcagagggcgagggcgcaggguacagcagggucagggcaaacacagcagagggcgagggcgcaggguacagcagggucagggcgaacacagcagagggggagggcacagcagaggaugagggcgcaggguacagcagggucggggugaacacagcagagggcgagggcgcaggguacagcgggguacagcagggucagggcgagcacagcagagggcaagggcgcaggacacagcagggucaggugaacacagcagagggugagggcgcaggguacagcagggucagggugaacacagcagagggcgagggcaugguacagcagggucaggggcaaacggcagaggacgagggcgcaggguacagcagggucgggugagcacagcagagggcgaggacgcaggguacaggagggucagggcaaacacagcggagggcgagggcacaggguacagcagggguggguucugagaacuaaagcuucacccugugcuacacauaaaacccacaacuagagguaucaggacggcagaacagggauguccaaaggaccacuccuuuaucaaaacgaccuuacgcuaggaaaaagcucagaauccacucucucaaaaugggucagcuugauuccaagcucaagccacccaggcagggcuucagaggaacaggugaugcucccugggaagcacacggugaguagcugccaccccagcauuccucaaccccgccuccacugcagggagcccagccuguguuccuggagcugcuggcugggaccauggugggcaggagaccuuguccuccaaaagucuggggucgugcauuuuaguuggucuggcaagucccugagggaccagcaaaugcagcagcuuccagugugcgucuaucggagacuuaaagagagagacgcacuugugguuccuuucuggauccagguaagaauaguuaaggaaauaucucaagaacagaaaggaacuucuucaccacgauaaaaccucuacaugaaacccacagcagacaccacgcucaacugugaaggacugaaagcucuuccuccaaggucaggaacaagauacggauucucucaccacugcucucagggcagcacuggaggcccuagccagaguaacugggcaagaaaaagaaaacaaagacaaauucucccuauucacaaaugacacgaccuucuacguagaaaacccuaaagauccacauacaaaaaacccuaauuaauuauuucagcaaaguugcagggcacaaaauccauacacaaaacccaguuauguuucuauauauuaucaaugaacaauacauaugcaauagcaugaaaaaaguaguuuacacugccgaguccaguggcucauguuggcagucccagcacccugggaggcugaggugagaggcucacuugagcgcacagggcugcagucagccaugaucgugccagggcaccccagccuaggcaacaacaugagacccugucgcuaacugcccuucucuuuaaagagugcauugaggccggcgcgguggcucacgccuguaaucccagcacuuuggcaggcugaggcgggcggaucaugaggucaggaguucgagaccaguguggccaacgugggagaaaucccaucucuacuaaaaauacaaaaauuagccagguaugguggcacaugccuguaaucccagcuacucaggaggcugaggcaggagaaucacuugaacucgggaggcggagguugcagugagccaagaucgugccacugcacuccagucugggcaacagagcaagacuccaucucagaaacaagacaaaaacgcacugagaagaacuguugacuucgcacaggcugcgccuucucucccugucccuaauaacugguuuucaugaccuagccacaugucccccucaccugcccugccugccuggauuggguggccccuuguuugugaguggcuggccaugccguucccacaaugaccacucaccuccucagcacaggaggcuucagagcacccgcagucucugugcccucguguuugggacgggaaucuuugcggaccgggugggcugggcucaggccucacugcugccugucaguucuuuccccaugggggugcaggcccuggccuuccccucuggcgggaaccacugaccccucauuaacacaucacagaagucucuucucaugcgcccccagcugaggacacaggcgggcacgcccgcuagaacuccaaggucaggguugacaagacugggaggcagcacacgggccgggggcugugcagaggcccuucuggguucccaggggggucucacgguggcagcuggggaaccaagugccccugguacucgccgcagucaggaggccaugcuugcuaccacccaguccugccuccugcgcagcgguuuccacugaagucaccccuuuuauuagagaccucugaaaacguaucucccgugucucuguuccaaagcacgucuuugucugcacuccuggggucccagagggacuagugacacagucugagugugcugucccugucacagcagcaggggcucagcagagaggacccuccccuccugaaucugccucgauccggaaaaggcucgccuggcuccucccaucccagcucccagcccuccucacaccagcagccccagaccuucugggcagcaagccagagacacauucucagguguccugggauucagacucaacccggagggucacggagugggggcuuccguacagcagccucaggcggcacucccagccaugacuccugggaacaagccuggggguagggacccccgggcaccuuuucugggccugaccaguuuucuguucaugcugaagcugcugcagccccucuggcucaguccugcccucugcuucgcaucucucuccgggccuccuccacugcucccguuucucuuuucagaacuuaacagcaucagaacuuccaugaaaaaaggccguugaccucucagucugcacagcaggguucuaguggcugacgguggugcucagagccaccugcccucuggaccuuuguucugggcugugaaaugcucaaggacagggacugggucagucaccaacuaccugggaguguucuggguacugcuggguauagggcugcaaagaaaacagcacaagugaaaaccagcccucacuaccagggccuguguucuaacugaagagagaaaauaaaaaucccuaaaaacaaagucaaaacaagcucacagaagucauucaacagggaaguggaccguggcugccuggccauggacaucagugauggggucagaacugggaggaugacagagcuggguccucgggccucuggggacgcacacaaagcagaagcgacggguugggggcuucggggguacacuggggugugaacccagggcaggaccggcagaagggacguaagagccuccuucucaagcaaggcgggguucugucgacagagacaccugccauccacugcugggacucugaggcagccucacagugccgagaccaggucccagcuccaaagcaccaggaggacccaccuucucaccugcccgccugccccucccccgccucccgcucacugagggaagccacguuucacugggcucgggagauccgcacacgagagagugaacugagugggcaccggggagaggcccuggagcacaggcgggugucuaggucgcccaacggaugccuccagcagaccccgggcugcccacuuacuuccuuucuggguaaggcucaaaggacucguccgaagacugggcauuuugcuucuugucauuuucaucuucacucaagacgucucuaggaauuaagagagaaucuucagcaaagcccugggccugggcagugacagacccaacacgaccuccugccuaaagauaccaaauggacccccaugucccacauuugaguucuucugaaaaugucuuaaaucuaaaauccccaaauuuccaaucccguuuccgaacacaaagggccagccaggcucacaagccagcaauccccacaagccaugugcucugggcaccaggacacuggacuuggaaacagcccuuuccacagcggcccagaagggguggaggcgcucaaagguagcuuccugcuaagcagacuuugagaaaucgaccaccucaccccauaacugcgaacccuaugcaacugauggguuugccaugagucacuucuaaguucacaaaaguggcugggugcagaggcuaacuccuguaaucccagcacuuugggagggugacguagguggaucgcaugaggucaggaguucaagaccagccuggccaauaccgugaaaccccgucucuacuaaaaauacaaaaauuggccgggugcgguggcuaacaccuguaaucccagcacuuugggaggcagaggcgggcggaucacgaggucaggagaucaagaccaucccggcuaacaaagugaaaccccgucucugcuaaaaauacaaaaaauuagccgggcgugguggcgggugccuguagucccagcgacucagaggcugaggccggagaauggcgugaacccgggaggcagagcuugcagugagccgagauugugccacugcacuccagccugggcaacacagcgagacuccgucucaaauaaaaaaaaaauaaauaaauacaaaacuuagcugggugugguggcgggcgccuguaaucccagcuacucgggaggcugaggcgggagaaucacuugaacgcgggagguggaguuugcagugagcugaggucacaccacugcacuccagccugggcaacagaguaaggcucggucuaaaaaaaaaaguucacaaaaggaaaaaaaaaaaaaaaaaaagauuuguggccuuuaugcuauaaccucagcugcgguuuuguguccuggugguccugaggacagucuuagccaccccaggugccuccuggcaccugcccgauuucaucacugcacaucccacugggauuggcccccaaacugggguguccucauuuggaugaggugcaucuguguugcagccaagguuuacaggagaggguggaaacggugcaaaccccagccuggcacagcugcccugaauggcgcuuggcucagaggcagggguggcccagggaguuugcagacacugaugaggucccuucugaggcccguccuccugcaacaccuccucgcagagccucggcuucaagccacaacagugucauagucaagggcuaaagucgggguuucucuacuccagaaacaucuggagcgaacacaaaacuauggcccuaaaacaguagcagaagcaaaggacccagccagagugguuucaacaaacucauuucuaggcugcucugggucagaaacccuaucaggcucccucuggagcugccucaggucugggagugcucucuggcacccaggaaaccaucaaucagagacaagaagccucggaagcuccccagccccuccucucccgccaccucgagaggaggcgugucccaaccagggcacggacagccggccccugugauggcuuaguuugguaccagcgcaugggcagccgacccuacgauggcuguuugguuuuugaaggagaaauuuuaggcuguuuaaacccacucuucucucaccccucagaaaggucacugaugguuuuugaaggagaaauuuuaggcuguuuaaacccacucuucucucaccccucagaaaggucacugaacucgucuuuuacccgaucauccgagguugaagauggaagcugcuucucacccaacugcccugagaaacaaagaacaaggcuccuguuaccaacacggagcacagaaaggucucaccugcaaggaggcaugauucuacuauugaugacuagaagggagacuggggucccugacccucaaguucuccccaccauggccccauccccaccaagggugcuaugcagccucugauccugcccugccagcccaacguccagaagcacacaggcagcaacaagcaucagaacccucaggaacagcagaaccagaaagcccaguccuuccacugacuccgauccaguccuucuaggacagccuggacuugguggauguucugagacauuuaaaaaauuacuaggccaggcacgguggcucaugucuguaaucccagcacuuugggaggccgaugcagguggaucacgaggucaggagaucgagaccagccuggccaacguggugaaaccccaucucuauuaaaaauacaaaaauuagccgggcaugguggcacacaccuguaaucccagcuaccugggaggcugaggcagaagaaucgcuugaacccgggaggcagacauugcagugagccgagaucgcgcacugcacuccagccugggcaaaagagcaagacuccgacucaaaaaaauaaaauaauuaaaaauuacuauucucaguccgggugcaguggcucacgccuguaaucccagcacuuugggaggcugacgcggguggaucacaaggucaggagaucaagaccaaccuggcuaacaugguuaaaccccgucucuacaaaaaauacaaaaaauugagcugggcgugguaacucaugccugcaauuccagcacuuuggaggccggggugggcggaucaccugaagucgggaggucgagaccagccuuaccaacauggagaaaccccauuucuacuaaaaaauacaaaaauagccaggcauaguggugcaugccuguaaucccagcuacucgggaggcugaggcaggagaaucgcuugaaccugggaggcagagguuguggugagcugauaucgugccacugcacuccagccuggguaacaaagagugaaacuccuucucaaaacaaauacaaauacaaauacaaaaaaauuagcagggugugguggcacaagccuguaaucccagcuacucgggaggcugagacaggagaaucacuugaacccaggaggcagaggcugcagugagccgagauugugccacugcacucgagccugggcgacagagugagacuccaucaauaaauaaauaauacuguucucucggccaggccugguggcgacagagcgagacuccauaaauaaauaaauaaauauuacuguucucucggccaggccugaagguucaugcuuauaaucucagccuuuugggaggccaaggcagaaggaucacuugaagacagaaauucaagaccagccugggcaaaagagugagacccugucucuacuuaaaauaaguuuucuuuguuuuguuuuuuucuuuuuuagacagaaucuugcucugucggucaggccagagcguagugguagaaucucagcucacugcaaucuccgccucccagggucaagcgauucuccugccucagccucccaaguagcugggccuacaggcaaccacagccacauccagcuaauuuuuuguauuuuuaguagagaugggguuucaccguguuagucaggauggucucgaucuccugaccccgugauccgccuaccucagcaucccagagugcugggauuacaggcgugaaccacugcacuuggccuaaaauaaguuuuaaaaaguauuguucuuggcugggcgcggugguucacaccuguaaucccagcauucugggaggcugaugcagguggaucacgaggucaggaguucaagaccaagccuggccaacauggugaaaccccaucucuacuaaaaauacaaaaauuaggugggcguaguggcgcgugcccaucaucccagcuacucgggaggcugaggcagguggaucacgaggucaggaguucgagaccaagccuggccaacauggugaaaccccaucucuacuaaaaauacaaaaauuaggugggcgugguggcacgugcccgucaucccagcuacucgggaggcugaggcagguggaucacgaggucaggaguucgagaccaagccuggcccacauggugaaaccccaucucuacuaaaaauacaaaaauuaggugggcgugguggcaugugccugucaucccagcuacucgggaggcugagguagcggugagccaagauggcaccaccgcacuccagccugggcuacaaaacgagacucugucucaaaaauaaauaaacacauagauagauagauaaguagguaaauaaauagauaaauagguagauaaguagauacauagauauacagauagguagguagauagagagagacaaagaaguaggaagauagauagguagguagguagauagauacacagauagauagaauuguucucaacacacugcauacaaguuuacagagccaagcagcucuaagaugugacacucacaaucccguuccuaccugaggcccccgagccgcacugucucaucugugcacccguaucuagcuaaacuaucuggguagcuguguuucuguuugggacagagucuugcucugucacccaggcuggaguacgguugugcgaugucggcucacugcaacuuccgccucccaggcugaagugauucucgugccucagccuccagaguagcugggauuacagaugcccaccaccauaccuggcuaguuuuuguauuuuuauuagcgaugggguuucgcuauguuggccagguuggucuugaucucgugaccucaagugauccacccaccucagccucccaaagugcugggauuacagguagcuacgcuuuucggaagcuccccucaagacucaaagugggaacugagugcucagguggggacaggugcacagagcacacacaggacaagaggccggagggaaacuggcccuggcccuccuaaaacaacauccaggagcagcugcaccagcccacagugcuauggguucuggggcccaaacaagggccuuguguuuccccucagccugucagcagagaaagcugcgccacacuggcccacaccagggugucaccaggcggcuggcugagugccaggaaaugaccugcagcuggcccagggcagcagccgcagaggcaacggccauucuuuucucccacauccacagacaaggcccuauucuucccucuuccucaguccccucagccccaagcacaggcuuagaaaaagacucgacggcugaugagcgugucuccacagaaacugcuggaacagagcccugcucacagaggagcaagaggcggagacaggcuggccgccccucccugcucucuggauguggugagcagccgcaggcagaagccccaagcucugcuccuucucacaccacaccccagccaccaccuagagcaguggagacauucacuuucugcugaaaacccugccccacugaggagcacacauccuggucuagcaccagcaagaggugccuccuaccuggggcccugcaaaggggcaggcuuggcugaggugggaagcccgaccugggccccaccgcgucgcuguccgaaggaggcugggccacauccgugcugggcagggucuuggucucagccccaacuggggucccugucccucuacccugggaggucugaggggcauccccaggguuccacccucggugcuggggcagccguggcgccgucucuuugucccauggccacuugacugccagcgcacuguccagcaagaaggccuugcagcuggagcugguauccaugguguagucguggcccuggucgcagccccacacgaccuggaugacgccgcaguacucggaggacaguguccucugaagguggggcagggccccgcagcuggccgcauguccaugcacccaccccaccaagccgugcaggcacugggggcuggaugugaucagauccacugcagagagucaacagagaugucagauccacggcuggucggcacccagcccacccuccaccgggggaggacucacccagacacgcucccuccucugccccuguugggggcugggcaccgacccugcaaaggaucaguguggccaugagcaggacaagcaggcggagguucacagcgcucgucguacgggacccucucgagaucucaaaccucagcgguccccauaggcaacuuucucuucccucaccccagcuccucccaguucaucucuccacaacagucccagggcuguuggcacugaacccgggcauggcccauuccccccacccagaggcucccgcggaggcacgcccugucccucucucaacacccgucacacugcaguacugacagccugaacgugcucugaacagacuagggcguacuuugcacaaggcuuccggcgaccagccggggaggcguugacccucugcaggaaggacuugagaaggcuguggcacugguagaacugggcguggcagcucuugcagacaaacggagacaaggugggguccuggcggacagccacaccaagcaggcgcuggaagucccguacgagcacgcgcuccucugcggauggccucuccaugcucgcuccaggcgcccucucggagaugcugcgcaggcuucucgaggaaaacuucccguggcagaggcgacagugacccauggcgagagcccggccugcuccugcacagagcggcaggaaguguuagcagcuggcaaaggaggcuccugagcacagggcgucccggacuccagguccgagggcagcgccugcagcgcccuucgcgcggcucccggacacagcaagcggcucgggcgcgcggcucucggcgggacaagccgcccugugggggauguggccgcugguccaagaaaucuuucaaauuucaaaggccucuaaggccucuccagcgaagcaacuucaagagugaaaccuggaacugcacccuccucccagcgaccgcgagacccggggcaggcgcugcgcccuccaggaaacgccgcgguuuccugucugccaauugcaggugccgccuccuuuccggcuccgcgagggcacgaagcaggggagggcgauucccacgcgcgggcaccccagggcgaccugcccgcggugacagcgcuccucacgccgggucccuucuggccgagcccgcggccggggaggccgggccggcgacgccggcgucacggagcgcgaggaaaaccgagccggccgcccagcgccuaucccgacgcagccccgaguccgcuacgcccuuggccggguggaggagaggccgcgccggcuuccgggcgucagugcggcuccucccacgagcaaccccugccgcgaccccaacccgccacgcccgggccgcggacccaccugccucguccgcgccguccucgcccgcguccccgcaggaccccaccgggccccaggcgcgccgcgccgucgccccguccacccucggcccaccgcuaagggaagggcggccccgaguccggcugacgccgccgccgccguccgaggccccgcacugucgggacgacccaggagacaggaagcggcccagccggucccgcuucauggcagcggaggacgccagcagaaucccgcgggugcugcccggcccgagguuccuagaggacccggcguuaggcuccgcucggcgcgcuggaagcgag

SEQ ID NO: 191996 - RNA, 14089 nt, Homo sapiens
agacacucaccccggacucccuugaacagggacagggaggaaccccaggcagcuagaccccagcagcagccacacgagcacacuguggggcagggaggggcaucucuugagaacaaaagauccauuucucgacuuuccaaacuggagagcuucuugagagaaaagagagagacagguacagguccacgccacccacacacagcccugugcacacagaccggacacaggcguccacaggcaaguucgcagcugcucauuuugugaagugaaugcugauuugggggccgggugggguucgucuguacaucgugcacugucagacccuuccugaaggauuuuuguuacugaaguaucagaaggcccuuguucuaaggugguggcacuguaauaucuggcccaggaggaggucagugccgugccggcgaguccuuugcucccuuccuucucugaccaguaaacgcaucuccagucgcucccccgaggccccccugcacgcagucuccgaccucagagagugagucagauagaagccgcugcccacccucccccacccuggccggguucuugccuggcuugugcguccuugugacaauuccugacacggaugcgcaccgggcaguggcacguccaggugcugugcgcgcccgggcccacaaagcuccuuuggacgcucauggcagccccuugguggaggaggucgggugcccacccccuccccgcccacugcggaagccggcgacccacggagcucgcucucggccgccgccaccccucuguguucgcgcccuuccgagcucugauccgacgcuuuguuucuucucaguggguucagggccugggccagccuuuaccuaccucccccacccaaaaccggcaaaagcucagagcaccuugucugccaaaagacagggagcugggauggugcggguuggucucuaaaccggcguggggaaaaaagacccuccguacaaagccgcaggguggggcugucgcaagggcggaaccgagaggguagcugggggcgggguucccagggccaagaggggccauuguccucccuggagcccggcgcccccacagccagcuccucugggagacagccccuccuuucgaaugcgcggggcccucagaccgcgcccggcccagcgcugggggauccuuggcugcgggaggggcgccgcauugcgcgcggcgggcggggacgcgcggugcggagccugcgggccgggcggggcucugcggcggcgccucccgauuggccacccgcggugacaucagccgaugcgaagggcggggccgcggcuauaagagcgcgcggccgcgguccccgacccucagcagccagcccggcccgcccgcgcccguccgcagccgcccgccagacgcgcccaguaugagggagaucgugcacauccaggccggccagugcggcaaccagaucggggccaaggugaggcugcgcgccccggccugucccgggccccggggcgggaggagggaggcgccgugccccgcgggccgcaccuccagcugcccccgccccugcgaaccugcaacaaagggaugcgcccagcgccgcgccgggcggccgggacgcggggcccccgcccugggacucucgccugcaccucucugccccugcccaggugaccucgggcugucgaggcgcagcucacgucagucgcgaagccucagcccccuccacaccugcgcccccuccacaccugcacccccuccaccgggccuccgcaggugcagcugggagcccugucugggcguggcccucuuuuuuggggccgcggcauagccuugagugagacgggugggguaggcagguuuggguggggugggggguucuccucacagccgugauuuccucggcccgaaccccccacuggaguagccgaacgucccccgagaggcuagagccgccccgauuuccccagccugcuccgacaccccucggcguccuagcuccacccugucccuuuguuggagggguugggccuggacucgagaugaccuugguccaggaccaggcucuccaucggcgcagccgcuccugggcaacccccgcggggcuugaccgcgcccacccagggucuaccagucuggggauuggaugugggaacaaagccgggcugugggguguggaggcugcaccguggcgcgccccucccuccauuguuagcccaccucgcagauguuggggccacgcagaaaggggcguuggugcagcugugcagggaccccugccuaaaucauuaaggggacgucguguccccugguccugggaggcugucccuggcccaaggucacacagcaggugcgagagagcugggcuggcccuugguucucauccccugcaggagccaaccuggggcucgggcggggcggguugggggcgcugcuugccaaaggaucugcccuccgaacaguguuggggaacaggggaucggggggggaggcuggcuuugucaggaccaaggccagggacccagcucagggcuggugcagcgcugauucugggaaggagggggugcaggagacgguccuggaggggaaggggccagagaaaggcagccuccggaggcuguugccauggaaaccaggcaggaacaaaaagcuaauuacaacagggccagccacguggcugacauguaaauugcaacuuuggcuccggguggaggcgccucugagggugggaggcccaguaguggggagacucuaaucacccaaggagacagcugugccugccaaggagagccugggggaggggagaccugggggacaguggccucaaaucaaaccaggacucccggagcagccucugacagcugccuuggccugaugggaggggcugagggcucauuaauguggucacuggggccaagccuccccugagcaucugcuccugggagggucaggggucgcuggggggagggagggcaggcagcccuggggcuccugggagggucaggggucucuggggagagggagggcaggcagcccuggggcccaccugggguuucuccuucuauggcugggaugggcccagagcuguggucccacaaggcacuugucaggcaagagcugggaucuagaagucaggugcacaugcagacauccccugaggcuccacggguagcagagggagcccuuguccccuggaccguguccuuggcugccuugugcucugcuucugaacacuggagcucuuaguuugcccgcuacuuuuuauuccuuuugaguuguuuguuuuuucuuaauauauuucuuuuuaaaaauuaauaccuggccgggcacgguggaugaggaaucucauguaaucccagcacuuugggagacugaaacuggaggaucacuuuagcgaaggaguucaagaccagccgggauaacauggugaaacuccguuucuuaaaaaaaaaaaaaaaaaaauuagccuggcguggugggccgcgccuguagucccagcuaccugggaggcugagaugggagcauugcuucagcgugggaggucgaggcugcaaugaacuaugaccgcaccacuguacuccagacuaggcgauagagugagauccugucucacaguaauaauaguaucugauucuuuuuaacaaugaaagcaacagagaaggaaauuuucucgggggcgggggcggcaagagcguguuccuuugcucugcugcccuuguggaaucaaugggaaguuccuuggccguucucggccuccacucccgcagcugauagggggugcaacgcggcugcuucccugucugggguccucgggcggugccuggcugggcaggaaggcccgugcacucugggcagagggaagucggggugacucgaggccgggagcaaagccgggucccgggcggucacgcggcagcgcggacgacucaccgcggucaccccugcgcugggagccgagcccccggcagcucgcggggaugcaguaagccgggcgcagcccgccgggaggaugagaaaacccgaagcccggaaagccgagcggccgccugcagucaccccggggggggcaggggcgggccgggcuaugcagaaacaccggggcccgcgggacacaggacgcugccccacugccgcagagcugaaucuggacccccgggcuuugcuuuccuggggccugugcuccucccuccccggggcgggguucgccugcagcggcggaggggggagccuuuguccuccgcgcgggcugcggcaccgccuccucgcggcugcggggcggggcugggggcggggccuggccgucucagccaaugggaggcggagucccuggcucgccccgcccucucgccugaaagaccugcggagccgcgggccgggcgggaaccgcauucggguccuggaggggcuuggaggccccagucucgcagccccuucaucggggacccccgcucccaccugccuuggccacugcccucaaagcccggccccgcuuuccccaggaccccaagcgcugcgcgaggucagcaccaaggacagcgcccgggccgagcgccuggccucgaacgccggguucugcuuuguguuuccagguuuuuguuuuugguuaugagaggaggccuggcucugucgcccgggcuggcguccagaggcgcgaucucggcucacugcagccucggccucccgaguagcugggaccgcaggcgcucaccaccacgccuggccacaauuuuccuuuuuucuuauuuucuuuuagauggaguuuggcucuuguugcccaggcuggagugcaguggcgcgaucucggcucauugcaaccuccacuuccuggguucaagcuauucuccugccucagccuccugaguagcugggauuacaggcgcccgccaccacaccuggcuuauuuuguacuuuuacuagagaugggguuucuccaucuuggucaggcuggucucaaacuccugaccucaggugauucaccugccucagccucccaaagugcugggauugcaggcaugagccaccacgccgggccgauuuccuuuucuguagugauguuaacaauuuaguuuauaaaauuauauuuuauuguuuauuaaauauguaacauaggccaggugcgguggcucacaccuguaaucccagcacuuugggaggccgagguggguggaucaccugaggucagcacuucagggccagccugggcaacauggcaagacuccgugccuacaaaaaauaaaaaacaaaaaaaauuagcuggacauggaggcacgccggccuguggucccagcuacuugggagacagaggugggaggaucaccugggggaggugggcagagguuaaagugagcugaggucaugccccugcauucuagccugggcaauagagcaagacccuaucuaaaaaaaaaaaaggaacaauauauuuuauuacuuuaucucaaauuauaauuuuauuaauuuuaacuacaaaagcaauuaauauauucuccugguuaaaaaaaaccuuaaauauugcagauaaaccuggugcccaucuagccaccucucucuauccaagugggaacaaauuucuuuuucuauccuucugguccauuuuuuuuaagugaccugugcauaugguuuuaaaacuuuaaauaguaucuaaaacauuugaacaaaaugaagccaacaugugcugaauguuuucaugucaagcuuugugcuaaggccuggaugugggcaccauucacacguucaucucacagaugagaaaacagguccugcgaggcacgcgccuggcccacagcugugcucgugcugggucuugaauccacucugcuccauugcuccugcugcccugugccucgcucugcagaggacuucccauagauguguuacucucuccaccccuccuuuacaggggcuggugguuguggguucccuggaaccauaaauuuggggugucccagugcuuuggggagcaagguccccgacucaaguggacugccagcaacuaaauuaaugggggauccucaaagagaguguuagggaggcaagcaguaggugggaagcuuggacaagccccaaaugccucagggaccuuucuguauuuuuuuuuugagacaggcucuuacucugucgccuggacuggcaugaucuaggcucacugcaaccuccaccccccuggcucaagugauccucccaccucagccuccugaguagcuggggcuauaggcaugcgucaccaugcccaacuaauuuuuuuguuuuuugguagagacaggguuucaccauguugcccaggcuggucuugaacuccuggacucaagugauccaccucucuuggccucccaaacugcugggauuauaaauaugagccaccauggccagcugauuuuuuuguuuguuuguuugagauggagucucacucugucacucaggcuggagugcaguggagugaucucggcucacugcaaccuccaccuccuggguucaagcaauucuccugccuuagccuccugaguagcugggauuacaggcacccgucaccacacuggcuaauuuuuuuuuuuuuuuuuugaggcggagucucuaucuguugcccaggcuggagcacgguggcacaaucucgguucacugcaagcuccgccucccagguucacgccauucuccugagucagccucccaaguagcugggacuacaggugcccgccaccgcgccuggcuaauuuuuuguauuuuuaguagagacaggguuucacugugccagccaggauggucucgaucuccugaccucaugauccgcccaccucggccucccaaagugcuaggaccacagacaggcgugagccacugcgucuggccuaauuuuuguauuuuuaguagagaugggguuucaccauguuggucaggcuggucucgaacuacugaccucgugauccacccgccuuggccucccaaagugcugggauugcaggcgugagccaccgcgcccggccuuuuuuuuuuuuuuuuuuaagauaggguuucacucuugucccacaggcuggugugcaguggcuugaucucagcucacugcaaccucugcccccuggguucaagcgauucucgugucucagacucugaaacaacugaaauuacaggugcgcgcuaccacgcccggcuaauuuuuguauuuuuaguagggacaggguuuugcccuguuguccagguugguccugaacuccugacuucaagugaucugccugccucagccucccaaagugcugggauuauaggcaugagccaccacacccagccugaaucauuuuuguaauuuaaaaauuuaacgcaaaaagaauaaaacuuagcaauaacaaaaaugcacaaaagauggaaagaaauccaccccugaccuuuguggagagaugaccucugauaacagucucagggugaacgggcaccucugauaacagucucagggugaacgggcaucccgagacacuguuagcagaggugguccauguccaugcuguccgcguuacaauaauuacacuauguuuauucuuaagguuuuaaaaacauuuauuuuuaacaaauuuucuuugaaaagcuaccgugugcacgugagaaaaucucaacaagaccacagggcacccgugagaagaagcuccucccagucuggggccccuccccaggcacagccuuccacacaucuaccagaggcacccacgcauagagaagcacccacaagcaguuuucuuucuuucuuuuauuugagacgguguuuccuucuguugcccaggcuugagugcaguggcaugacauaagcucacugcaaccuccaccucccgaguucgugugauucuccgccucagccucccaagcagcugggauuacaggugcucgccaccacgccuggcuaauuuuuguauuuuuaguagagacaggguuuugccauguuggccaggcuggucuugaacuccugaccucagaugauccacugccucagccucccaaaguacugggauuacaggcgugagccaccgugccuggcacaagcaguuuucuccccuuccuuccuuccuuccuuccuuccuuccuuccuuccuuccuuccucucucucucucuuuccuuucuuucuuccuucauuccuuccuuccuuccuuccuuccuuucuuucugacagucucgcacuauugcccaggcuggagugcaguggcgcgaucucgacucaccacaaccucugccuccuggguucaagcaauucuccugccucagccucucgaguagcugggaguacaggugcgcgccaccaugccuggcuaauuuuuguauuuuugggagagauggaguuucacuauguuggccaggcuggucucgaacuccugaccucgugacccacccgccucugccucccaaagugcagggauuaugggggugagccaccgugcccagcuaugagugguuuuguuucuauuuauuuauuauuauucuaugagacagagucucacucugucgcccacgcuggaguacaguggugcaaucuuggcuuacugcaaccuccgucuccuggguucaagcaauucuucugccucagcuuccggaguagcuggaacgugugagccaccaccccuggcuaauuuuuguauuuuuaguagagacaggcuggucucgaacuccugacuuccggugaucugcccaccucagccucccaaauuguugguauuacaggcgugagccaccgcaccuggccucuauuuauuuauuuauuuugagauggggucuugauaugaauuccuagacucaugcuucucaugcuugcuaccacccaguccugccuccugcacagcaguuuccacuaaagucaccccuuuacgagaggcaucuuuuuuuuuuuuuugagauggugucucacucugucgcccaggcuggagugcaauggcaugaucucagcucacugcaagcuccaccuccuggguucaagugauucuccugcuucagccucccgaguagcugggacuacaggcacccgccaccauucccggcuaauuuuuuguaucuuuaguagagacgggguuucaccauguuagccaggauggucucgaucuccugacuucgugauccacccgccucggccucccaaaguguugggauuacaggcaugagccacuguaccuggccuacuagaggcaucuuaaaacacaucuccugugucuccauuccaaagcgcaucuuugucuacacuccugggguccucccacgucagccucccaaagugcugggauuacagucaugagccacugugcccggccccaccaaauuguuuucuaaccugcuuuuuucuugaggaaucuucugcagcacaugacucacauguagagccccuuguuucuugaggccuucauacccgucagcucaucuaaaagucacuccugaggaguaagggcaaggggcauugggagaggucaggcagcccugggaagccucccagcgugugucccaggaggccugcugccugcagacacugcucccagacgcagcggccucggccaucagagcgugucccacgaugagguggcaacuucccugaagggcuugcucucacccaggggugugguucuccgugugcacacagauagauaguucuacguuugccauauaccauuuauaugccucacacagauuaacccacuuucauuucaaaaagaccuccugucaucgugcccauuguacagaugaggacacugagacacggaauccuagugaccugugcaaggucacacagcugggaagggugagggaagcgucugugaacccagcaggcccagccccugagucuaggcuccgcucggcagcugucaugggagcagaguccgagaagcacugcaggcaccugcucuagggggagagagguggagguggcagguagagagaggacgaccccugggagcugagacgaugccagccucacacggacaggcugggugaccucaggcaagucgcuucccauuugggaccccaaggacccuucugcagacccagcuggggguccccgaugagacuggcucucagagucccugugagucccgucagcugaggccaguaauguccuggcaccaucacuggacaugguuugcucucccauggaggggcagguguagcagccaaaagcgauccugagcucugggccucugaacccugcucugccagcuacugugggugucucuacccgcucugugucucaguucccuuuccugaaaagaggggauaguaaaaacuaacccucaagguguuuauuaccaaugcccuucauggaggaauccgcugcuccaggcccuugccagcagcugcacagcugggccuggggaccugggugugggucuguugaaccuuggcccacccuggggcuguggucggccuggacguguagguguggaggugcauauuuauuauggcaauuuucugacagguaacagaguguggggcucucuucugaauggggcucguggaggccgugggucaaaagcccuaauuuuguagugagggcuaaaaggcuucacaagggaaagggccuggcuggggcuaugggccggugccgacccccccucucccacuuuguuugcaguucugggaagucaucagugaugagcauggcaucgaccccagcggcaacuacgugggcgacucggacuugcagcuggagcggaucagcgucuacuacaacgaggccucuugugagugccugccccagccucccuaucccagcccuggacugaccaggucucagcgucugacugaccaggucucagcaccuggacucaccagcucucagcaucucuguccucccauggguuagguuggcugagaugccagcaggcguaacuggaugucaggcauccagacgcacagaacagacaauaaaucacagucacaaaagugagagccaaacauauuagugccaugagggccugugcguguccaggggcacagacagggauggggcaggccagagacuuuggaggccauaagagggccuagagaaggggucaccuggagggcuuagucaggggcucuuuagcaacuggugugaagugauuuccauaucaaaguggugauacacccaccugcccacauggacaugugauuuaaaauuuuauuuaauuuaauagagacagucucgauauguugcccaggcuggucucgaacuccuggacucaagcgauccaccugccuuggccucccaaaguguugggagugcagacacgagccccugcaucugguggacgucugacugaauccugccuguccugcuccguccuguccugcuccguccuuaaacacagugaggcuuaagggugaagaaaguugcugaagcuugccuuugguccaggacucugacuucagaguacaggcucuuaggaugugagcaggaggauggcaggcgggcacagaauucagaaagaaugagggagaggcucuggcccucugugacccgaaucaccgagccccucucuccccucagcucacaaguacgugccucgagccauucugguggaccuggaacccggaaccauggacaguguccgcucaggggccuuuggacaucucuucaggccugacaauuucaucuuugguaaguucccccugcuccaagcucugauggcagaccccaucacaggcaagcccaggucgguggacggggacggcugugagaaacaaggaauggucagcuccucacaugauccugaauggugggaacucaucucuccauuuuacagcugggcauuggaggcccagagaaaggguucuguggggagaacagaaaccacucaugcauuucaaguggaaugaaguguaaagcagacagaagcuuacagaauugcuagagagcuggugagacagaacggggccuccagaggacuccgggguccaggagcacgaggccuugcugcggucaagagaucaggacguucccaugccuguguccugggguugggccguggaugccacguucccaugucuguguccuggggcggggccguggaugccacguucccacgucuguguccuggggcggggccguggaugccacguucccacgucuguguccuggggcggggccguggaugccacguucccacgccuguguccuggggcggggccguggaugccacguucccacgccuguguccuggggcggggccguggaugccacguucccaugccuguguccuggggcggggccguggaugccacguucccaugccuguguccuggggcggggccguggaugccacguucccaugucuguguccuggggcggggccguggacgcgccacagaaacaggagggccucgcuucacuucugccuucccgaccgcagcacauccagcugguagaugccaacucgcauccagcccccagcugccagggauucugggguggcuguuugggcuccuggcacugccagucggaaggaagguaugcuggagcaggagggcugauccauucacccaggauccccucaggaggcagagccucgcucugcugugaccccaaguucucaagacucuguccagagcccucguccugagcacucagcagcaucggcucagggaagccacggcggguaugagaaggggugcucaguggggccuacuuuacagaagacagaacaggcauggggcugccacggcugcccuugggauguucaggcaggggcuggaggucuggacugcagagucccuggccccugucucuuaccccucuucucccuguacaggucagaguggggccggcaacaacugggccaagggucacuacacggagggggcggagcugguggauucgguccuggauguggugcggaaggagugugaaaacugcgacugccugcagggcuuccagcugacccacucgcuggggggcggcacgggcuccggcaugggcacguugcucaucagcaaggugcgugaggaguaucccgaccgcaucaugaacaccuucagcgucgugcccucacccaaggugucagacacggugguggagcccuacaacgccacgcuguccauccaccagcugguggagaacacggaugagaccuacugcaucgacaacgaggcgcucuacgacaucugcuuccgcacccucaagcuggccacgcccaccuacggggaccucaaccaccugguaucggccaccaugagcggagucaccaccuccuugcgcuucccgggccagcucaacgcugaccugcgcaagcuggccgucaacauggugcccuucccgcgccugcacuucuucaugcccggcuucgccccccucacagcccggggcagccagcaguaccgggcccugaccgugcccgagcucacccagcagauguucgaugccaagaacaugauggccgccugcgacccgcgccacggccgcuaccugacgguggccaccguguuccggggccgcauguccaugaaggagguggacgagcagaugcuggccauccagagcaagaacagcagcuacuucguggaguggauccccaacaacgugaagguggccgugugugacaucccgccccgcggccucaagauguccuccaccuucaucgggaacagcacggccauccaggagcuguucaagcgcaucuccgagcaguucacggccauguuccggcgcaaggccuuccugcacugguacacgggcgagggcauggacgagauggaguucaccgaggccgagagcaacaugaacgaccugguguccgaguaccagcaguaccaggacgccacggccgaggaagagggcgagauguacgaagacgacgaggaggagucggaggcccagggccccaagugaagcugcucgcagcuggagugagaggcagguggcggccggggccgaagccagcagugucuaaacccccggagccaucuugcugccgacacccugcuuuccccucgcccuagggcucccuugccgcccuccugcaguauuuauggccucguccuccccaccuaggccacgugugagcugcuccugucucugucuuauugcagcuccaggccugacguuuuacgguuuuguuuuuuacugguuuguguuuauauuuucggggauacuuaauaaaucuauugcugucagauacccuu

SEQ ID NO: 191997 - RNA, 33640 nt, Homo sapiens
gccggacggaggguggagggcccugcgccugcgcggagcuggaguccggcugggccgcagccgcugggagaccggcgguugccguggggaccggucgggccccucccuccuccggucccccgccccagguccuuccccaccgagacgcgccggcggaccgcgggcgagugcagccggugacccggcgagaggcggcgccgcucccaagaugucgcagacggccauguccgaaaccuacgguacgaggcccgggcuggcggggcgcgcgggucgggccgcggggggcgucgguggcgcggggccgggccugggcugcgggggucuugaggguggcgguggcgccggccggagccgggggacggaucucggaggugucugggcuugggaccgggaugggggacgcgggccgcugggggcucgggugggguagcgggugcgcggggcgcgggggcgcugugcacagcgcauuggcgugauccgccuuuucaaguuuccucuugcucuuucucugcucuugcacucuuagcgcuuuuccccucucagucuaauguaaauaacugaagguuugaaaagccagcuugauguucgguuucagcugcgauauuauccccagcgagccugugaagggcuuagggcgacgccuguguuccucaaauacuucaguuugaccuuuccugguuuggaauuccuugcuuuacauugggauuacagugaggaguuauuaauaggcuaauucauucaucucuuccuccggagaccucuugcuucguuuauuucucccucccucucaguguuuuuuagccuuuucuggguugcauuuuggcuauuuauaaacaugucuugucuccuucuuaagaccguaagcaccuuggaagcaaagcccuggcuguuuaaucuuuguuuccccugcagcacccagaccuggaggugcuugacaaauacuguuuugaauaagcgaaagcuuucccagugcauaugcugugugcuuuuuuuuuuuucuccccuuuuuuggccuugcgugguaagaauaaacaacuuguacuuuguaucagaguugaauauuaauagauguuuaccagucccuaaucacucuuucagauguauguauucucagauuaagacuuugauuuggaguuuuacagucccagagagaggcucaaguucaaaauuacauaccucaagccaaauuaguccugucuccaucuguccuggcaugcugcuuccuucucugcaacaaauacuguggaauggcauuagggaagcgagcaccgugcugggagggcuguacauccugcagaaacacagcagacacggcucuggucucauggagcguagucuauugagggaaugcaguauuaauccaauugugauacuaaugagugaauaauuaaaaaccaggcaagaguucugaaggagugugguccgugaaaguguguuagaaagaaagaugacccagacaggggugucagggaggcauuaaccaggcagcacgcagaacaucucaggccugugggaaggguaacucaagaaggguguguuuugaguaccacgcuggagagguggaugaggaggcagagaggagagggucuugaggaaggcgucaguuugucuuguaagaaaaaaugggaacuuuuggaagggcuuccaugcuggggucacagugcauuugguccaccuucagugagugacuccugugacugguacugcccuguucuuggugacaaaggggcaugacaucuguuccuagaaggcguaggaaauccuccaguaagucgaugccuucaucaggacaaguguuugcaaauguuucugcaaauggcaguggucugguucuuccuguagagaaccacagucagaaauguuguaaggaaaacauggucuuuagcaauuuuugguuacaucuuugcacuucuuuauuuucaagugcucuuuagcccaggcuuaguuucuuuaaccugaguaaggagcacggagcacuaggggaaggguggaauguccaaauaagaaaagcaagugggggucaugaaucaguaagaaaggauuggaagaguucaggagauagagcuuuuauguuucauuuuucguauacgcaugauaacaacugauaaaauagagcuuaucuuuggcaucuccacuucagacacaguuaacugaacuuuugagcuucacagauugauuacauucugaucauaaggcuuugaccauuaguauucuuauuucaugguaacuuccaaguauguuuuuacuuugcaacucugaauugaaucuuuucuucuaauagaggaaauuaaucgaaaacuaguagaaacuaauaaauagaaaaugaggccagaggugauggcucacgccuguaaucccagcacuuuggaaggccgaguugggcggaucacuugagcucaggaguucaauaccagccuggccaacauggcgaaaccccagcccuauuaaaaauacaaaaaauuaccugggcauggugguacgcuuguagucccggcuacuugggaggcugaggcaugagaauugcuugaacccaggaggugaaguuuacagugagccaagauugugccacugcacuccauccugggcaacagagugagacucugucucaaaaaaagaaaaugaguuuuagaaggagcaagcaggacaguugaaguuugccaagcugaaguaaaagucaccuagaaccaaguccuaggcugucacuuugacguaucaguggccauauuuauacagcauuguuccuuaaaagugaaacagucaggcucucuucuggacauuugccucugagcuggugaaggaauguuugccuaaccuuuaaacuccuuuguacucugugcuuauuugcucuucuguaaaaggaggcucuguguagcuugacagagagaugaggaaugaaauguacuggguuuuuguuucccuuuuuuuuuuuuuuuuuuuuugagacaggaccucgcucugucacccaugcuggagugcagugacacaaucacggcucacugccaccuccaucuccccaucucaagugauccucccacuucagccuccugaguagcugggaccacaggugcaugccaccacaccuggcuaauuuuuuuuuuuuuuuuaauuuuuuuuguagagacgaggucucugucuguugcucagucucaucccgaacuccugggcucaagugauccucgugccuccaccucccaaaauguugagaucacaggcaugagccacugugcccugcugaaauguacuguuuaugagcuaccucucauuaauguguucauuuaauaugcuuuuuaacauauuaaaacaguauuucaccuuccauagacugaguaguguugaacauuuuuguugcuuugaagucaccacaugaauacuguacuuuauguaauaucgugaaacaaauugaaaucuuagguuuuggaugaaacccuuagucugaauaugaaacaguucuaccaaaugccauuagauacacuacauucuuaaagcccuggccaguuaguauggcuugggacuucccaaggaacucugcuucagccaucugagaccugggagauuacaaauuggcugaaaguaauuuugaugcuaagcagcgauguucagaaaggagcugaaaaguauauguagugggaaaaugccaggaauuucuuuugaaauuaagugcuggggcaguucgagagugaggaaaaaucuaauacaaaaucucuacauauauuagaguuuaugccgucuacaaugggaauaacaaaugaaacagaagaauacaauucaaauugcugguucuaugcucauuuuuauuaaaauauacucuuaauguuuuuauuuugugcuucauuuugaaaacagcacaguauuacaguauuugccauauaauuuugagaauuaucagaauauuuuccuuaaaaauguaucauuuuaggcuguucagguugaauuguguuccccaaaauaucuguuuaaguccuaaccccuaguaccugugaaugugaccgcauuuggaaauaaggucuuugcagauguaaucaaguuaagaugaggucaucguacugaauuauggugagcccuaauucagugacuggugucauuauaagaugagggaaacuuagacacaaaugcauucagagagaaagagaugugaggauggaggccaagauuggagggaugcaucuaccagccaaggagugccaagggguggcuggcaaccaccagaagcuagagagaggcaaggagggauccuucccuugagccuucagagagaccuugacccugucagcacucugaauuugaaugcccggccuccagaacugugagacaauaaacuucuguuguuuuaagcuucccaguuugugguucuuugugauggcagcccuaagaaacuaaaauauaggcuuugcucaucaaaauacgauucaugagaaauuuaggaugacaaggcaagaugaagugaagaagauauccuugguaaaggaaauagcauuucuuuuccuuuuuuuuuuuuuuuuuuuucuuugagauagagucucucacuguugcccaggcuggagugcaguggcacaaucucggcucacugcaaccuccaccucccggguucaagcgauucuccugccucagccucccaaguaacugggacuacaggcgcccgccaccacaccuagcuaauuuuuuuuuuguauuuuuaguagaggcgggguuucacuauguuggucaggcuggccuccaaacuccugaccucaugaucccgcccuucucagccucccagagugcuggguuuacaggcgugagccaccgugcccguguauaaauagcauuucaaagucaccugguuccaauaaaguaugaaauaacuugcucuuagggaaaucaccccaauugcccuuuaccuuaauuucaugaaagauggaacagguaaacaugucaacaaaggaauccuguaacaccaaaacaaaggacauuucuucaaguugaauaaauauaugauuauacauguuugucauuuucuuuuucucauucacugaaagcuggugaacauuucaaguaccaaaguuugggaaacauugcaccaguggcuuaucaaacuaaugugcacacgaguccccugguguauuaaaauguagauccugacuuggagggugagggagaucggcaucugaccagcucccgggccgugcaggugcuguugguccagggaggcauguaaugacuccaugcucgagaacuuugaaagcaugguuuuuugaaaaaacaaaauauucuuucucauggucauuugaacuguaaaguauuccaauccaugccugugacuuuacugcugaugcucugaugacuguaacaucuauauuucuagucacauccuucacucaaacuacagaucuuuuuuucagcuaccuaacuacaccuggguggccuacaggcaucugaaugcaguacgucccaaacccaacaaauuauucacgccuaugccccaucuucuauuuuuccuguguuugccuagaagauaaaguuagaguccauuuuuaauucuuccccauccuuaccuccuggaucuauuggguuucagagucuuuugagcugacuucuuaacaugguuuaaguuacuguuuacccugaaagaugcaaaggaaaguuaaauuagggccaguuuacaugauuaaaagguaagcaaauuggguuucauuccaaaguucuucgucguagugacuugagcagcugugcugacuaucuuacagcuugccacacagcaucugcaccacugucccuaggcagcuuccacagcaccuggaaccuggguucaugaggauacaagagccuccugggccaggaugggaguaguuuuccacuuuagaagaacuauauaucuauauauaauauagauauauauaauauauauaguuuauauauaaauuauuuacaauuuauauauaauuauuuauaauuuauauauaauuauuuauauuuauauaaauuauuauuauaucaguggaaaguaacaaagaguuggccugcuaaguaacugccuuccucaaaucagccuccucagugugugugaucccaacgaaugggucaggaaaaucaaagacccaaucacgaaccuggagcaauuguugggagucugugcugcaaauguuaaauuuacaagcgucaggauuccgcugugccgacaacguuuaauucaggcuuagguaaaccgcggcuccuacaggcacacugcagagucccaugauuagcuuuugcugccuguuccaccuccuuuacuucuuauucuucccgcuccucuacaggucgugugcucuucugcugcccaaaccuuccaccucuccuaaccagcauuucaucaagguucccacuguucaauuccucccugaccauuguaccaaaacuuuuuguccuuuaaaguacaugucaucuuauauucuguccucugccagcuccucguugcuguuaucugaugacccuggggauaguccuuuuucaacaaggucaucuaucauauggucuugcucuuugcucuaacuccugacugauccuaggucacugcauuguccuugcagaggucaaucaacaacuccgcuccacaguuccuugacuuuagucaagaugaagucaggucucuucuaccaccucuucagguacucacuucccugacugcucccuggacuuugucaccuaucccauucugaccacuccaacuccauccagucuucacuguaagagcuucaggcugcugguccaucuccucccuuucuucuuuuuuucugagacagagucucacucuguugcccagucuggagugcaguggcauuaucucagcucacugcaaccuccaccuccuagguucaagugauucucgugccucagccuccugagucgcugggauuacaagugugcgccaccacgccuggcucauuuuuguauuuuuaguagagacgggguuucaccauguuggccaggcuggucucgaucuccuaaccucaagugauccacccaccuuggccucccaaaaugcugggauuacaggcaugauccaccaugccuggccccuuucuucuuuucaggcaaugagcugcucucucuucagauaagacucauggcuuuuccuuccaccucguccuucuuuuucuuucaacuacacacacuuugcacagcuccagcccuggcuacccagccaucugccuugccugcugugcagacagagcuccuuuuagauugagaucauugcagauguauggucucugcuuccagcuggguacucaguaauacuuagcaaucauuuuucuuauccuggccaccucucucuccacaucagcuauuuuaaaccuucacacaucuccucaagcccauucucucacuccuaguagaugaccaccaguagauguaaggaaaagaugccaugucugcaaacuugcuuaccucauccuuaacccuuuccauguugucucagaaggucucuguuguuuaaaacuaaccccagccuucuacuuuggaccccaucucuaaagcuucaaguccccacuucacccaucaugucuguuccccuccuuuucccuuuccacugguagcuuccugacuuugcgccuuccuccuuuaaccaccucugucucuccuuucccucacagcuaaacugcuuauaagagcugucaguacuuuuugucaacaguuuuacuuccuucauucuucaacugacuguaauuaggauuuugcccccaccugaaaugauguugguuucaccagagaugcugaugaucagucaguggacacuuggcagccuuuaucuuacuuagcuucucuuuucauauucggcccuuauaagaacugcuuccccaaaucuccacuguguuggcuuacagguauuuucaacuuaaucucugaauuggcaacuuauuauuuuaccuuaaagccuauuccuucucagaaccuucagcaucucuuaucucaguuuucguaaucacagacccuaagccuuuaauuccuaaagaaggaaaccuucuuuaaaugacuccauucuacccaaauucuagugcuauaccacagcacuuagccuuuucugccaggaaguaggacacaugaaaugcaucauacagucagaggccauacauccgugcuuccuuucugacauuuggaaaucuugaaagcaagacgauugcuuggggaaaaaacuaggaaggcagaggucaucgugucugcugaauauggcuuaauuuucuugaacacucaaggucaucauugacuauugacugcugcacagaaugugcugugcuauuacggccacuuucuagcucauccccugcuguccccaucugccuuugugccuguaguucacaguccuacuuuaguauauaccuuugaucuacugcaguuuggggcauuagguaauagaggcugcuugaagugaauguaaaacaagucagucaauuccaaaugaggugucuccuguagaguuaaucuuuuuuggcuuuauguuugcuauuucaguggcuaggagaccuuuuuuuccuggucuuuauuuugucuguguuccugaauggcugacauuugcucaagauugaauucuaauuauuugauaccuuuccuauuaucucauuugacuuuucucauacggaaaguuaaaaguacauuaguaggauguaucuguuuuagauuuucuguuuugggguguggucuuucccuucaaucuuaauucauucuggagaaaacccuuaucaggugaauauaauuauaaacugagugagaaaaauuuauugugaauuugagcccucaaguuaacguucacuauaauaaacaccgaaucuaauuuaagugggcacaauuauuuaaccaguugacacuuaguuauauaaccuacauaggcauuuugccuucauuaauuacucuguaauauggcuauucaccuguuccuguuaagccuuucuguaguuguuaagcacuauacacuuaacauauaaaacauacacaugguaugcuauauauaugucauccacuguuaagcaaggaaaaagaaaaaaccacagauuaaaaauacaaaauaaacccauaaaacuaguacagauucugccauauucugauauggagucaugaugagugagaucaucauugcugcaaaccagcaaacauugaacacucugagagaacaugaugcauuccugccagaaugauuucugugagauccagguaauucagcacuaacugaaacuccucaugaaguuggauucucaucaucuaccaaggaauaauucauuaucuccuuauaguuuuaucugcguuaucuaaauacauguaucaccacacagaaaaagaauugauggacagcucagcugcuuaucugcugcuccuuccuugugguauuguuuccuucuugaauccuuugcuaguucuuccaguuuggggacugugcauaguaaacguacagagucauugucugauaauaucacguauuuuuuuuuccguuaagcuuucuauuuugagaucauugcagauucauauaguuuuaagaaaaaauacggaguucucaugcaccuuuuuccuaguuuucuccaaugggaaaaacuuacaaaacuguugcagaauaucacaacuaggauauugauguugacacagauacaggacacuuccgucaccacaagaucucuccuguugcccuuuuauaggcacagacuuccuuccuaucaccacauuuuccuuagccuuuggcaaccacuauucuccauuucuaugauuuugucauuuuaagaauauuauauaaauggaaucuugcaguugcaauuuuuucggauugacuuuuucacucaguauaauucucuggagauacauuccagguuauugcauguauugacaguuuaauccuuguuauuuccgaguagcauuucuuguuaugaguguaccaaagauugucuaacaauuuaccuguuaaagaacaucuggguuguuuccaauuuugggcuauaccaauacaacugccauaaacauucauauacaggguuuuauaugacucaaagucuucauuucuccgagaugaaugucuaggagugcaguuucugagucauaugguaguuaaauguuuaguuuuauaagaaacugccaaccauacuguuaacauuuuacuuaauguuaaaaucucgagcuguaauggugaguuugucuguuuggccuuuuaauucuguuaguuuuugcuugacauauuuuacagcuguuuggcauauacacguucaagauaccuauaucuuauugguggguuuacccuuauguauuaauaguuauguaaugacccuuucugucucugguuauuuucuuuguucugaagucuauuuuaucugauauuaauacagccagcccuguuuuucuuugauuaauguuuguaugauacauccuuuuccauucuuucagcaguccauaucauuauaacugaagugaguuucuuguagacgguguaugauuaggucaugcuuuuuaagucagucuuccaaucuuugucauuuaauugauguauuuauuccauuuacauuauuguaauuauugauauuguaugacucagguuugccauuuuauuucucaguuuucuuuuccagccugccuugacuggccauuuuaaagaauucuguuugauuuaccaagagugcuguggaauguaucucugcucauagcuuuuucaguggucacucuguguauuacuucauauauacauaacuuaucauaguuauauauauauauauauauauauauauauaucauaguuuacuguugucaucuuuuuauccugucuuguuuuaauugucuuaaauauuuccuuuacauauuuuagaaucauauagauaauacuauuuuucuuaaacaguuaaacauaaugaagaaaacucaagauaagaaggaaagccuauuguauuugcccauguuuuugcuuuccauguucuuucuuccacucagauguuccaagauuccuuccuuuaucauuuucuuccuguuuagagaaauuccuauagcuauucuuuugcaggcagauguccuggugauaaauucuguuaauuuuuuuuuaaaucagagaaugucuucauuuacccuuuauuccagaaaaauaguuucacaggacauagggcucuggguugaaagguuuucuuucuuugagcacuugaaaaauacagucacucucuuauggccucccuggcuucagaugagaaaucugcuguuauucgaauuguauuucccuuguagauaugguaucauuuuucucuggcuaccuuuaagacuuuuuauuugucuucaguuuucagaaguuuaauuaugauguaucuugucauggacuucuuugaguuuauccuguuugaguucauucagcuuuucaaaucuguagauuuaugucucucaccaaauuuaaguuuucagugcuguuucuuagagugcuuuuuucaaccacuuucucuuuguccucuccuuccaggacuccagugacaugaauguuagaucuuuuucauugucugcagguccuugaggcucuguuuauuuauuucaaccuuuuauucuuuguuguucagauuggauacuuuaucauuuugucaucuaguucacugauucuuuccugucacuuccauucugcugucaagcccauccacugaacuuuuauuuugguaguuuuauuuuucaguuuuaaaauuucuauuugguucuucuguguaucuucuaguucuuugcugagacuucuaguucuuugcugaugauuucuaauuuuuucauuuguuucaagcaugcuuguguuacuuguuggauaugaugacugcuuuaaaaucuuugucagauaauucuaacauuugucaucuugacauaggaauaugucuguuaccuuuuuucguucaguuugaggucuuccugguucuugguaugaugaggaguuuucaacugaaacguggauauuuuuauauuauguuauaggaccuuagaucuuuauuuaaaucuuuuaauuguuuuccucucuuggacacuaccuuaucacugccaucaugucuagauucuggaaucuagaaguucagauuccccacuugcuuccauugacacaugagaggaauucaucuuguuacugcugcuggguaaggauuagaauguucucgucccucuuucccuggugaccuccacugacacugugccaggggcacacaagagcucauuacacagccagcagagaugaaagcccuagcucccuacuuggucuucucugacaccaucuuuguggggauauugauaugcccgguuguagccuugcaaggguggaaguuuaggcuccccauucggccuuugcuggcauggguacagguuggaccauaguuuuugcuguggugcuuggcuagaauagagucauuauuguguaagaguuuuccucucucuugcuuggcugccccuuuuuuggucccauggcuacagagagcaggcuuuugcuaggacuuuuuuugucugcauccauuggcauuucuggguugccagcuuguucugcuccaagccuaggauacaagaggcaaaaagaacccagggaacuuccuuccaaaucauuccuugggcccugaaaucccggguacacugaaaucucugguacacuggccuucuuuugcuccacucuuucagagucuuuuuuuuuuuuuugagacggaguuucauucuugcugcccaggcuggaaugcaguggcacaaucuugcuucacugcaaccucugccucccagguucaagcaauucuccugccucagccucccaaguagcugggauuacaggugcucacuaccacgccuggcuaauuuuuuuauuauuauuauuuuuaauagagacaugguuucaucauguuggccaagcuggucucaaacuccugaccucaagaugauccaccuaccuuggccucccaaagugcaggaauuacaggcaugagccacugcgcccggccucagagucuuugauauuucuuuucuagggugguuuuuuuuguuguugguguuguuugguuuuuuuuuuuuuuuuuuuuuuuuggacugaguuuuguucugucgcccaggcuggagugcaguggugcaaucuuggcccauugcaaccuccaccucccagguuccagcaauucuccugccucagccuccugaguagcugggauuacaggcacccaccaccacgccuggcucauuguuguauuuuuaguagagacggggguuucgcuguuggccgggcuggucucgaacuccugacugaggugauccauccgccucagucucccaaagugcugggauuuacaggcaugagccaccacacccauccuuuucuaggguuuuuaguuguucuuagugagaaaaauaggaaaaaguucuucuacuccauugucuuggaaguggaaguccaccugggcuuuaaggguaauuuuuuugcacaucaaaugcaacaaugauggguuguuguugccccucuucucagcccugugaagauaguaccccguugcuuucggaccuuuggaaucaagacaccuaguuucuuuacaagccuucuuuccuuucuuucuuauugcuuuuacagucuucauguguauucugcaguuucacaauuauguauuuauguguagauuuauccuuauuuauucuucucaugguucagaguuauuuuuuauuugaacaauccuuuaauuuuaauucuauaaaauucucagccauuauuuauuuuaacaugggcucucuacccucauucucuuauuuuuuuaauuucaaaauuccuguuagauccauguuagaucguuuccuucaauccuccaugucucuugaguucuuuuauauguucuguccucagcucucaguacugccuacugguaaucuccagguuuuauucugauucacuaauucucuccucaguuuuguccauuuuacucuuuaaccuauccauugaauaauuaguuuacagacagagugcucugucacccaagcuggggugugguggcacgauucuaacucacugcagccuugaaccccuggacucaggugauacacccuccucagugucgcaaguggcugggacuacaggugugugccaccauacccggcuaaguuuuuauuuuuauuuuuuuuaggaacagaauuuucauauguugcccaggcuggucuugaacuccugggcucaaacaauccucccuccuuaaccucccaaagugcucauauuacaguugugagccaacgcgcucagccuggaacuuuuuaaugcuaacaaaauucuaauagcauuauuuuuaguuugauugccuguaaccaugugaauauuaugagagguugaauaggcuucaucucucaguggugauuaacauaguucuuaagaaacgugacagagcuaggccaagcaucaguaaaggaacacacucuuggagcuuaauugaggagggagugcuugaucugaucuggaaaagaguguggaggugacacuuucaaagcuacaaacaggggagccaggaauacagagcagagccuuugaggccacagaaggagucaggcagcaguggggauuagcaguggugggucaggagcaaggguaaggaguggacuuagcagcugagucaaacggggaggagggaguugguguucugguacucccgagcuccuaagcuccuaagcuaugcagaauuacaguucuuugguaacagaaaaaacaaagugaauuaacauggguaauaugaaguuacugauacuacaucaugcuaauuaaaaauuuccauuuggaaauccuuuauuuccauuuuauaaaaaauaauaucccaaauuaaauauauuacuauguguaaagaagaaguuauucaguuugucauugaaucagacaaauuucgcacuugaagugcugaccuaaacuuggcuuaugccguuauacaaauuacagaugagggaaaagaagcaagaccacguaaaucugcaagugcagacaaaacuuauuuuuuuccuuuucccuuuuccccugcuuuuuaagaagaagaaagagguagacucuucaaagucuaccagguuuauucuuuuguacagaaaacacuugaaauuuucuaaacuaacuuugcugccaacugaauaugcauauuucuuugaauaguggcuagcaaagggacaaguuuuauucauuccaagaguaguuuucagacuuuaaccuugcaaaguaauuauucaaagagcacaguuuggaaaaccacugaauuaacaugucagccaaauaucuuaaaugugaaaagguaagucaacauauguauugucauuucacaagauacucaguuaccucuuuuuccuguuauauuaacaacuaagauacuaaauuugaugaucgugaucuaagaagaaauucacagcacuauuuugaaguuauuuucacagucucuuuuuaucuuucagauuuuuuguuuaaguucuugguuauuggaaaugcaggaacuggcaaaucuugcuuacuucaucaguuuauugaaaaaaaauguaagugucaugaaauuagucauucuuccgugcaugucuucugagagcccucucacucagauuuguuuacaguaaacuuaauuuuuucagaggaaaaaaguaauaguuugaaaguauuuugaaggguuauguuauugaacuuugggugaugugauuuuuuauuaaguuagcauuucuauuuaacaaugguucaguauaugguuacuucuacuguacauuuugcagaugcugagagaccauauagugauguugaagauagcagagggguucuguggcaggaauccuguuuccugacagagcagccagagaagcucuaggcauacauuuuggauaaaauaacaacauuugguccucauagugggcuuguguuguaguuaaggcaguugcugucaucaauucuguuuuauaggccagaaacagaccucuugaccacacagcccaucuuuuaccauugacuuucacuguuuugguaaaggagguugaauuuuuuauuucaaacuaugugagaccuuggaaggcuguagaagacuguagguuugaaaggcccuuaaaacaaaaaaugcuuuuuaauaauggaaagaaucguggagaaagaccugucuaguuaguggcaggugggugaagggucaaaaacagagugucuuauuuaauuaaguuuaucuuaagaaaguauaugugaggcaugguaggugguggguaaaaaggagaaagaaccaguuugggguguuuuggcagaaagcuuugaagaauaauaaaauccuagaaauuuacucugcuucuuccauuuucaucacccaagagcuuguuggagccuguuuguuuagugacauggacccaguguggcuuagucacagaacugguccuuacugaauuuaacaaguauucauucacuggauaguuuauuuacaaguugccaagacuuugugugguacagucuuagaaaagaauacccagaggguacugggccaaguacccagcuuauguaaucauucuguccuccucagagaacuccccugcaugguccucucugcaacuccucacaacaguaaugaacggaaggucucucuuuguaaccaggaugccccuggccuuuaguuacuauuuuuuuuaaggaucuuacccugcauuuuuccugguaguuuacuccuaauggaauuuccauacuaguucuauacugucugggcaugaaacagacuagcauagucacuguaaccauuuaucuacccucugcccuguaaauaauaaauccaguugccaguggcaucccugaucucugaaacaauuaaauuuuguucugcaguuacaaaauauaaacuagccaauggacuguauagcugcgauauucaauuucagcuuaucuguuuaucaucacagaaauguucuuucauaggcaguguauucccgcuggguuuagcaaaauacuuauuuugccugucuccugcccauucaaauaguacuaauuucuccaacaaauucaucccaaaucauuuccauagaacacuacgauuaaugaaaucucaaacaccuguagcuugcauaggguuuuguuuugggguuuauuggaggguguauuguuuugggguuuguuggaggguguuuuauuuugggguuuuuuggagggugcuuuguuuugggguuuuuuggaggguguuuuuucuuugguucaauuuuuuuccuccuuuucccuuuuccucugcuuuuccuuccacucacuguuauuucuuuaaaauauuuaaccauucaaauacaguaguugaaacugucuccaccucauuacuuacugaguuccacaccugucacugggcguuaugcccuucagaaugguacgcugguaugucagcagucaccaucugugagcaucuuaacagugcacaguuggaugugguucggauauggcagggcuacuuucaggcauagguuuuuaaauguaucauuuguuuggggguuuugagaaaaaucuuuaugucucuuugagaauaggggcuguguguauuaucuuuaaaacuaaaugcaucuucucaauggaauguuggagaaaugaauggcuagaguaauguccauuccccauugauguaacucuugguuuuagugucacuuguuuaaaucuauaagccuguuaauguucuaaaauuaaauaugcuguucuuguuuuucuuuuuuagucaaagaugacucaaaucauacaauaggaguggaauuugguucaaagauaauaaauguuggugguaaauauguaaaguuacaaauaugggauacagcaggacaagaacgauucagguagcuuuucucuaacuuaauaaaaauauuugaaaauuugauuuaaaauaauugaugauauucucucaauauauaaggucucacucccuccccaacacaccccuuccuuguccuaaucucagaaacuucauuuuuggaaacuuugauugacaagacagcuaaaauuuagguuagcucucugcagcauggauuacuaaagaauacaggaggaucuccgcgcaacugcauuauaauucggaggcugacccauucucaggaggauguggcacuguguauuguacaguauguuucuagauucaaaucaaagcacaagcuuguuuuucuguguuccuuuuuuaaagaagaacuuuuuaaaaccuugugaggguuuguuuuguuuuacauuaacuagagcauguucugauguuugauacacacuccacaaaauauucucuccacacuuuaauuacaauagggucauaacugaggcucagaaugacuucagucacugcaaaugagguuacauguuuaguauucuguaacuacuaaagcaagaaaauagauuaauauuuuaguugugguuuuugcacagaugcacaaagucagaacugauauucauaguuuuauaauucagugaaauaaaauccaccccauuuguaaacauuucacuugaaguugaguacaugucguauauuaaauaauugaaguuuggcugggcacaauggcgcaugccuguaaucccagcacuuugggaggccgaggcagaccuccucaccugaggucaggaguucaagaccagccuggccaacaugguguaaccccuucucuacuaaaaauaaaaaaauuagccgggcgugguggcaggugccuguaaucccagcuacucuggaggcugaggcaggaaaaucgcuugaacccgggagguggagguugcagugagcugagaucacgccauuguacuccagccugggcaacaagagcaaaacuccaucucaaaaauuaauuaaguaauugaaguucaauaauugcuucaaaaauaccauaaccaccuuuaaucaccaucauuuuucuggaagcauugauuaaacaugguggauucaauuagacauuuaugucuucccucucagaaccccacugaaaugucuguuaaguaacugaaauugaaguaacucaaaaaggccaagauugagugagugcacaauuaugauugagagauuuccaaaaaaaucuuaaagauaggaaguagauggugcucugacagcagaaggagcuccaccuuaaguacuguaaugggggaagccauuucuuccucuggagucccagaaaaggucaggauuuggaagcaucagguucuacaggagguagagguuacagagguucauguuuacacacgaaauaagagguucagucuuuuacguugaaauggagucuagacucaaggucauaaggcccaccugagggcauggggucaggccugaaaagagggaaauuaagugaaaaugaaagccucuggcccccaacccaccuccccuaccucuucccuggucgcuggcagccagguguguaugucccacauaggagaaaggagccuucucugcagaaaaaugaauagucagaaaggaaaggcuugaagguagugacauuuugcuuucccagucaaacagcccagucucuauccagucaucugaaagugaaacccuccaagcccaccugcuccacccacacauaaagagcuucuuuuagacuuuuucauuccuugcucuuaaugaucaggcagaauuuugaagaaaguuucuauagcaaaagagagagcucaaaguaaagaagcuggaacuuugagggaguaagaaaaacacacuaaaaccacaguauccuuaggaagaagagcagagauugcauuggaguauguaauagaaacaaagucauacuuaaaaagagcaaucagaauaauauguuaaauaaacucauggugaaaaaugggagagaugacauaaagaauccuccagaauuaauccagaagaugcaaugacuauuaggaguuccagaagagagaagagcagagagaauaauagaagaaaauguuucacugaaggaaugagauuccagauuaauuggcccaccuaaaaucaaacauaguaaggaaaaaguccagaccagagcgugccaugugaaauuucagaacaccacagaugaaguaaggaagaccagaaagguuccaagagggaaaaagcagccacauauaaagugugaaaaauggaauugcuuugcacccuuccacagcaacauuggaagcuaaaagaaauggaagcauugccuucaaaacucagggugaaauaauucuucaaccuaaaauucuaaacuuagccaaacuguaagugugcaaguaaaggcugaauaccaacagaugugcaagaaagaggaggaagccaagauuaucuuucucagagacuucuuagaaauguacuuucuuagaaaguuuaggaggauauacuucaccaggacaagggcaugaucccagaaagaggaaaaugaagccagcaggaagauccagcucagaauggcacaggucuagagggacagugagggaagacuaagacagcagucaguaugugauggcacugcccuuccaggaggaccaggggaacaagugaggggcucuguaagagcucacgacucugucagagcggggaagaaacagcucugaaauucaguuuccuaaaccuuuuguagaaaugagaagaaagaaacuguaagauccaugaguguaaggguuuuugaguuuucuguuuguuuccccugugcccagaauagugucuagcacacaggggcgcaguaugugcucuuuuaaugacuuaauuaaaggaaacccaguuaccagaaagagagaacucaccucgcuuguggagaguagggcucccagagaggagugaggcaggagauggcuguguuuaauuuagagacuuuucgugacauuucacuuuaaaacuauccacauguauuauauugguuaaauuacuuuuguaagaaaauguggcacauauacaccauggaauacuaugcagccauaaaaaaugaugaguucguguccuuuguagggacauggaugaaauuggaaaucaucauucucaguaaacuaucgcaagaacaaaaaaccaaacacugcauauucucacucauaggugggaauugaauaaugagaacacauggacacaggaaggggaacaucacacucuggggacuguugugggguggggggaggggggagggauagcaaugggagauauaccuaaugcuagaugacgaguuagcgguugcagcacaccagcauggcacauguauacauacauauguaaccugcacauugugcacagguacccuaaaacuuaaaguauaauaauaauaaauaaauaaaaggaaaaaaaaaagaaaauuuaacaccucaaaguaguauucuuaaauguguauauuuguauacuggaguaauuuguauaagaaacuauuugucaagacaguguuguaaaauaaauuugaaaguaaaauuuuaagaaguagaugugauacagcuuaucuugaagagaacucguaguucccucuuccucuagaagcuaggugccugcugagcaagaauagaaaggcgcugccucuuaauagaugugaacaagcgaggccuuucccccugccuuaggaggcuguggggugaagagcaaacaguccacucugcaccucuaccugccaccaguccuuaaagcgugugccucuugcuaacagucucaaggcagagaggaaaagcuucaagcuacaugaagaccuugaagcuuccugacuaagagcuaaaaaguacauuuaaaaguagcucuucuuugccaagcagcaaaguaauaauuaguaauuuuguuuguuuguuuguugcaagcugcacggguuucuuuguucuccaaggauaguucauuccucuggugucuuuuuuuuucugacaucaagucuaugggguuuuucuucacaccagccagucggauucucugacaccagcuggguguccaacacuucaauucacuuuugacacuacccagaguuaaaggggacccuccaggcuaaggagaccuagacugccacccccgcuucagacaccagucacaacuggagugcccaggcuuccugcacuucuuggccaaauacagaucuggcaguucccacacccuccaucccucacauccccaucagguuggagaauuuguuagaaugauucacacaacucaggaaaaacauuuuuccuggcauuuacugguuuguuagauaggugucaauucaggcacagccugguggaggagaugcuuaggagacgagguauggggaugggccaccucccagcaccuccaugccaccaccagcccaggagcucucugacccccauccuuuugguuuuuuuguggagguuuuauuacaaaggcacgauugauuaaaacauuauccauugaugauugacucaaucuccagcuccucuuuccuccccagagggcugaggugaggcuauaaguuccagcacucuccucacucggugagggcucccacggccacagccccgaucccaaggcucucuagccugcuacucuucccacaguuaucuccuuggcuuacaaaagacaccuuuaucacuaaggaaaucacagggguuugggccucugugccaggaaccugggacgaagaccaaauauauauuuuuuaauuuaauuaggccacaguuaaguucugggaaugucuagcuagcagugguccaggcccugugcuaggcacugggauccucuggugagugagacagcagagcccugccccauggaggggaggcaggcagccaacacagagacagagacagaaagagcaucccaccaagugggauggugccacccaggagacagcacgcugagauagaggggguccacuggauggggaugcuuggggaacguugcugaggagauagaguuaaugagacccaagggacaaggaaagccagcggugugacgagcccagacgggaguggcaggggcugggagcagggaagagaauggggccaaagggacagguacagugacggagauguccuguccugggccuugaugaguugggcugcucugaagaauggacugugggccacacauggcagcagggacagcagcgugggcagacacaggauuuguguaguguaggagacugcacuaggcuggcggagugaauguggaggugcacaggaauugaggaugaauguggagcugauuugcuuuagaaacagggugcguggugaugccucuuccuaggccaggacgggccuggagggugggaccaaaaagaguccugcugugcagauguuaaguuugacauguuuaucaggcagucucauggagauauggaggcagcacuuggaucugagcuggagacaaaauuugagucgaauguuaagagagcccaggacccagcucuggggaaucgcaaucccagcagggcagauucagaagaaugaccagagccagagaaguggcuggugagcgggaggaagacuagcagagugcagggcgcagaggcugcgcgagugagugaggacagaaaugcccacuccagcuucgguugcagagaggguggggaccuugacaggcuuuuggggaguagcagagauggacacuagguuggcggugaagaagaggaagcugcagguaaagacagcucuuucagaaaguuggauguggggccacgcgugguggcucacgccuguaaucccagcacuuugggaggccgaggcggguggaucauccgaggucaagaguucgagaccagccuggcuaacauggggaaaccccgucuguacuaaaaauacaaaaauuagccaggcgugguggcgggugcagcuacucaggaggcugaggcaggagaauugcuugaaccugggaggcagagguugcagagagcugagaucgcgccauugcacucuagccuggguaacgagcgaaacucugucucaaaaaagacaguuggauguggagaagagcagacagugggacaguaacugaaaagauggugcagcauauuucuguuuuguguuuuaagaugggcgguaccagagccaauuuauuuuuauuuugcuaauaggaaaaauccugaacuccuggcuuuuuuuuuuuuuucuuucuguugccugggcuggagugcaguggcaugaucgcucaccgucaccucaaauuccugggaucaaacaguccuucugucucagccuccugaguagcugggauuacagguguguacugccauaccuggcuaauuuuuuguagagacagggucucucucucuuacccaggcuggucucaaacuccuggccucaagcaguccucccuccugggccuccuaaagugcugggauuauagguguccggccacuaaugggaaaaaucucacaaagagggugagauugacaauguaggggaaaacauguaugaccaaaagacgccuucuugaaugugagaguggauaugacauacugggacacucaguuuucccguaguaauagggcagggaugcagguggguguagggccguggugacuauggauuccuguggugacuauggauuccaccgcgccgagagguggcgagaacuggaagagauggagaaaauugugccagggagugggguagaugaggagcucgcagagaagugaguggauugcugagccccuuaguguccaucuaggggguggugcuggcuuccgcagacagcucacccugcuaggaguucucaaaggagacauccaucagagagcugcauccgcugugaaggaaucuccuacuugccacagugaugugauuucaggcagaauaaccccucacauguauguucaaauaucuuugaaucauuucucuuuuaaaccagugucugucccuguguugugguuuacaaagcaagcauggguguuuuuucaugggaaagugggauacaguaaagggucucaauugguugaaaguaaaaccaguauaauucuuccagguccgugacgagaaguuauuaccgaggcgcggccggggcucuccucgucuaugauaucaccagguaaugccagcucccccuggugaaggagggugcucagugcccugcagcccaaaggcuggucuuggcgaggugcccuccgugcagugugugcuuuguguguccagggacggugguguggcuggcauccaggaagccccuuagcccuuccaucuggggucucagaggucuuugaacgagccccuaccacugcuuuccccugcagagaaauguguuuguaagguuuuagguggauaaagcaauccaugcuauuacauuacauuucuugacaugaugcuuggacacuuuccuuaagguucacaaagcuuuauguauggaaaguuauuagaagugaguugagagagggugaggacacagacucugggcugagauugcuggguucaaaucccaguugcagucacuagcugauugacccucucaggccaggugcuucagcugccugggccuuaguuuccuugucuguaagauggagauaguaauaaucacaugauccucaggagguuauugggagguuuaaauuaguuaaugugaagcaguuaguagcuguuugugacauauggcaauuuaacugaaauaaaaaauucuguuccucgauugcacuggccacauuucagguccucaguagcuacauguggcuggugacuaccauaucaggacagauuauagaacauuccuauccaugaggaaaucacauucagcagugcugaucucaguagcacugucuuagaaaugugucaucuaaauggcaucaucugggggcccuuucuggguaggaaccuguccagugagaggaugucacucagcagccgcuucccucuuccaaucugugucccgggagccaggcguucugagaggaggaaggcaguuucuggcccagcccuuccugcacuugcccaggcagugaaaggcucagccugcuaaagugugaagucaucaaucaggcuagcaaagugccaugagaagaacucaauccuuagacacaugagggccaaaaauaguaagucugagaguugguccuggagucagacagagcuggucaaguccugacuuugccacuggcugcuguaugaccuagggcaacguaauuaaucucucugggccuuggauuucucagagaaaaggggaauaauggcagucugugucauggaaucuuuauaaagaaucaaugugauaaaguccuguaaaacaaagugcuggcacauugcaaggauucauuaaguggcagcaauuagcuaugaaaucuugccuaccagagucuagugccuugcgcaugcuaagagcucaauagauauuugucaauugaaugaaggaacaucucuuuccuuuugccccaugacugggcaaacgaaaaauaacaaaauaucucacuugcugucucauuuuaccagaaacaaaauggaacaaacuguggguaugguauauacuuggugcauucacguugucugaguuaucuuaaagguguuggugccauuacccugaaauguugaaaagcgguaugaguagugagaaugacuggaaagaguugcuaguuuuauaaaauacauguauuauuuucacaaucuuauauuacgcagccgagaaaccuacaaugcgcuuacuaauugguuaacagaugcccgaaugcuagcgagccagaacauugugaucauccuuuguggaaacaagaaggaccuggaugcagaucgugaaguuaccuucuuagaagccuccagauuugcucaagaaaauggcaagugaccuuuuacuucuuacuauuuuucaaaucgcauauuugaggauaauagcauuucuuugaauuuaaaacauauauuggaauuucaagauuaaacuagauuuaggaaauguggaauuuccaauuguuuuuuucuauaaauuagaccuauuaagcauauuuuuaguauauugcauucugccugcagaaguuacuauaaugauaaaagcaaauguaguaacauuauguaaugacuuuucagucuagggucuuugaauauuagagaucuugggcuaaagugaaauuaauaauauuuaaagacucuaaccaaaugaugucauuauuuuuuaauguauuuugaaggaaauuuggugaaauauuaacccaaauagaaagggaagcggaagaagaaauacuuggcuuuuuggcuucauuuuaagucauuugguuauagacaacuuugaaacuuuuuugaauuuccauauagaauacaugaaaaugccacauaaaauuaaugguugcuuaauuaauggauaagagaaugauuuuuuaaaacuucagacauuuuaaauaacuuuaauuuuuagaaccaaaaacuagaauccuaauaucaauauuuggacucuaagauuccaaauuauauuguaacuugacuaguuucuugcuaagaaaauaaacaugagagaaauccauaugccaucaugacaguuuuuaaaaagcuguuuagaaaucagaaguuuagaauguuaacaaagaugaaaaggaauuuagaugucaucuaaacucauuuuuacaagugaggauacaagaggcuagagaggccaugguuugcugagagagcaagcagaacaggccuuucugcugagaugaacagccacucugguggguagaaagaguauuaauuccuauacugucucuucaugggcuguaugacagauugcaauauaguccccuaaaaaguguaaacacuuguaggucauauuuguggugacacucagauuguuugaagaaggacauugcaacuuucccugaaaucaauggcagggccauuuuggcaagccagcuccuuucugaugggcugucauuuggcuggggaagccugguugcuugcucagccccuucaccagguuaagugcuagcacaagauagcaguuacuuuucagaaaaggcuaaaauucuuuuaacauuuaaaaaacacauaaugacauauauugauuuuauauuuacagaaauauaugguuuuaggucauaaauuauauuucgucugcuuuucuaagagaaugcuacacaggcuuuuguaagugaaaauuaugaucaucuucuaaacaugacuuuauuuuguuugauguccauuuuagagcugauguuuuuggaaacaagugcgcucacaggggagaauguagaagaggcuuuuguacagugugcaagaaaaauacuuaacaaaaucgaaucagguaaaagccuuuccauuaagcaacuuuucuucugcauauuuuacacuguagcucaguagaucaccuuuuaauuaauaguuucagggugauuuaguaaagaauguucucucucuaccugccaaccuaaaaucaucacauauggguucaaagguccuguucuuaucaggaugaaagccccauccuuaucaggaugguuuccauggugaugaaaguggaugggcacaccagcucagcuguggaaagguagucaagguuucagggaguguuugcauuuagaaccauagucuuucuuugguccuucacuaaacggaggaagaauaggccuuuguccacucugucaacagcacgcuaauucuguugggccaguggucauguguaagggaguuauagguacaugguauaguguugauuguugcagaucgggcaucauggaacuauggaguccagaguaauuuuauuucugaagcuuacugagcaugccucaauuauaaaaugccucauuuuuguauuugcuuauuaaaauaauuuaaaauaauccuaauguaggcagcugacgaaauacuguguaguugucauuuacuaaaguaacuauauaugggcaucaccuuuuaauugauucauucaaacaucugagugccuauuugucagaugcugggauacaaaaaugaauaaaucacaccccuugccccccaagaaacugucuuucaugggagacagucagaggauaauuauaauaucacaaggcugauguaguagcugagagaugcacaggcucaggguaacgugaagaaggggaccugccccagccagaggauagaggaggugucagggagggcuuucaggggaggucuuagaugagcucagucuuucagaauauaaggaagagugagccagcaaagggagugaggaagagggaauagcaggagaaaagguugaagaaaggcaggagccagccaguccucaucaaggaucuagaacuuuaucuuguagauuaccaauugucaacccuggaugagcacuagagacacugagaugcauuaaaaguucuaaucccaggcucugccucuggagacgcugaacuaauugggcugaaguauggucgaggcaccaguguuuuuaaauguuuacucaugcuguucuaauguucauccaagauugagaaccacugcuguaggugguggguugucagcaggugggugaugugauuggguugugacuugagauaagucauguauguaggagguuauguugaaaacaaacugaagggaggacaggccuggaggccaggauaccaauuauaaggcauuuuugaguaauccuaguaagagaugacugauuaaugcuuuaacaaggauauggaagcagagauggagagagagauggaucuaagauauauuuaggcaguagcaucuuaugacucauaugcccaauagugggacaggacaacugacucuuaggugggacaaggugaggaggaagggccagcaggggaggaggaaccaaggaugacucgcagcugucacacuggugucucuagacagagaugggguggagccagaggagaagcagggaaugugagggaguaaagauggcucuguugcaaaugugcggccuuugcgguaacgcugagacaugaacauggaguuaucuaguaagcuuggggaagaguuccuggcuggcaguauaaguuugggaaccaucaauauauaggaacagcuaaaacuguggaagcaaugugaucguccggagaacaguguuuaaggagagcagugaucaacagaacccuggaguuggaggaugagcagaggaagaggaaucuacaaaaaagaugaaaaaggaaauggucggaaaugugugaagaaaaucaagggaaugugggugucacuuaagcccuaauuauaagcaaaucaaaggaguguucauuauguaauguaauaguaacagagggaagccucauaagcuaagacugagcugaaaaacacacauugggauggggaauagaaagucagugaucauuuugaucaagaacaauuucagcagaauuaugaagguagaagauggcuggccguccguuaggaagaaguaggaggugagcaagcagaguguccacuccucuccugaggaagcacaggcuggcacuguagggugcaaaggguuaauuuaaagcugggguugugggugaugggagaaauuccagcauguuuaaaugcugagggggaaggagagaagaaugggcaaggagagggcagggaagaaggagggugcuaggugaaguaggagggaggagagucgggcccagguagaagggcuggguuucaacagaaguggacaugucaucuuuuuguauuuuuuuuuaucagaaagaaaaaaaaauuacuaagcuugguacaaaaaccaagacacuguuacauaaauccuuacaguuggcuuacuguugaguauuauuaagcucagcaugagguuguauuuacaugaccuugcuauuuuaauauuguaucccugaaugcaucagauagaacaacucauaugcagucuuccaagauguguuuuuuucugagaucaucaaaaucauaaguaccucuaggugaaaaaaauauaagaguauaaauuaggauucuucagcaguacuuuuuauuuuuuuaauggguaauacauucagaaaccauuguuuucuucccuuuuuuuauauaaaauguaucauaugauagacuaccacgccuugcuuuuuuacuuacuauuguauaaccuacaaaucauuacaaaucagcuuauaguuuccguauauacauauaauacauaagguacauauauauaacauaaugucauacauaauguguguguguaauguguaauauggguugaguaucccuaauccaaaauguuccaaaaucugaaacuuuuuaauugccaacauugccacugaaaggaaaugcucauuggagcacuucaaauuucagauuuucagauuagggaugcugaacugguaaguauaauggaaauauuucaaaaucugaaaaaauccaaaauacuucugguuucaaguauuuuggauaaggacugcucaaccuauauuuggauaaggaccgcucaaccuauguguuaccauaauucaugagccagucuacuuuggacauuuggguuguugccaguauuuugcuauuauaaguaauguuacaguaaauaauuauauauauauauauauauauauauauauauauauauauauauauauauauauuuuuuuuuuuuuuuuacaugugcaugagucugugugucagacaaaugcccagaaguggaauugcugggucagagaacauaagcauuugggaucuugguguagaggcugucacauuuucuccuagugaugggcuuauuucacuaaagccauguccacagcauguaguaucaucauacuuggacuuuuggcccaucuaauaagugaaaaauuauaucuuuguaauuuaauuuuaaauuauuuuauauaaauaauguauucacauaauuugaaauucaagaaguauaaaagaguaugcaaugaaaagucccccuguuaccacccccuccuguccucagccaucuagaacuccuccgaaucagccguuccuuauguauccugcuagagauguuuugugccggugcaagcaaacauauauauaguuuuuucccuuuauucagaauggugggauauauacacaguguucuguacuuugcuuuuuuuuuuuuuaaucuauuuuuggaaucaaagaaacauaaaagccuuuuuuaaaagaagacuugcuugguccuuaggugagcuggacccagaaagaaugggcucagguauucaguacggagaugcugccuugagacagcugaggucaccgcggcgcgcacaggccccgaacgcucaggagugugguuguuaggagagcacacagguggguuuggacaccucccugcccugaguuccuggcaagcucaagugcagaggccuguuaaagcuuugggaagcugcaguaugaaaaagaggggaucccagccgggugcaguggcucuaauuccagcacuuugggaggcugaggugggccaguugcuuuaguucaggaguucgagaccagccuaggcaucauggugaaacaucaucucuacaaaauacaaaaaauuagccaggcgugguggcgugcaccuguagucccagcuacucaugaaacuuaggagaauugcuugagccugggaggcggagguugcaguaagccaagaucauaccacugcacuccagccugggcgauaaagugagaacugucucagaaaaaaaaaaaagagaaggagaagaacccauaaguuaaaguuggauguucuaacugaaagaauuuauacucuauaggaaauucuuaugcucuuguucagaaagaaaggaagggcagguggugguugaugggaagggugagauauccugauuccuuaugucagugaggagcccuuccuggauugauugaggucuaaaugaaugugccuuuugcuaaaacaggaggccuauuuauaaaauugacaaaugucucccuuuaacuuuuuaaagcuucuucuuuuuucccauuuaccacaguggacguuuuauuuauagucgacaucauguaguaggcacaggcaaguguuaaaagacaagauauucacgaauucucuuuuaggcuuuaagcuguauuuacuuuugcauuuauaguuaugcagauuuugaaauuguucuuaauauuuuuuagguguucauacaguggcauuugggacacaaucguuggaaccugaagaaucugaaguuuuuuuuaccaccaucuuuuucuacucuguauggaaguagaucuuuauggggaaaagagaauuugggguguucugcaagccagucaaaguggcacagcaaaucauauaaaucgaauuaaauggacaacaccguuagauguguauguaaaaauuuucuguuucauauuuuuccuuucacuuucgguuuaaaacaugcuauauguacuguauguccuguagcccagugcggcuccacagcauggaaucugauguaugauaugauagaauguggcacuaaaugcaguuucagauuuuauuuuuuuuaaucauaugaacuaaaauugucaauugugaggugugcuuuucucaucauguugguuauauugcacaauugguuauauuuaugaccugauauucaaagacucuggcauugauagccaguguguuuucuuauuuaacuccguuuacuacauucuacaugguguuuacgugauccacacuugaaauacuagaucaguagacauucacuaauauaccaaaauaaaaugaaaaauugaguuuuuccgugaacuuuauacuguccagcucuguugauuuuaaagccucuucauccaggucaguucaggaaguauaucuggaguaccugcucuguuuuuggcugugagacuagcacuaaggauucugguaccuuuacccaaaccuacugggcuacuaauacuucucucagcaguugaucaaauacaauagaccauguaagcuggggccgcucauccacuuccaguuugcuggucucccugcuagaaaacacauuguacugugcuuuuucuggaauucaguauaauggcaucacugccuguuuuucacaucuuuuguuuccuguucauuuuaaggaaaccuacuaaauccaguuaauauuaaauggacaccacuca

SEQ ID NO: 191998 - RNA, 21937 nt, Homo sapiens
agaggaucggccgggcgcggcgggaaggagguaaggcagccccgcgggaccgcacgccuagcucaggggacgccuccggagaccccaggaccacccgaucacgggccccgccgcuccccucccucgcuccuccucccgcucagccccagucuccugcgguccccucgccccagcccgcagccucccugccuuccgcccacugagcagcccuccucggcggcgcgccccucgaccccagcagccccgguccccgccucugcucuuggucccggccgccgggugaggccgcccccgccccgcccccuccccgcccucgccgggacccgcccccugcucccguccgggcggggcuccggguuuaaacgucgcggcgggcagggccggcggaggggcggggcggccucugugucguguaccgggucccguaggcugcgggcagcgaggagcggcuggcgcucgaggcggcggacggcaccauguccccggggagcggggugaagagcgaguacaugaagcgcuaccaggagccgcgcugggaggaguacgggccgugcuaccgcgagcugcugcacuaccgccuaggccgccggcugcuggagcaggcgcacgcgcccuggcucugggacgacuggggcccggccggcuccucggaggacucggcgucgucagagucgucgggcgccgggggccccgcaccccggugcgccccgcccucgcccccgccgcccguagagccggcgacccaggaggaggcggaacggcgggcgcgcggggccccggaggagcaggacgcggaggccggggacgcggaggccgaggacgcggaggacgcggcucugccagguacccggcccggaggggagcgcgaggggccugcacgcagggacgguuugcucuaagcucugagcagcugaucucuuauuucuugcgccacucggggcuggcucuuccuuuuuuuuuuuucgguugacagaauccgucucucuugacaaaauagggaagguggcagccuuugccacccuuuauuuccuuaauuagguggcuuucggucgagccagcggugaacucaauugaagcgccgcuggcugagucuggggucuuuccucgcgggccucugcggcuuggcaaaccucugaaucccaucuuauuucuuggcgaaccacugagucccaucugcuuauuucuaggcgcccauuuuugaucagaggagccccagcuuuaaucagauucucaaagguaacccaaaagguuaagaaccacagagcuaagcuuugucugaugaauggggccauuguuuuccguauuaacuccccgaccucgcuacgcugucccuaaagaauauuuugcauuuguuuacguggaguguugaauaacuuggcugugagagcaucuuuauaagugcuagggccucuccccuuccgucccuccccauccucccucgccuguccagauccgaaagcgccgguggcgcugcgcguguuuucaaggcauggccccuucaccuucuuuccugcccagaggcuugcagggcuggggacccaguugaacgccucaguacagccuggaguaaccaaugguuccuuccagaucacuggauuuuaaaaaggcucgagugaggaaaacauggaaaauguauugggagccuguuagacauucagucacugaucugggaauauguauguugucauuuaauauucaaaacaaucccaaaagagaccauguuguaaucuuuuuuuuuuuuuuuuuuugagacggagucucgcucuguggcccaggcuggagcgcaguggcgcgaucucggcucacugcaaccucugccucccggauucacgucauucuccugccucagccucccgaguagcugggauuacaggcacgcgccaccacgcccggcuaauuuuuguauuuuuaguggagacgggguuucaccauguuggucaggcuggucucaaacuccucaccucgugauccgcccgccucggccucccaaaguguugggauuacaggagugagccaccaugcccggcccuaaucucaguuuuauagaugaaaaaacggaagcucaggaucagugacuuuauucauuuauguguuuauuuuuguuuacccgauugcaagccaaucagacucuuccuggcuucucugugagaggcugaggaggagaugaaauuucggcuaugagccggguugcuuugcucuugguuuuaccaucuucagcuauuuucagcucaucaucggaggcagggcugccuccucccaucaugauguuacuugugaauccccacaaauccugaugcuucagugaucacugcuagaaaugcaaauaacagaagguggaggggguagggaacaugccuuccagauuauuccuguggguacugaucugcuagcuaaauugagauguacuuuaucaggcuaaauggcuuuucucuccccgaucuuuuauuguuugugauggaguugucaaauauuugcaugcaauauaaauacaauuuuuaggcagcguugugauauggauggugccuguauuuaccagcucagguaagcucugaguucaugauuauuuugguuuccuuaaauauagcguccucucaguuauuucuucccugcuaacguuucugguuuaggcaucaggaagaagaaaggauguuuucugcuuucaggacucaaucgcagcaucuuuuguuuugcuccuacccguaaggcccucuugacuccuguguugcuugcacaagauuaaauauccugguuuuuaaguggaugguuuuaaauacuagugcaaugagcacucuuuugaguuucuauaaaauauaaaauuuuuuacuuucccugaagccauagaugcacauagaaucacguaguucugucugacuuauuacaaaagcacaucagcccuaugccauacauaacacccugguuuuuccuuugguauuuauuucuguaucuccaaguaacauggcuuuuauugacaugugauuguuuuuuuucaguuuuuaacauuaucuauugacuuuaauucuuuuuuacugcucuccucacccacacacacacggcccaucuccacaccugcacaauacaguccucauagaguuuguuggauucauaauuaguauguaccguauugugcccauggaaaaaguuacucaaagcugacccauacuauuucccaugauucccuuuuuucuuucacaauacaaccaacacaucagguucacuaucacucuugucaucuuaagaugccucucccagggccccugaccuacuucugucugggcuggcugcugcuccugugggcugcugccuggcuggcaucuugggagggcccuuggccauccuccuaggaccuuucuuggcuucucucuuggguuugagucucugucgugugccuuucaugucauuuucuuucuugguuuaccccuucuugguggagcacaucuucuaguagauucccaagaaaggaugguucagagguuagcuuucuuugaaugccaagagauagcuuuauucuacccuuacaauuuggugaguguggcugggcauggaauucuagguuggaacaguuguccguagaaacucugggggcauuccuccuuauguguuaugacugcugauguuacagccugccucguuaugauucuugaucuugaucuuuuguagguaauguguugcccucaggaagcuuucacggucuucucuuuggccuuuauguucugacauuuuuccuugaucuagaucuguuuuccuuugcuuugcugggcacuuggcaggucuuuauagacaaacucauguuuuuaauucccggaaguuuucuggaauuauuuucuuauuucuguuuuuuuuuuuuuucccauuucuuuuuuuucugaaguccuuaguuggauauuagacuuuaucauuuuauccucuaauuuucuaaguuuuuucuugacagauuuucaucuuuuauuguuuuguuuucugggugauacucucagcuguaucuucuaaaucucuuauuacauuuuccauuugagggauccuauuuuucuuuuaaauguaagagcucuugaauuguuuucugggcugccauuuauucccucccuuaccucccuccuuuccgucccuuuuuauuucuuuuuacaacacaguaucugguuccugauugaugcauguaggguuuuaucuuacugaggauauauauuagaauuuuucguuuguuuucuucucuuucuguguuucuucagcacaaucuuucacuucugccucuuuguuucuuuuugcugguaauucucuauuuucauguuaggcacuuuucucaaaugucuaaugauccuucguuucucauucuuauuuaagggauggauacuaaaaagcuguuaggaaauucuguguguguguguguguguguguguguguguguguguugggguuuggggguggaagugcuugugaaccgugagauucuuuuccucccauagccaauaugcuaugaagaguggucuagacugucuccgauuccuuacuucauagucacguuuucuuuuuagguuagauuuuauuuuuagcaaaguuuacaugugcaguaauuuaaaacauuuugcuuaaaaugaaaaaaacaugauccugccccauuucccacccaugccccuugcuccuuucacucaguuucgcuuuccuuucagcauuggccacccucuuuuuauuuaaucuuaucuguuggcuuuuugauugugaacauuaucuacugacuucccauuaugggagaugaagauuuagcucaggaucuuagcucugccuucccuauucuacccccagacacauaccaacacccauuuccucuucuccauauccccacaauauuaacuauaugauugcuuuguuuaaucucuguucuguguuugaauuauggcuguguagauauuugcaggugagccauguaauauauucugauuacauuuuuuuguuaaaauuuaugguuuuccugaaauugauaauuguuccacuuuuuuguuugcuuauuuuguuuuuguuuuuugcuucuacuccaguaauagguuuauuaaaaaauaagcuaccuaucacugccuaucacaguuucuuauuucuuauuuauuuuagcuaucacuaaugccugaaauggccugauaguacuaugaaacuugccauuugucagacauauuagguauucuauucaucugauuuuuuuuuucccuuggagacacgcacacacacauauauauauacauauauauauauguauguguauauauauauauauauauauuuuuuuuugagccuuugaucuuguuccagucuagauuuuaugcuguccagccuuggcacagcugcugaacugggcuuucuuuauuauuucccuccuuugugugauccccugccuugcacaucucaagucuuccuuuugcuuggccuguuccuuccuuuugauggaacacauccucuauagauccuguaaaauauugcgugggaauuagaaauuuuguaaccuugcauaucugaaaaugccuuuauuauauccaggauugauauuuuggcaagguagauuagucuagauuggaaaccucagcauuugaggcauuaugauaacacugaauccuagcuucaggucauaguguugagaaggaccaugccauucugacaccugcuuugugugugugaccccccuauguuuguuuuuguuguuuuguuggaaacuuuuaggagauucuuuauaucuuuuuaggagguguucugaaauuuuguggugugccugugugugucuuuuuucauucauuuggcuggccuuuuucauucuggaagguucuuucaguucagugauauuuccuauuuuucuguuuaaaaauaauuuucucugcuccauaugcuuuauuuucucuuucuauaauuauccuuaguuggauggugugccuccuggaucaguccccuaacauuuuuacuuaaaaauguuucuacaauggaauuuggacuuuuugguucuauuuucugggagaacccuucaauguuauuucccaacauuucuauugaaauuuuuaauucucaccuuagcuuuaaauucccaagagaucaucuauuuuugguccauaauguucuuuacauuaaaaaaaauagcauucuguuuucagauuucuuuuaaccuacaaagaaaaaaagaaaagaaaagaaaaaggccagaaauaucuuuucagagcugucuuccauucccugccuugccuuuuucugcauaauuuuggucucuuccuuacuaauagaggauguacucagauguuugcucuuagccugucugcucauauuuaagaguaaggccuggaagagcuuuuuaggaggucugugcacgggggaugccuguuuucuguaauuggcugaggacccagcuguuccucuggggacugcaaacauguauaccugccagcgucucuugagugagcugcccagacagugcaucugcagucuccugucucauggggaauaagccuggcaccagcauccugggaacagagguggaggaaggugccgaggaggggucuccuuuaccaugaggccuuucaccuaauucuguuuucaggaagcuguuucccuugguuucuccugucccuagggucaucugaaguccaagccuccccugcuucugccgcucaagacugaaauccacagaccuucuggguaggagaggagugaccaccuggcauaugagcuaggggaaagaauauagaagugucaauugcuguguaacaaaauuaccuugaaaauuaguagcuuaaaacuaguaaaaacaguugucccuugguaucugggagagauugcauccgagauacccccauggauaccaaaauccguggauauucaagucccuauauaaaaugguguaguauuugcauauaaccugugcacaucccucggauacuuuaaaucaucucuagauuacuuauaauaccuaauacaauuaaauacuauguaaauaguuuuucuacuauauuuuuaauuuguauuacuuuuuauuguuguauuauuuuuuauuuauuuuucccgaauauuuucaauucaugguugagugagccugcagaugcagaaccccuggauacggaggcccccagccugcuguccuccuuugcugcugcucugguuuccugggcuggaaguuggcccugggcagugagauaccuugucugcagccuguacuggaaggcuccaggcuggagggacccggcugggcuguugcugggacccucacaugcaugaccucuuccugugccuggccuuccucagaacacacuagcugaccuguaaggacagcguccggagacagacccagguugaugcugcguugcuuuuucucuuuuauccucaggagcucugcaggcccuuucucaccccauuuuaccuucacuggggaaguuauuacuuggugcaauuauuuugacaccaaccuaauauaaaagucugcccagguucaaggggaggacccguggaucccaacucucaacagagcacguccauauuauagucagaagagcacgagggcuggggugcugauugaugcugaacuuuuggaaaagagaauccacuucacuagccuucugacgaagcuggcaccucauacaacucuuucauuuuuuuuuucuuucuuuugagacagggucucagucuguugccuaggcuagagugcaauggcaugaucuaagcucucuguagcauugaccuccuggguucaagcaauccuccagccucagccucgugaguagcugggaccacaggugugcgucauuauaccuggcuauuuuuuuauuuuuaauuuuuauuagagaugaggucuugcuauguugccuagcuggucuuaaacuccugagcucaagcaauccucccgccuuguccucccaaagugcugggaugauagacgugagccaccacaucuggcucaugugauucuuucuagggcucagcuucuguccuggaggccuuuccccucuggcaguuaggauucauccuacucaguucugugaggccauuuuuaccucuucaguugcuuuucuuuuccuccaaauuuuauugaugccuuuugccugaugucaucaccucccuugcucucuguccuuguggcuuuauaccuuuuuuuccuuccuuuaguaggauuuggagaggaagagacuauaagcuuuaaggaacuauaaggcacagguuuuuagugcauauuuaaccugaacccuccaauuugcuauauuuuuuuaacugauuuuuauuuuuacuuucuucucuguuucuugaucagacuugccagagguuugugaauuuguuuaguuuuuccccacauuaaagauuugugguuucucuuuauuguauauuuucauuaauuuauuauuuuuuccuuacuuuaauuuucuuuggguuuauuuugcuuuuuucuaacuuuuugagauggaugcuuaucauugauuuuuuugcccccugccuuucuuuuuugauauguucauuucaggcuauaaauuucccucugauaacugcuuuagcugcaucacgcauguuuugccauguaacauuuuuauucaaacucauuuucaaauuuucauuaugauuuuuuaaaauagucacaaaaaucauaaaauuuaacauuuauguauaguauccacguaaggaaauauuuauuuuuuaaagaaaacauauauuccagccuggucaacauggcaaaaccccaucucuacuaaaaauacaaaaauuaggugggugugguggcgugcgccuguaaucccagcuauuuggguggcugaggcacaagaaccaccugaacccaggagguggaggucacagugagcugagaucgugccauugcacuccagccugggugacagagugagacuguuucucaaaacaaacaaacaaacaaaaaaaccuaaugcaaacguuaugcucaaugaggaaacuggaaacauuccuaauaauaucagaauuaagaaaggaaugcccucuauuaccacuacuuggaauuuuggaaaauggugcugaaauacauaaaauacacguuacaauuuuaaccauuuuauuauuuauuuguuaauuauuauuauuauuuuuugagauggaaucucacucugucacucaggcuggagugcaguggcaccaucuuggcucauugcaaccucugccucccagguucaagugauccucccaccccagccuccugaguagcugggcccacaggcauacacaaccaugccuggcuaauuuuuuguauuuuuaguagagacgagguuuccucauguugcccagguuggucuugaacuccugaguucaggcuaugcacccgccucagcuucccaaagugcugggauuacaggcuugagccacugcgccuggccuucuuuaacugauuuaaaguguccaguuuggcugggagcauuucuaaauaaauaaauaaaugaaguguacaggucaguggcauuaaguaccuucacauuuuugugcaacccuguuuucacuuugaccuauagguuauuuagaaauuuuuuuuuuuuuuuuuuuuuucgauggagucucgcucugucgcccaggcuggagugcaguggcgcgaucucggcucacugcaagcuccgccucccggguucacgccauucuccugccucugccuccggaguagcugggacuacaggcaccugacaccacgcccggcuaauuuuuuuguauuuuuaguagagacgggguuucaccguguuacccaggauggucucuaucuccugaccucgugaucugcccgccuuggccucccaaagugcugggauuauaggcgugagccaccgcgcccggccuagaaauguuuuuaaguuucaaaacugggagggauuuuuugaaguuuuuuuguuguaucuaguuuaauuacauugugguuagagaacacauucuauauaauuucaauuuuguaaauaucuuaagauuucuuuauggccuuggauaugcagauucuuauaaauguuccauauaugauugauaaaaauuuacauucugcaguuguuggguucaguguucuauauauauccauuaggucaaguuuauuaauucuguuuaaauacauuugaaaaaucagauguucaguacagcucucucugugaugaugggcguguucuccauuugcgcugucugccaggguagccacuagccacauguggguauugagcacuugaacgauaacuaguguaacuugaggaacugaaucuuuaauuuuauuuacuuuuaauuaauuaauuaaaauuuauauuuaguaaccacgugugguucauggcuauuguauuggacuggccaguucuaaauugagacugaauuuauuuuuauuugaauguucugccaauuacuaagaaaggggcauuguaaucuuccaccauaacugguggauaaugcuguuuuugcuugaagaagucuuuauuuuaaacuauuuuuucaaacaggauuuuagaaacauacacuuauuguuuggaaaaaacucucaaacucuuuccucuguugucacacaacaacaaucaacacagacuucugaaauagccccaaaauauguggggcuauuuucccaccagcaaacaagcaaucaguuccgacacugucugccuggagauagcaucaggucccacagguugagggcucagucucacagacugcccccuccuucccaccagucgaaagucgaggccuugggaacuucuggcugaccaacuucaaacugggguucccauuauccccguuuagguuugauuaauuugcuggaguggcucauagaacucagggaaacacuuaauguuugccaguuuauuauaaaggauacuagaggccgggcgcaguggcucacgccuguaaucccagcacuuugggaggccgaggcggguggaucaccugaagucaggaguucaagaccagucuggucaacaugaugaaaccccgucucuacuaaaaauacaaaaauuagccggguguuguggcccacgccuguaaucccagcuauuugggaggcugaggugagagaauugcuugagcccagcacacaccuguaaucccagcuauucgggaggcagagguugcagugagcugagaucgcgccauugcacuccagccugggcaacagagcaacauucugucucaaaauaauaauaauaauaauaauaauaauaauaauaauaauaauaaaaggauauuagaaaggacacagaugaagagaugaacagggugagauauggggaaaggggugagaagcuuccaugcugucucgccggccuccaggaaccuccugagcuuagcuacaauuggaagguguggaagauuagaguccugccuaguggcaggggaaaggagagcaggagagauucgguuucugggggccugccccugagguuuaacacacccaacauuauaacaaaagacuggaacaggggcuaugggaguuaggagccacgaacuauggacaaaaacgaacacacacagagacacacacauguauauaauaccacacuuauauacacuucucuugugccagccacuauuucaagaguuuuacaaaagaguuuuauaaauauuaauguuacggugaugaguuuuaccuuuucuguauuuuccaucuuuucucuccuccuguugcagauaauucuucugucuuuuucuauaagcacagcuauuuuguagucugaauaagacuccuuggauuucaggccuuuugcuucucccggucccccuuguugccuacccuccugugugccgguuaucuuuacaacacacuggucuuuguguuggaaaagcuauuucuaggaauaauuugaggucuaaggguuuccugagaagauuuuaguuuuuguguuggguaccugauagacauuuguuagccuggggucacuuuugaauuucauuuagcuuuuccaggucauccuuaguggggagggugaguccaguagcccccaagaaccaggauggguaggcuccacucuguucaguccucagccagcuggggucugguucccccaccccacaccuccccucuggcaccagugaccaccgagcugccaaggcaaagucucuucaucuuuauuguaccaaucucucuguaauuuuuggacuguuaauugcauuuucuuuuuuuuuuuuuuuuuuagauggaguugcccaggcuggagugcaguggcacgaucucggcucacugcaagcuccgccucccggguucacacuauucuccugccucagccucccaaguagcugggacuacaggcgccugccaccacgcccggcuaauuaguuuuuguauuuuuacuagagacgagguuucaccguguuagccaggauggucuagaucuccugaccucgugauccgcccgccucggccucccaaagugcugggauuauaggcgugagccaccgcgcccggccugcacuuucuuuuucugaaacucuuugcucagccucuuuccugguuauucuuuuuuacucuuuugcuacccuuccucugcucccaucucggguucuccuuucuuugccugugcauuaaaugacgguguccccgggccuguuugcaccuccugucuuccggcucuguguuucuucugggugacuugguccacaccaggagccguggcuuucaucuccaugccaucuucucuccugagcuccaguugaaggucuggcugccgggaccaggagugucuugcauccaacgugacaagcacccuuuccucauccuuuagggggccuaugucagaggacagcaugaccauccacucagaacaccugcaggagccacagaaccgagcgcccacaugguccuuccugguguccucauggugucugucugucuguccaccugucagucugaugcaguguugcugggcugucugcucuggaggguccuuguugucuguccaccugucagucugaugcaguguugcugggcugucugcuuuggaggguccuuguuuuuauuuauuuauuauuauuuuuuugagauggaguuuugcucuuguugcccaggguggagugcaauggugcaaucucggcucacugcaaccaccgccuccuggguucaagcgauucuccugccucagccuaccaaauaggugagaucacaggcguguaccaccaugucuggcuaauuuuuguacuuuuaguagagacagggcuuuaccauauuggucaggcuggucucaaacuccagaccucaggugauccacccucguuggccucccaaagugcugggauuacaggguugagccaccguaccuggcuggaggggccuuguuaaaaaaacauccuggcaccaccucccagcuggucugaucgguguguuuuucuaacuggccucucugccccuauuucugaucucacccaucuuccacguguggagcuaggggccucauuccuaaaauacaaauaggaccauguuaguuuucagcuuaauguccucccaugaugauucuucaucuccaagauaaaauaaaaaugccugaguuuggcauauauaaaauaaagccuuuauuucccccacacuaucuaccccaggccuucauccauagacucuauguucuugcuauuuugaacuauuuauaauucccucuuucuucuucucuccaugccauugaagaagccauucccucuuucuggaauucucuuuccuguucucugccuggcuagccccagauuguccuaucaaugaaauccuuauugccuucuaugggcaggcuucucugggagaucugggcuagacaugccuggaacaggaggaagagaggggaagugaaucagugaagaugacuuggguggcugcuuuuuucucucucucaguaucacugugccacugcacagguucuugcacuuccccacuucucuuucccuuuagucuugguccugaugaucucuucuuuccuccucuucuuaaacaccagggaagaggaggagaaagcguguggacacaucacucagauaaacguuugagcagugaauggauaucgucucaugaaauggaaggcugguguccugccucauccccagcaacuccagugcuggguuuaaagagaugaugcacuccaaugcagaacaugacacccggauucagacaugaagcgucuguuccuucaaaugcuuaguaauaaauguaaugguuugcuagagucaaggucaucacugaaggcagacguggcagaugaccuauaaagguuucuuacaaguaugugccaguuugcaugcacugcccaugcagcgguucccucaacuuuaaagggaaguagaaauagacaagagucacaacugaaaguaauggcaaaauucuguccuacagaggugauaagaccuuauauagauuguaauagcaaucuauaaaaucaucacugauggcugggugcaguggcucaggccuguaaucccagcacuuugggaggccgaggcaggaggauuguuugaggccaggaguuuaagaccagccugaucaacauagcaagaacccaucucuacaaaaaaaauuuuuuuguaaauugccugggcauggugaugcacuccuguagucccaccucccuaggaggcugaggugggaggaucacuugagcccaggagguugaggcugcaauaagccaugaucgcaccacugcacuccagccugggcaacaagugagacccugucucuaaaaaaugaaacaaaaaaaauaaaaucaugacugagagcaaaacucuggagcaucugaaacaaagggucuccuguggccuaaacaacuggggcaccucagguggagccccagacccgucacgaacucuuacuucagcagaaccauagguggaagcaaacacaggcucacaaaguguuuauacugaaucguacugauuucauaaaaagaaaggcuuacaaaauaauaaacaggaaaaucauaaaagguaauucaguggaauagauauuuuuuggaguacauccuugcuaucugagguuccccuuagguggggcagccacauucaccaccggggguuccccagaauuuagggcugugguacagacccaggccugauuucaugggguaauuuccguugcaaguguuggggaagccccuuaaaacuggggcccucuuuuuuuuuuuuuuuuuuuugagacggagucuuucucugucaccaggcuggagugcaguggcgcaaucugggcucacugcaaccuccaccucccagguucaagcgauuccccugccucagucucccgaguagcugggacuacaggcaugcaccaccaugccuaauuuuuuuuuuuguauuuuaguagagacgggguuucaccauguuggccaggauggucucgaucuccugaccucgugauccgcucgccucggccucccaaagugcugggauuacaggugugagccaccgcacccggccggggcccucauuuuuaacucuucccacagggaaugccuggcugcgcaccuaggcgguaacgauggaaaucacucccuguugugcggaggggcuuuugaaugaaggaagcggcucucaggaggagcacggaaggacuaaggagcauuuucggguggaguaacucaaacagcaaccuccugcagcugcuggaggaugaccacaaauccagaucuuuccgugaaggaaagcaaaauugagaugauuggauuuaucuugggggauugcggagaaagcccuuaggguguggugcugucuaucuuuuaacauuccagaugcuaagucucagaaucggaguagcagugguugcuuuugaauaagcuugguucaaucuugguauauuuguuguugauuuuaaaaugagauaaaugguuugaaaauuaugcuaacuuguuccuguauuucuacuuuaaguggaucguaugaguugagccauaagugaaaauguuacugucuuaagcauuaugauuuuucaacauaaauauuuuaauuauauauaaaucugauuucaaaguauuuucaucucauuuaucucuuuucaaaagcacugccagugaaagauguagaagauaaaccugaacaacaaaccagaacaagagagacugacaaaucacccaccaguacugagccucgacagcaaccaagugccuuauuugcuagaggaaacaggaaagcggucaaaaguccccaaagaucaucgaguaaaauaaaagaaaacaagcauccauuugcucuuuauggcuggggagaaaaacagaccgauacaggaagccagaagacucacaacgucugugcguccgcuccugugcacgaggugcgcucugggcccuugugguucuguguucccuuugagaguggccagcugggccaugcgccugucaucgggcaucguguccuuuggccacugggugcuuugggcccaugggagaucuuaggggauagcaugguggguuggggaacuccagaauggagccucugaugaaccaaaggaggauucugcauguugguggccugcagagcgagggguuuuggcuuggaguuacccagaagaguuuagugacaccaagccaggcaaagauguagauggaguugggguucacaaguuccuggggggccggaagguuaggaggagcagcacagccaaggcuggcgacggcccaucuggauuugccacuggucucuugagcuguuucagcuuccuucagcuucgauaaccuggcgcuucuuuaucuuugguuugucugauugauugauugcuuggcaucugccagagacucccuuuuguuccucugauuaaauucaaauggcugcauuuccccuguucauccauaacaaaugcauuuuacucucaggagcuuuaguccuccccugacuuagccuuagcuugucucuccugugucaagacccggaaacauuucagaugagaggaccuucauguguguagucagaaaacauguauguuagcguuaauacuguuaugauagccuaaagcaaaggcugcguuuaaggaagcagaaagugaaacugcaaacugcuugaguucuagauaaacagcauaaugaaaauuucacugaacagacaucugaacccuagcaaaugguguuauuuggagugauauuugagacaacaaagcugccguuuaacaaaagaucucuaagaaguccgugggauuaauuuuaacaggauuuaucuguaguauaagacaucuuaggugguaaaaucucgagaugucuuugguauacugauguuaaacauuuaaaguucuuuuauuuucccugcuuuuuaugagcuguuuauaagucguuaauuaaauacuuauguuuaaugcuaagcaguucggacaguuuuccagagccaacucuagaggcacaugcaaauuaguugcuuaccauuucugucuaacauuuaauuugcuguugcuuaguuucauuaucccugauaugaaucaagugagaacagcaucaagugagaauggcucuucuguggaagguuuuauguaaagaagaacuauauagagaggcagggcuugacucugcccugcugcaguugaccuggcaguagccagcuucauugcaaccucuguugaacauuaguauaauagccccuuaaguuacuauccuuuauuuugaacucucuuuagauucaugaaucagcauuacgagccaagaacagaagacagguggaaaaaaggaaacugguugcucaaaggcagcgagcucacucuguggauguggagaagaacagaaagaugaaggcuuccuccucagagaacccguggaugacagaauacaugaggugcuauucggcaagagcuuaaagaaacacuugcguggacagccucuuuuaaaaaguguaaaugacugaaaggaaaaacaaaacaaaaaccaucaaaagaaacggacacagguuuaagaaaccaacugauuaugcaagguuuuuuuuagggaauuuguaaaagauuguuuuauuuugaugaauauuggucaccuaccucggcaguagggcagacaguugaagccauagacauuugguuauuuaugaagauaauucccuaaaucuuugauauucuuauaagguuuuuguuuuaaagcaucuuaaucuuuuaagauacugacaccaaaugccuuuaaauggcaacagaugcuuacaguucaguauucuuuucauaagcuuagguagagccuauuaucaucuuguucuaaauaacuuuccagauuccauagcuauaagaucauuccauccuacagcauaagacucguuuuccuuauaugccguuuuguuugugaaagaauaucaagucaaaaaugagugucagcacuacuacugauuccauguauaaugaaaguagaacuuugcuaguuccugaaaauuuuuaacuuauuuguauuucaguucagcagcaucuuuauguagauugugauauuuaagaauuaucugggcugggcgagggucucuuuuucucuuucagugaucaucuaggcaguuauuauuuaauaguuuaauagcucaaguacauuccaauagacgaagugcacacaacacaauauguguguacaguaguaguaaaguuucuuuugaguagucaaagacucacuuuuuuuauugccuuuuuuuuuuuuuuuaaagaauacauacuguggauucagucccuugucacacuugaccuuuuggcauacacccacuguggacuuuugccucuucuguaauggcuggcaaugacauuucaaacuuacaaucuggaauugcacuugguacauuggcauugcuuguuccacugggauggggaccagugugaagaugccuguuagauagacugcccaccccuacuuucucuuuuucuuuauagcacuuaacaauaacaaagucuugaugauguacaguauucaaacuuuagguugaaauacguuacucuuugauuccuagccaguagaucuuaucuacacuuuaaugggagagaauggugguguguggguaggcacaaauuuauguaaauagugcuccuucucuuuaguauguuugcuuuggggguagaaaaaugguuuuaacaaacacugguuuccaucaaaugaaugaugucuucuccauccuguggagacaagaaucugcuagaaggauaugugcuaaguuccuuauaagagauaauggugcucugccuaugccagcuuggcacccgaagaugugugaguggacgugaggcugaguauuaccuuaguauuuuucucugggucuuuggaaaaccauagucaauuuuuagaacauauugcuuucauuccccauaaacucuucacacaugauaacuguuuaagcuuugaaaacacauacugaaguauugugagcuuaaaaaaacuuuuuaaauauuugcauaguuuugaggugaauuuguuuccuuacagaucucuccuaaucauugagauguauauuucaaaagaggaaauuuuacauguuguccaaaacagccuugcuaguaacuggugaauuuugguauuaacuauuauuaaagucuuuaaacgacacagguaccuaaagaucaccuuaauguggcaauuugugaugguguagcuagcugauugugaaaacuguuccuuuaaagucgcuucuugcauguucgguguuagucauccagcucaggcuuguguugcagcugacaaucuaggaaagacggccuuagagaguggugcaggccccacacugacggacugccuuagaaacccgacuuccucuagacuuugaaccgccagacuuuucucuuguuuagaaaacaaacuuauauuuaauguacuuacuacuuaaaacuccagacagagauauaauguagaaggcaaauauuggccaauuuuuuccucuuuuuaaguggaagacaaaugaacgggauuuuuaaagugcuuuuaaagugcaugaaugguuaauaaaucaguaugaauuguaagccuucaucuuacauccaaguccuuaguugguuaggguuucuuuucuuucuuuuuuaaagagugucaauuaccuuuugaaccugugaaaauuugauaguuguuaacagucugaugguccuaauucuuucuuuucauucuagaaaugaaugugguuguaaucauguuccuaauucuugggacaaccugcaagacagugagacaguuuaaaaauuaccuuucauguugaaaaagucugaaacagagaacccaaugauauuuaaaauaaaugcuacauaaaacucuuuuuaaaauuuugauuuuaacuuaauuaaaacaaugucauaaauaugcuuuuugauuuuguuacugcuuuuaauauuaaaguaauagaauauugaagcaauauugucuagcacucugcuggacauuaaguccgcgggaggagaagugaacaggaaucgauucuuugucuuuuaacugcccuuaguuaggagauguuaaaauacuuggcaccucugguuauauguauguuauguguguucuccccccuaaaauuucuaagcacauuuauucacuuuuaaaaugaaucuuuaaaagauuauaguuaguaguuauaguuaauauucuauuuacuuggaaaaaugugaauaaauggaucuucaaaagauucauuuuaaaaaugaauaaauguauaauaggcuauaggugaucuuacuugcguauuagguaggaggcacauauuuauaccauuucauauguaauaucuuugucauuguguuucaucgaagaucaauugcuagcaacuugaaggguauuuauacuugggucacuugaacucagcugacuaaauuguaagaacgagagcaagcaagauggcuguuauuggaagccauaacuuccagaagauaauucugcacaauucguaaguuaaaaaaaaucuguagggucuuccacuauccuuuuucagguugauaaugcuguucugggcacacacuuuguaaauggaauguuaugguacagucgccucucaguauccauggggcauugguuccaggccucccuuaggaugccaaacuccauggauacucaaaccccuucuauaaaaugguguaguauuugcauauauccuagacacauccuccuguaugcuuuaaaucaucucuagauuacuuaaaauaccuaauacaauguaaaugcucuguaaauaguuguuauacuauauuguuuagggaauaaugacaaggaaaaaaaagccuguacauguucagcacaagugaaaccauccuuuuugcccccaaauauuuucaauuuguauuugguugaauccauggaugcagaacucacggauacagagggccgacuguacuuucuuuaaaguguucaaaaguauuacuagcaaagaggaggaggagcaaagcauauaucagaaguaaaacaauuuuucuuguugacugcuuugguaaaaaacaguuugauggauaguuuuacauuucacuggacuagauaaaaaauggugcuaauauuuauguagcuugaugcuauaguugcuuugguaucaaacuuaauaccuaacccauauaagauccuuauuauauaauuuugugaucaguaaaaugauauuuuaaagagugaucuuaaaaauaugaccuggucauugcacaacguuugcauuugaaaugaauuuguguacuauaggguggauauggaguuauucagugcaagugugugcuuaauaucaaacccuaugcaaggagcuaugucuagauuuuugguccaaauuugccuccuucaagccuacuagugugagauggaaaaaaaucgauugcucuuuuaauauuauuuccauuuugaaauucucgacacuugaaugaaggcaguagaggccucuuuuuggauuucucuucuaauaacaaaacuuuauuuagggaagguuucccugugcuaucguaaguuuguuuugagcacugcauucacuuuaaaauucuggaggaacaaaggcugggcacauaaucacaaagcccaggccacacaauaauucgggguuguauuuucuaagaacuauguauuguuuuuagcuuauaguuaauauuguauuuacuuggaaaaaugugaauaaaguuaauuaacauuacaagcugaga

SEQ ID NO: 191999 - RNA, 67045 nt, Homo sapiens
cucuucccuuagguguuuaaguuccgcgcgcaggccaggcugcaaccugacggccagaucccucgcuguccuagucgcugcuccuuggagucauguucccagccgccccuucuccgcggaccccggguaccgggucccgaaggggcccgcuggccggacucgggcccggcuccacgccccggacggcuagcaggaagggucugccccuggggucugcagucagcuccccagugcucuucucgccggucggccggcguagcucgcuaagcucgcgguaagugaucucccugguugggucuggcaaccaacagccucacgggccgcagugggccggauagguuguugucuuuagaagccuuuggaaccggggcggcggaauagaaugccacaguauuggaaaauagaccuuuuccacugcugcagguaguaucugcuucguuuugauuaucaguugaucaguugauuccccacuuugcauuuuucauggauaccuuugugcagaagugaaguacaaacuggauuugcaucaguguuuaccuacuucccaccuacuacccgugugaucugguguaagucacucgugauuuucuucaucugugaaauggcgauaauauaucucaccugagccagaggaguuauuaugaauugccacgaugcagauguaaggugauggugauaaugaggaccuacaacccugaaagaucauuguuuaaugccuaacauaccaacugacauuaauaucugaugauugguaauuaaaggguuucuagcuacggaauuuaacuuucuagguaaauuauaaggaaaaggcuuuacauaagugagcuaagaguacugugauaguuuaguuacuaaaacugcucguuuggagcaccaguaaaaucaucacacacacacaccccuccccacccccaacacacaccauguucauaauuaaccuaaaacuuuaguguuucugcauaguuuucucugaauucaucuauaaaaaaugaauuuuucccugcaggaaacacaaaguauugugucuugaaauuaugguuaaaauuuaucuguaaaauuuuucaguacuuuaaaggagaagugguuuugaaagaauacacuguaucuuugacuuuuuuuggcauauuuugaaaaguucuuuucaaagugcugaucuugucaguguuuucuauuccuuuugcgaaaaguuggagaauaaaagcauacuuuauuuacuguguguuguuuuauuuaaaucucuucuugugaucauuugaagaaaaaccuuuguuauccucugucaggaaacaaagcccuuagcccuucuguaugugcaucuucucauuuaauucucgugauaagacauagacuaccuuuuauucuggugacuuuacaauauucuaaauguuaagagggugagcaagaaauaaaguuuuuacugugauaucugcuguugaggaccauguaacagcugaugcucguaaccuguucgauuucuugcuugguuguacagaucugauaguuuuuuuuuuuuuuuuuuuaaagagacagggucucacucucugucgcccaggcuacaggcuggugccacaaugcccggcuaauuuaaaauuuuuuuuguagagacaaggucuugccacguuccccaggcuggucuugaacuccuggucucaagcagucuucccgcuucggccucccaaagugcugagauuauagacaugagccacugcuccggccaggucugguggacucuuaagcaccuaaagcuagaugagcuuaaaucucaucuaagccaauauuuauaaaauguauuugaccacaacauaugguaaaagcugauguuuuauauucugucuuucaaaaauguugagaucugcaaaaugacccgcuguuugaaaaaaaaaaaaaaaaaacacuggucuaguuaagccuuauuucacagcuaaggaggcagaauuauaaggaguuuaagugaauacaggcaugcauuucaauacuagagucuaugggauugaagccaaguuuuccuaaauccuguuuuguuuuuuuuuuacaugaaaaauauuacauuuaauuacaugguaaauaugagccaguguuaauuuuuuucaaagaacuccuuacugugaaaauauauacauaaaaaauuaggauaauggagaauuuuaaguuacaaguaagguaauauagacucuuuucuuuaggggaacaccaacacgaauguucccacaccacuccauaacugagucugugaacuaugaugugaaaacguuuggaucuucucuuccuguuaaagucauggaagcccuaacauuggcugaagguaggugucaucuuuccauuuaccuauauuagcaguuuaaaauggagccuagauguggcauagagauuaaauuuauguuuucucuaguauaccuuuacguaaauggugagagauggguggccugucuaguguuuuuuuauuuuuauuuuuucgagacagagucucacucugucacccaggcuggagugcaguggugugaucucagcucacugcaaccaccaccucccagguucaagcgaguuuccugccucagccucccaaguagcugggauuauaggugugagccaccacgcccagcuaauuuuuuguauuuuuaguagagacaggguuucaccauguuggccaggcuggucuugaacuccugaccucaggugaucugcccuccuuggccucccaaagugcugggauuacaggcgugagccaccacaucuggccaccugucuuaguuuuuuuuuuuuuuuuuuuuuuuuuuuuuaacuguaauugagauguauaauacauucgagaaggagaaugaguucauuugaacacaaucaaauuaagucuuuaaugguuuuagguacuguacaguagucccccauuaucuuugggggauaucuuccaggauccccaguggaugccugaaaccuuguauaguacuaaaccuuauauauacuguguuuuuuuaauacauacacaccuaugauaaacuuuaguuuauaaauuaggaacaguaaagaugaacaacaguaauaauaaaguagaacaauuauaacaauauaccagcagcacuacucuuguacuucguuuggggucauuaacuaaaaugagaauauaagcauugcauuacugcgacaguucaucugguaacugagacagcuacuaagugacaaacagcuggauagucucagggguguccaaucuuuuggcuucccugggccacuuggaagaagaauugucuugggucacacauaaaauacacuuacgauagcugaugagcuaaaaauaaauaaugaaaaggucuguguauaaaucuuaucauguuuuaagaaaguuuacaaacuuguguuggaccgcauucaaagcuguccugggccacacgugucccugggccauggguuggacaagcuugggguauacaguauggauaugcugcacaaaggguugauucacaaccuuuaggcaggacaguaugagauuuuaucacuuuacccagaacagcaugcaauuuacaacuuaggaauuguucauuugaauuuuccauuuaauauuuucagacuacgauugaccacagguauuugaaacugcagauaaaagggggaaauacuguauaugcaaaauucaguccuguuuacagaguugaucagguuuaugaaguuucccgugaaaccccaaaacuggcaccucauguuauuggguuuaauaauacaguaaaaucaaguccuaccuccauuucuggauccuauguagcaucccagaggcugugugcacaaauuuaugacguuaccauugucgugguguaccuuuagaagcgucuguugguggagaauuaguguggaauuuugacagauacaaucaacacaagcuuagaaaggcaacuuuaaagaugagcaguuggaugacacuggaagagcaaaguucagagcagccuuaauaucugcugaagucauuuuuauuaaggcuugaauucuagaucuuugugauuuuucuggaacaguauuuuucaaauuguaggggugaccaaaauuuagcgguucuugaccagcauuuaaaaaaagaagaaauagaaugcaucucauauguuuaguaaauuuuguucguuuuacuuaaauuguauauggguguaucgugauguaaaauguauuauacugugaauaacucuauuuacuguauaacuuaauaacaguaaaaaaaaaaugcugaaauuacucuguuuuagaagaaggaauauaucucaucaacuggaacuuggcacaucuugccuguagguccuugggagcuuuagggauaguuguuuucagacaacuacuaaccuuucuauacauuguucuguuuuaaauaaauaaauguauauauauauauugguauauauguguauauuuuuccccucuaaaaauuucaguuuacauuuaaaccuuuuaauguacuacucauauuuuaacagacuagauuaaauaacacagccccaaaucuagaaauucagagaguccuuagaaauuaggauauauaaaacaaagaggugugucaacuugaagaacucuuccccacuuagaaaccugccaacuacuguuaagucagcccuuaaaggcacaccggucgaggaucuggaguuguagugcuuucaagaaaaagaaaauuacugagcagauaguucaguugagcaaaaagccucacucagccugggcuugguuugauauuuuugcuuguacauugucuaugccuuuuacuucacccuucuaccuuucuguaaguaaagagcaaagcucaacuuaauaaaauuuccagggcuguuaacacauuuguggagguuuaccaccaauacuuaagauaugugcuaauuuaguuuugucacuuaauagagaacguaacucuuugucuccauguacuaaauaauuuaucauuccuuuaaggagcucuuauuugaaaauuaugugcuuuugguccuccaaaagcacauuguuuuccuugaaauguuuuauauaguuaaugaguuuguuauuuguuuuacuuuaucgauauaauuauaaauguugcuaaauauuucuuuuuuguuuguuuguuuugagacagagucuugcucuguugcccaggcuggagugcaguggcgcgaucucagcucaaugcaaccucugccucccagguucaaguaauucuccugccucagccucccgaguagcuaggauuacaggugcacgccaccaugcccccaugccuggcuaauuuuuuuuucuauuuuugguagagaugggguuucaucauguuggccaggcuggucucgaacuccugaccucaugauccacccaccucggccucccaaagugcugggauuacaggcgugagccacccugccuggccucucuuuuguuguuucugcuuacuuauuuuuugauauggagucuugcucucuugaccaggugggagugaugugaucaugguuuacugcagcuucaaucuccugggcucaagugguucuccugugccucagucacccuaguagcugggaagugcacugccaagccuggcuauuuuuuuuuuuuuuuuuuaagagagagagucucacuauguugcccaggcuggccucaagcaguccucccaggguggccucccaaaauauugggauuuauaagcaugagccacugugccuggccuaaauaugucuuauaggaaauaagcuaucuggucuguuuguaacaaaaaauuaaggaauauuaaaugucccaaauacacuuuuugccuuuagauauauuucuuuuuucuuucuuuuuuuuuuuuuuuuuuuuuugagauggagucuggcucuguugcccaugcuggagugcaguggcacgaucucggcucacuggaaccuccaccucccagguucaagcgauucucuugccucagccucccaaguagcugggacuacaggcacgugccaccacacucagcuaauuuuuuguaguuuuaguagaguuggaguuucaccauguuagccaggauggucucgaucuccugaccucgugauccucccaccucggccucccaaagugcugggauuacaggcguuagauauauuucuaaaguugguuaucagaguuaauagaucuauuguuuuugguguugauaauuuuggaauauucaaaaguauuuguugugagguagucguuucugagugugccaauuacuuuuuuuugauaaagcgugugguaauaaagauuuauacuauaagauuaaucacccaccucauuuuuuccuuuagucgaugaccagcugaccauuaacauagaugaagguggaugggcuugucuggugugcaaagagaagcucauuauuuggaagauugcucugucaccuauuacuaagguaauggcucuuuagagagcuggaacaagauagaggagaggaaugccaauugacuuuucauuuuuacccuaauuuuuuuacaguuggaggauagucaauaggaaacuacuuaggcauuaagaguuugcauuuucauagugaugugaaauaaugagcaugcauacacauuuguguauugggaaaaaaguuucccccuuuugaagaucuguguuguuuacauuuaauaaaauuagagucauugauauuuccaaugaauauaaugcuaauccgucugccuaaugaaguaucagacuaaaugcuauccacauaagcaaaugaacuuugaguuugcguauuucugagaagacagaacuauguuuuguugaaccuacugaaugaugcuuaauaaaauaagaaaauaugauaccaguugcuaguuaaacuuuucacuuguccacuuccaacaguggguuaucauuugcaugucuaguaacguauccucagcaaccuuuuucuguuuguuacagcuuagauacacuacucucuucuaccagucauuacuuccuuggccauguuccguuggaacucagggcuccugcuuaccucaauucuucacuucugcugaacucuguguuacugcugccuagaaaaggguguaugugguuaggaguaauaggugagggugaauuccugggggacauacugaguuagcugcgggauccugauauuuggcugagagucuaagaaauuguuuccuagguaacuugguauaauuacucuuuggucaugcuaauuuuaaaugucagaugaacaaaucaagaguaaauugggaaaguuccauaggaagccuaagcacucaucuuaaccuuacuuagucuucucuuaacuggacuuuucuagcccaggaagagguuaggauaguuguucuucagaguuuggucuaccuuuaaguuuucaugauucaauacucuuaagauacuuuguuuuaaaauuacugaaagccugauuaaaaggagaugugagaagaaagaauauuuguagaaugguguuuccagcagugagucagaaucuaaaauaugcagagaagggaaaucagaugcaucuucaaaauacuggauuugaugugaaagauuuucuguuuggguuuguucuacaguuauccguuugcaaagaacuucagcugccaccuagugauuuccacuggagugccgacuuaguggcucuuucuuacucuucucccucaggugaagcacauucuacucagguaggugacuuaaaagcuuauuuaaauaaacuuuuuacaacaaggacauccuaaaguuagaggaaucauccucuuugauuuugagauauaacuauaaaccuauagaaaucaagauauugugguauuggcaaagagagcuacacacauaggucaguguaacagaauagagaauacaguuauagauccacauaaaggcacccauuuggucuuugaugaaggugcaaaagcaauucagaaaggaugguuuuugacgaugauuuuucucuguaucaaugcauaguguaggaacauuuguaauuuuaaaauuacaaaugaccaauuuguauuguauuguauugaauuuucccuuaaaccucauaccuuguuacaaagauuaauuugaaaugggucauagaucuaaauguaaaacaguaaaacuuuuagaagaaaacagaagaaaaucaucaugaccugagauuagacagaguucuuggaaaucaccaaaagcaugauccauaaaagaaaaguuugauaaaauuaauaauaaaauuaaaauaaaauaaaaauuuaaagcguugcuuugccaaagacaagaaaaugaagagacaaguuacagaguaagaagaauuugcaaaucauguauccagcaaaggacuuguauccagaauauuuuuuaaaauucuaaacuugauaagaaaacaaugcaguuuaaaaacaggggcuaggacuugaacagacacuuagugaggauauaaggauggcacauaagcacaugaagagauguucagcaucauuagccauuagaaaaaugcaaaccaaaacacuggugaguucuuauuucugauuuuucuugaucaaauaguaaauuguccuguuucuuuguaucauugccaucagacugcugguuuuuggguuccucuuuuauugugauugcugauuguugugaucuuguuuugaggcuguugcugucaugguugccaccagagaaggaucuauccgcuauuggccaagccuugcuggugaagauaccuacacagaggcuuuuguagauucgggaggugauaagacuuacaguuuccuaacagcagugcagguauaccacggauauuccuuuauauuuauuggaaagcugugauuuggcuuggaaauaaauuuuuguuuuuauuuuuaaauagaggugggaucuccuuauguugcccaggcaauucucaaacuccugggcucaagcaauaacuccugcuuuggcuucccaaaguacugggauuacaagcaugagccacugcaccccagccguggaaaugagauuugaugacuaaaaaugugggguuuuaaagagacuauagaggccggggagggaucaaaaagagacaaggaagagaagaauguaaggaucuaugauuugaacaguuagacaagggaggcucuucucacaggacuccaaaauaucaauuucagauaguagcuugugauaugaauuucuuuuagaaacauuuuauaagauuggcuuaaaaacugucagacacuauaaagaauggcuugcauuaucuucuuuguagguucacaaagaaacaaaaucuggcugagcaugguggcucaugcgugcagucucaccacuuugaauggcugaagcggaaggauugccugaggccaggaguucaagacuagccugcgccauaaaacaaaacuuugucucuacaaaaaaauuuaaaaauuaucugggcauaguggugugugccuguagucccagcugcucaggaggcugaggcaagaggaucucuugagcccaggagauugaggcugcagugaacuaugaucucaccacugcacuucugccugggugacagagcgagacccuaucucuaaaaaaauaaaauagcaaacaaaaaauauaaauaaauaaaaucugauaaccuaauuuguugaaucugaaauaugaugaacuuguaguuuaaaaaucagaauuuaaaaaauaugcaauuuuuuucugcuacaaaaguuguuuuuuuuuuuuuucuuuuuucgagacacaguuuuacucugucacccaggcuggauugcaguggcgcaaucucagcucacugcaaccucugccuccuggguucaagcaauucuugugccucugccucccaaguggcugggauuacaggugcgcaccgccacgcccagcuaauuuuuguauuuuuaauagagacgggguuucaccccgccuugggcucccaaagugcuggauuacaggugugagccaccaugccuggccaguuuuuuucuuaugagaguuuuucuauguaggauuaauaauauuaacugaauggauucugaaauauauuacuuuaauaaaauaacaacguucuauuuuguauucuuuuagauuuauuucaauuacgaugauuuuucucuguaucaaagaauuuuucauuuuaucuuagcauucgaugcuaaacugaacuaaccucauaauguuuuuucacagggaggaaguuuuauuuugucuucaucaggaagccaacuaauucgguugauaccugagagcucaggaaagauucaucagcauauccugccucaggggcaaggcaugcuuucaggaauuggucgaaaaguuucuucucuuuuuggaauuuuaucuccuaguagugaucucacaguaaguuuauaaaauaacuauuuuacaagcuuauuucuuaguuaaaucaauaaguugaaaguauccucugaauuuaguauuccuccauauggacaguagcuuaugcgaaauaaaaccuuuggucuuuuuagugaacuauuuuuauuaugaugaaaugagaucauacuaaccuucucccauaacuuguaacacuaaaaucuuuaaaucagacagauuaucucacaaguacauuuuuugaacuaaaacuauuauguaaaauauaaaauguguuucuuaaagauuaauuugacuuuuuagauuuaaccagaagcguguuucuacucaugccuccagcugucuguguggaugacugaaaucuagaucuguuggcuggacuucucugcaccauacucuagcauagugaagggaagaugaugggaacuaauauuuauggaccaucuacucgcugcucggugcucuauaguuguuauauucauauuguguaaucauugugacaaccuguaagguagcaugcuuucccgccaguuuacagaugaggaagcacccucagcaaggcugaagguguguaacugcugaguggcagagcugggaaucauacccaggccugucugaauuuaaagaacaugcucuuuuuacugugcuguuucccucuuguuucagauaauuaucaccugcuuccuugaauguucuuuaaaccuaaacuuaacauguuuaaaaacaaauuuauuguguucuuucaucucuccuauuggcuacucacuuaacccuauaaaacucauuucucuuuugaccuguuuuuguuaagagcaccaucccuuuuuucagugacccagguauaaaaccuuguuauuuuuugugucucccucuccuucuauagcaaacuaguuauuuaccaggugcuguagauuuaacuucuauccaaucucauuuccauccccaucuuucugcuuuugauguuaugcccuaaccuauacucuugauaaauuucaccuaagcuccugguaccugcucaguuuacuuacuguuggccuuucugcccuaucagugaugcguuuuaacacaaaacagucauguauauccagcuuuaaaaagccgaauaucuauacuucaugauuaaguauauacugaaaaggcaaaauaacacuccucuucaugacuaacuacauacauucugccaaaugcauucaaacacaauucuguguucagaagcuauugauaauaucucccuugcuugcuacacuuaccaauucacauucaacacucucugcuauaugucccugauuuuucauuauuuuuuauuuuuauuuauuuuuaaaaauagagacagggucucagcauuuugcccaggcuggucucaagcuccugagcucaaaugagccucccuccuugguaucccaaaguguuggaauuacaagcacgagccaccacgccuggccucauuauuuuucaaaaaauccuuauuuuuucuucuuuucuacuugucaucuacauuccaauguaacaggaugacuucuuguucuccaaagacgcuguaacuuucccaccuuucagcucuucuccucuugggcuuuccaccuguauccuucuuccuauagauccaaccuugcccucaagcucuauuucaggaucacucauuucugguuuguuuuguuuguuuguuuuggagauggaaucucacucugucgccaggcuagagugcaguggugcgaucucggcucacugcagccuccaccuccuggguucaagugauucuccugccuuagucuccugaguagcugggacuacaggcgugugccaccacacccggcuacuuuuuuguauuuuaguggagauggaguuucaccauguugcccaggguggucuugaacuccuaagcucaggcaauccaccugucucggccucccaaacugcuaggauugcagggguaagacaccacacccggcccaggaucacuacuuucuuuaaaucccaaaugaagaauucugcuaggauuacuaaucacauaugugaaauuugacuuuuaaaacaauaguuccuuagcauuagaaguuaaucugugaauuugacuuccuuuucuuuucugaauagcuuucaaguguucucugggauagagagagaucaagcuuuuauagccugacgaguucaaacaucaguaaaugggaauuagaugauucuucagaaaagcaugcauacaguugggauauaaauagagcccugaaggaaaacauuaccgaugcuauuuggguaagaaacaauaauauucaucucuguaauucauguuuaugguuguaugauaaugcugguucccuuaauuguuuuauuuauuucaacacauuucaguguaauaaacaacauaguguaugguuaucagauuaaguggaaauggguuagucaaucuccagaaauauuggaaugcauugguuuacuugcuuagcgauuuuuuuuuuaauguauacauuauucagcaacugaguuaugggugaagcacuucacuagguacuagggauauaaaggugaaaauaaaucauuccugcacuugagaagcuuacauuauugauauuuucauguagggaucugaaaguaacuaugaagcuauuaaagaaggagucaacauucgauauuuggacuugaagcaaaacugguaagcaauuaauuugucguaaagaacauagagaagaguuuggaaaaaauaaguugauguuuauaauaaaaugaugagcaaucucacuaugugcucuuucuuuggagacagggucucacucuaucacccgggcuggaauacaguggcaccaugauagcucacugcagccaugaccuccugggcugaagugauccuucugccucagccuuccaaguagcugguacugcaagcaugcgccaccacaccuggcugauuuuuaaaauuuuuuuguagagauagggucuuaccauguugcccagauuggucuugaacuccugggcucaagcaacccuccugccucagcaucccaaaguauugcgauuacgggugugagccacugugcccagccuguucuuuuagugcgggucuucucaugcuaucuauuaagccuuacugaauggucuugcucuuguuuaucgagugauguuaguucauuugggaaauugaggcauuuuucagccuuaaauaguauauucuuaccuucgugucucauucguuagagacaaagcuuuucugcucuuacagcuagagcuucucuucuucacugccaagagaugccugagacccugucauugcccacugcuguggcugccccaugcugugaucuuucucucauuggagguaucaggcacauauuucccacccucuuucuguugcucagggagcuuuaggccuauguuuguggcuaugcugaguuaaggaugggauaaggcuuugucuugguaguacaaauuagaacuuaaucauaguucauacucagaguaaauuuccucuuagaaacagugcucucucugaguggugcauaggauccuagguuagucugauaaagcuaauuaucccauguuacuauuuaacuuuaaugcucaaggucacauggaacuuaaaaaccauuuguaacauugcucauagugaauccaaauauauaacuaguaauccuucagaugacaacuucucagaaguuaaagacuauuuuuuaugaguuuuagaguaauuuuuacuguucuuguuacauguuuuggguuaguagaacaaauucuacguguuccuuggagggauauugcaguuguaccacuuuguguaauuugucucucucuuggacuguuuagacuauuauuauaggccccuuuacagucucugaaaaccuuauaaaagcuaucaaagagguaaaaguaauaguacuuguuuaauuucuguaagcguuuuaauuaaauacaguuuaccuguuuuugucuuuaccagacuuuuggaaauguaggacuacugcuaggacagcccacuaugggcauauaauacagacauuuuucuuuuuucuuuuuauuuuuuuuugagacugagucucacucugucacccaggcuggaguacaauggcauggucuuggcucacugcaaccuuugccucccgguucaagcgauucucccaccucagccucccaaguagcugggacuauaggugggugccaccacucccggcuaguuuuuguauuuuuaguagagacagguuuucacuauguuggccaggcuggucuugaacuccugaccucgugaucugcccaccucagccucccaaaguagugggauugcaggugucagccaccacgccuggccaugcagacauuuuucacauaguuuucugaauuggaggcaugagguugagaaugagaagcaugcuuaggaauugcuaugcaggguccacccagggcuccucugccccaguguugucaugcugaccagcagggucccugugaggugcagcccuuauccuccuugaccuuccucuccaccuuuacucaaaauuauccaguuaguacucuauuauguucuugaggccucaugaucagaacuguacagagaauuucucauauggguccguuuauuuauuuuaagaauagugucugucuuccuuauagucauucacaccuacugauuuguuguccauuugggcagagcuacaaucugggcuuauaauuucagugaguagcugggcuggguggcucacgcauauaaucccagcacuuugggaagccaagacaggaggauugcuugaagcuagcaguucaagaucaccugggcaacaaaacgagacccuaucuccacgcaaauaaaaauaaaaaauuagcugggcgugaugguguguaccauagucccagcuauucagaaggcugaggcgagaggaucacuugagcccaggagauuggggcuguagugagcuaugaucccaccacugcgcucuacccugggcaacagagaaagaccuuuuuucuaagaccaauaaaacaaaaauaaauaaauuauuuuacuagaugauuacuaauacaaaguuuagauaucuucauuuuagauauaaaguuuggaauuuuuuuuaaccuuaacuucauuacuuuggauauacucacauaaaaacuuaacugguaaagcaggaggaucacuugaggccaagaauucuaggccagccuggcauuguagagagagagacacugccaacauguuacaaguuugggccaauauucuuuuuuuuaaaguugauuuuuuuuuuaaauuuuuauuucaaugguuuuugggguacaggugguuuuugguuacauggguaaguucuuuaguggugauuucugaaauuuuagugcaccugucaccugagcaguguacacuguauccaauauguagucuuuuauaccuuacccuccucccacccuuccccuucagguccccaaaauccauuaucauucuuaugucuuuguguccucauagcuuagcucccacuuauaggugagaacauaugauauuugguuuuccauuccugaguuacuucacuuagaauaacguggaccaauauucuugaauuccuuucaagaguccaagcagaagugauaaaguuuggggagcugggggaagagaaccgugaagaaggaaaaugagccgugcuaggauuccuugcuuugaagugucaugucauuuaguuacaugcuugguuucuuauuuuuaguugucaguagagggugcuuugccacccuuuuaaucuuuuugagacuugaaugaaaguugcuaguaauaggaccgggcgcaguggcucgugccuguaaucccagcacuuugggaggcugaggugggcggaucaccugaggucaggacuuugagaccagccugaccaacauggaaaaaccccaucucuacuaaaaauacaaaaauuagccaggugugguggcgcaugccuguaaucccagccacucgggaggcugaggcaggagaauugcuugaacccaggaggcggagguugcagugagccgagaucacgccccggcacugcagccugggcaacaagagugaaacuccgccucaaaaaaaaaaaaaaaauguugcuaguaguaguauuagauguuuuagaagagcuaaaauaggaaccauuuaauuuauugggagcaacaaguuugcuagacuuaaggaacaaauaagcuuuaagaugcaaaaugguuuguuuuuacauauauagcaguuugaaauuucuauaaccaauggcuaaaaagcauuuuaaauauauauguuuguuuuuaaacauuagagacaggguugcccuguuuggucuugaacuacugggcucaagcgauccuccugcuucagccucucccaaagugcuuggauuaaacacauaagccacuaugccuggccuaaaauuauuuuuuuuuugaguuagagucucacacuguugcccgggcuggagugcagugguaugagcuuggcucacugcaaucucugcaucgcagguucaagugauucucaugccucagccucccgaguagcugagauuacaggcacacgccaccaugcugggcuaacuuuuguauuuuaguagagaugggauuuugccauguuggccaggcuggucucgaauuccuggccugaagugauaugcccaccucggccucccaaagugcugggguuacaggugugaaacaccacaccuggccuuuuaaauuuauuuuagagauauauggucucacaguguugccuaggcuggucuugaacucuugggcucaaaugauccuccuaucucagcuucccaaaguguugggauuacaggugugagccaucgugucuggagguaaaacuuuuuuaaaaauguuuuuccucuggacaaaagcaaguaagcuuuaaauaacugaguacaucagggauuggcaaaccuuuucuguaaagggccaaaaguaacuguuuuaggcuuuggcggccauguagucuuuacugcaacuacucuauuucaccaaugguaucaugaaacaucccuagaaaauacauaaauaaaugcguaugguugccuucgaacaaaacuucauuuauaaaaacugguuugagaucaguuucacuggagggcuguacuuugccaaucccuggaucagaugguuguuuugaucuuuuuuuaaagucagauuuauugagcuauaauuuauauagaguaaaacuuacccucuuuaguuuauaauuccacaaguuguuuuuuuuuucuuuuuuuuuuuaagauggggugucacucuaucgcccaggcuggagugcaguggugcgaucucagcucacugcaaccuccaccucccggguucaagaguucuucugccucagccucccaaguagcugggacaacaggcaugugccaccaugccugacuaauuuuuauagagaugguuuugccacguuggccaggcuggucuugaacuccugaucugagguuaugugcccaccuuggccucccaaagugcugggauuacagacgugagccaccgcaccuggcccuaauucuacaaauuuugacagauacacaauuuagucauuuaaccguaacaaucaauacagaacaguuuuauaaccccccaaauucccuugugcuuucuguaaucgaccccuccauccucuagccccuggagaucacugaugugguuucugucccuauauuuugccuuuugcuuaaugucauagaaauggaacauacaguguaaagccuuuugagucugguuucugucacuuagcauaauacacuucaaauucauucaguauuuuuuuuuuuuuuuuuuacuacugaauaguguucuuuuguauggauauaccacaguuuguuuaucuauucagcacuuggaagacauuggguuguuuucaguuuuaggcaauuaugaauaaagccacuacagucauuuguacacagguuuuugugugaacacaguuauugguuuucuguuucuguuuuuaaauuuucucuuggauagguguccacgaaugggauugcuaaguuauauggaagcauauguuuaauuuuauaggaaacuccuaaguuguuuuuuagagaggcuuuacaucuuccuuuuuuauugauuagugaugggcuggugauuuuggcagcagcauggcacucagcagacaauccaugucucaucuauuacucucugauaacaauagaagauaaugguugccaaaugucagaugcaguuacuguagaagucacucaauauaauccaccuuuucagguaagauuuauauugguuaaauuacaaagcaauaauauguugaguauuuuucuaaccauuucagggucuuauuuauuuauugaaagaguuuugcucugucacccaggcuggagugcaguggcuugaucucagcucacugcaaccucugucuccccuuccagguucaagugguucuccugccucagccucccgaguggcugggacuguaggcaugugccaccaugcccagcuaauuuuuauauuuuuagcagagacaggguuucaccauguuggccaggcuggucucaaacuccugaccucaagugauucccccagcuuggccucccaaaauauugggauuacaggugugagccaccuugcguggcccauuucagggucaaauuucgugacagauuucaucugcagggcuuggaaauauuuuaaaauagcuuguuucuagacauuguugcauuuucuuugccaucucaggcuuguucuuuugcuuaguuuugacuaaagaaaaaugagaauggaagcaacuagcagaaagcaguuuguuucuucugcucuagaucuuuggagggauugucaugucuguauuuagguagaaagaagguauugauuaauuccagggugaaaguaaggaagaaaccaagcugggcaugaugaguacaugccucuagucccagcuacucaacaggccgaggcaggaagaucacuugagcccaggaguuugaggcuguuguguaccauauucacaccugugaauaaccacugcauuccagcuuaggcaacauaaugagacuccauccuaaaaaaagaagaaaaagaaaaaggaaggaagaaaacugguaggaauuaggguuugguuuagagccuuguauacuauagaaaaauccuccuuuuuacccaaaggaagauuauauuuguauucagcaguguucuguagucaucaaaguucuuguaaaugacuggaagacaggcuuuccaauuuuaaguucauuaauagcaauuaaacauguuuaauaacugguauucaugaggaagaaccugaacaucuauaaauucauuuuauuuacucuuacauaguaucuaauucuguuaaauccuuguuuguuuauuuuuugaagagauaaagucuugcuguguugcuuggacuggagugcagugauauucacagguccaucagagugcacgguagccuccaacuccuggucucaagcaguccucucagguagcugggauuacaggugugcaccaccguuccuggcuuaaauucuuacuuuuuuuuuuuuuuugauccuuacucuuaacaugacuuguuuaauugaauccuguaagaaaaucuuuugauuuguucuuuuaugccaaacagaaauaaacuuuaucauguguucugauuaugcaguguggaaaacaugcucaguguuagaaaaaauuucagccagggcagaagacuauaaagagaauuugaggauuaaaaaacaauucuaggaccucgcauuuaauauuucuguaaaauuacuucuuuaauaacagcuuaucauuuuuagcauauucuaauuuuauuuaaugagauuuauuuuuauuucucccucugauuuuauauguaaacaaaucaacuaaguuuucuugucauuaauaucuuggcaguaagguaagaacaaaaauguuuguuuaucagggaauauuuauaaaaaauugccaauucuuaauauaacgaauuuuagugcuuucauuuucuccuuugaauuuaucauaggcuucuaguuauagucaucaucauggaaauguuuuccaaauuuguuaauuuuggaaauuaacaauuuaggccaggugcgguggcucacgccuguaaucccagcacuuugggaggcugagguggguggaucaccugaggucaggaguucaagaccagccuggccaacauggugaaaccccaucucuacuaaagauacaaaaaaauuagccgggcaugguagcaugcaccuguaaucccagcuacuuaggaggcugaggcaggagaauuguuugagccugggaagcagagguugcagagagccaagauugcaccacuacccuccagccugggcaacagagugggacucugucucaaaaaaaaaaaaaaaaaaaaaaauuaaaaaagcaaauuauaagcaagucaacaaaauauaugucuaauugauguuuauaaacuuacucugucauguuuuguuaaucaucucauggguaguguucagauuuuuacaaagagaauuggugaaauauuuuuaugaaauaauguacaaaaaugaauuuaaaaaaucauacaaauauuuuuguuuuacuucuuguuaaauguaaucuuaaauuuaacuuucagucugaagaccugauuuugugucaguugacggucccaaacuuuucaaaccagacugccuaucuguauaacgaaagugcugucuaugugugcuccacaggaacugggaaauuuucucuuccccaggagaaaauugucuuuaaugcacaagguacaguagcaguuuuagaaagcaugauuggugagcucauuagucauucugagugcuuuuuuucucuuucccugaaugucacuucaagcaugcugcuuucaaauguuucugagacauuucauaccacaacuacagcagcugaagccauaacccuacuaagaaaccaaaaggguacuagaauuuccaaacuauuauauuuacagacaaagauaguaacauuuguuccaggagaagaugccaagaagcaaaaaacuauugccaagagaaguaauugcuuauuccuaguuaguaaaagugacauauucugaguugaugcuuuaacuuuuccacaccccuagauaagaagagcuucaggugcuggacuuaugcaggggggcuggucaggauugaagaagaaccaagcagauacuuagcugaagggguugggcagaggacagagugcagguaggcaacagcauggaacccagguuuucuagucccagcacaagaaccuugacagaggguggguaggauguuacuaaggugccagguaggcuuagaccuuuuuuuuuuuuuuuuuuuuccaguccccauugacugaugugguaaguuaaagucagaauuaagagaacuccacaggauugaaaaagcucuucuucugaguuuugcagaaggaauaauuuucuuuuuuggcuuacuagacugacugcugucuggcaaggcuaguuuuuauuguccuuaaagcugaaagacacagagccugcuucuucagauagcaaccgguucuuagcauuugauucugggauguaaaggaugaguucgaaguaggacuaauguuguaaaggaaaaaaugugcuuaauauaucaucaagaugauuuucugcuuagggugguagcuuuuacauagcauuuuguuguuauuguuagauguauuugacucuguuuuccuuucuuuuaggagauaguguuuuaggugcuggugccuguggugguguuccuaucauuuuuucuagaaacaguggacuggugucuauuacuucaagggaaaaugugucuauauuggcagaagacuuggaagggucuuuagcaucuucaguugcuggaccaaacagugagguaaugugauucgauaagaauuugaaguuuuuauguuauuuauuuuuuagagauagugucucacgcugucacccaggcuagagugcaguggcacagucguaguucauugcagccccaaacuccuggccucaagcaauccuccugccucagacuucccaguaggugccuggcuaauuuuuuguuuuuugguuugguuugguuuuugagacagagucucacucuguugcccaggcuagagugcaguggcauaaucauagcucacugcagccucaccucaaccucccgggaucaagcaguccuccccucuuaacuuccuaaauagcugggacuacagacaugcgccaucucaccuggcuaauuuuuuauuuuuuguagagacaggaucuccuuauguugccuaggcuggucucaaacuccugggcucaagaauccucccgccucggccucccaaagugcugggauuacuggcguggagccaccaugcccagccuaauuuuuaguuuuaucagauuauuuuauacaaauggucucaaaacugagacaguuuucaaagacguaaugaugcagacauuaguucuuuuuaucuuccucaucccuucuguccucuuugccuggagcaacuacauuuaagccuuuuagugauuuauucugguauuuuucuccauauaucuaaguaauguacauauauuccugucuccugaugcaucuguugauuuucuacuacagaaaaugagguuuuggguuaccuuauacuccuuccucugccuuuaucauucuaacauaaauuuuuuucauuguaaugacaauguaaauauuguuuaugguuugcugaucccaaauacugauuacauguccuuuauuauagaacuuugugugacucuuggaguguauaaugaccucguuuuguauuuucucacuuuccuuucauaugugacuuaaucuuuuuacacacuccaggaguucuguagagugccccucaauguaguuuuucccaaagucaagucuccagaaaccuuccaucugcacagcugucaucccagaacuucccuuuucuauuguccucaaauccucaggaccuguccucugcaccaugcauagguggccucaucuccugucagcggggccauuucccauuccuucugcuuucuaucuuccuuuguuguaguuaguaucacagauauuuccaaggagcuuguauuucuguuucuuuuuauucugggaugauuuuuugagaggaauagccagguaaaaauuaccaauuuuauucuguugucuugaaaccugaaauauccuauccauaagauuuuuaucauucuuuuacagaagacuaaaaauaauuaauacuguuugggguaauuuccauuugaauaguguaugaaauauauagacuaccucuguaauucaaauuaaagugauuaaguguaguuuuaaaggaaagaaacaauuuuuaacuuuuuuuucuuuucacaaaagggauuaauaccuugcauuuuguauuuuguaauuauacaaaauuauacaaaguacaaaauaccuuguauuuuguaauuaauacgauuacaaaaaaggauuaauaucuauuuuguaauuguaugguuauuauaauacuguuauacauucugaagcaauuuuauaguauuccauuucuuuaaaauuuuucuaaaccguuguuuaaauuuguaaucaaccauuaugcuuagguaguauacacugugaugagucguguaagagcaaaccuauaaaaagauucuguuaauuaugaugaaauguccaaauuauuuuacuuacaacauaaucccugaauuaccuguaccuuuucuguaugacuuugguugaucauuugaugcuauuuauaguguuucaauaaguauaugaauaauugguauggaccaagcuuguccaacccacaacccaugggcugcaugcggcccaggauggcuuugaaugcagcccaacacaaauucguaaacuugcuugaaacauaaauuuuuuuuuuuuuaacucaucagcuaucauuaauguuaguguauuuuaugugugggccaagacgauucuuccaguguggcccaaggaagccaaaagauuggacaccccugguacagacaauacggcaaacagcucguguauaugcggaguugcuaucauaggaugggugcaguuuuuaguccaauaauuaagaauauucagaugccuuuaccucuaaacuauacuuuguuauuuugcagaguaugauuuuugagaccacuacaaagaaugaaacuauagcccaggaagauaaaaucaaguugcugaaagcugccuuucugcaauacugcagguauaacauguuuuuuaaauuauggauuauuuuaugugugaggauauguuuuacugacaugugcuacuuauugacuggugggagcaaguuggaggaaugaugcuaucaagaggagaauguuuuuuugagcuuuagcacuuuaauaaacuguucuucugaacuuaguagccaugggaggguuccagcuagcuagguuagggaaaaaacaugggcucuaacauacucucuccacuucaugaaaaacaauguaccauuaaaaauggugaucaugaagacaucuugcaagggucuuuuacguauaacguuaaggugcaaauaaguugcuuacaaaguuuuuuuuuuuuuuuuuuuuuuuuugagacacuccgucgcccaggcuagagugcaguggcgcgaucuuggcucacugcaaacuccgccucccggguucaagcgauucuccugccucagccucccaaguagcugggacugcaggcguguaccacuacaccuagcuaauuuuuuuauuuuuaguagagauggaguuucaccauguuggccaggcuagucucaaacuccugauuuuaggcugacuccuaaagugcugggauuacaggcgugagccaccacuuccagccgcaugcaaaguuuuauugguaauauuaaagaauuauggccuggugugguggcucacaccuguaauuccagcacuuugggaggcugaggcagaaggaucucuugagcccggaaguucgagaccagucuggacaacauagaccucaucucuacaaagaaaaauuuuaaaaauaauuagccgggcauggugaugcacgccucuagucccagcuacucagaggcugaguugggaggaucauaugagcccgggaggccaagucuacugugagccauaaucacaccacugcauucuagccugagugacagaucaagucccugucucaaaaaaagcaaaagaauuagaccuggccuauuaguugaguuuugcuuuacgcaaaaucaccacaaaccuuagugacucauuuaacauagcugacaauucugcaguuugacuguuggggcuggacucggggcaguuuuacuuuucggaguaggcucacucauuuuggucugcagcugggcuggcugcucuuuaccguacucacauuucugggccauaggcuggccagcucgcucucuauuccugugaugucuccucaacuagcaggcugcccugggcuuauucauguaucacaggguucuagaguggcaagagaacaagugucagugcacacucuuuaagucuuugcuuggauggcguuugcuaguguccuguuggccagagcaaguccagcuguagugagagcgugccuaagcagaugcgcguaugggguggggagugauuguccucacuuggucacacuugcugcucuaauacucuucuggguuuaaggcaaaugcagauuucaguuuaucuuagacauguauucugcucauguauucugguacuuuccuuaaaagguauggcaaauucacauuugaauaaauacucaggaaaauggugauccagccccccugcucugccccuuguuagcugugggaaacuuuggacagaugcugaacauuucugccauuguguuucuguuucuuccuuuucgaaguauugaguggggugggaguuagcauggcuaaaggaucauuaguuuaucgucagaucuuuguuuugaaggaauauacugaguguacuaccuucauuucccccaguucugagcccaugguuccauaaucccacucauacuggugucugaugcauagcggcucacucacagagacaacagauuccaaagugcuuuuacaguucuaacauucuguaccucgugaucuacugagcuuaguuugucaccagaagggggcaccauuaggcaaguuuuuuguuucuguuuaaaauuauauucuuuuaaucuuguucuuuuacaugguucagucuucaaaaaucucaguugaaguacuguguuuuuaucuuucacaaguuuauccuguaauuaaaauucugucacauuuguggcaucucaaaauguaaaugauaaugcagcaagugaccagucauuagauuuguuuccuguggcugccauaacaaaucaccacaagccaggagcuucaaacaacgcaagugucuucucucacaguucuggaggccagaagucugagagcgaggcaugagcagggcccucccucugaaagcucugagaaaggaucugucuucaccucucucagcuccggguggcugcuagcaauccuugguuuguagaugugucacuccaguuucugccuccauugucacguagcuguccucacauucacauggccuuuuuuuuuuuuuuugagacagagucucacucugucauccaggccagagugcaguggugugaucucggcucacugcaaccucugccucccugguucaagcaauucuucugccucagccucccaagcagcaggugcacacugccaugcccggcuaauuuuuugaauuuuuaauagagacgagguuucaccauguuggccaggcugggcucaaacuccuggacucaagauccacccaccacagccucccagagugcugggauuacaggugugagccaccaugcccagcccacguggccuucuuauaaggacaucagucauuggauuuagacucaucauaauuuaacaaauuguaucugcaaaaaccuuauuuccaaauaagguugcauuuugaggcacuggguagauaugaauuugugggagacacuauucaaccugguguagucaucuuaagauguuuuacaggggaaaauuauuaggcacaagaagggaccccugaucuaaguccugagcaagcaguacccucaggaacagugucaugggcccuguagcacagcugugcugaacucauccugcccaacaugggugaaguacuauggacuuaauaagggaugauuucugggggagugucagcuagcucucuuaaagauguagacuccuuacaaacagaauuguggugccuuuaaagcuggauuucucaaccccauuaacauugucauuugaggccgggugugaugguucacaccuguaaucccaguacuuuggaggccaaggcaggcagaucauuugagaucaggacuucgagaccagccugaccaacauggugaaaccuugucucuucuuaaaaaaaaaaaaaaaaaaaaauagcugggugugguggcacaugccuguaaucucagcuacucaggagacugaggcaggagaaucgcuugaacccagguggcggagguuguagugagccgagaucccgucaccgcacuccagcggugcauuguaagcuguuuaacagcaucaccagccacuuccugcuagaugccauuagcacccuuucccccaacuugugaugcccaaaguuaucgucagacauugccagauggccccuggggucacaauugguagauaacacuuuuaagugugacugucuguuuaaucuuuugcuaagguaauauuacuguuuuuauagcaucauuucuuugaaauugauuuuuauguuauuuugguuuucauuuuauuuagcccaaaaaacacuaaaucuuuuguucaugagaguuuuggggaacuuuuucuguaauuuuuuauuaaaucuugccauagucaccuuuguauuuucauaaccuguagcgugacugggucaccagcuucacccuggccuuucacgcuuucaagaguuuuucugcguuucuccagucagcugugucuccuguucuaccaagggaccaugacagcccuuuuccagucuccucccacuucccucagacuuagcagaggacuuaacuuccuacuucacagagaucacagaagcccuugauaagagcucccuguaccuccuagcuuacuagcuaugaauguaucuggaucccaaauccuguuccucuuucccucccaauaaaguaggaaguguacucuucuuccuaucagagacugcucuuuguuuugaaggccacucucuccugcuucacuuaagacuacauccuuucaguucucccuuuccucuguccuuugaccuuucucgugcuggcuccuucucaucagcaauuaaucauauuuagucugccauuuguaaaaagaccagucuuugacuuugcguccuuugaguuaccaccuuaucuguuuguuccuguugauggcuaaaccaccugaaaggaugucuacauucucaguugucgaccacauucccucucugucuacucccucggugaucuuuucuccuccuuggcuucauuugcugaagaaacagauguaccaugacccgggccauuaugugaaaauggagaguguccagcagcaguacauauuucauaggcacuugaguuucaacguauccaaaaccgagcuuaucuucuccaaagcuuauucuuccauccuuacccccugcuccagugacaagcacuaccaucucuucaguucaaagcaacaacagaggagucauucuuauacaguuguucccccuuacccacagggggauaugucuuaagacccccaguggauaccugaaauugcauauaguacugaaucauauauauacguuuuuccuauaguaccuaugaugaaguuuaauuuauaaauugggcauccuaagagauuaagaacaauaguaauaaaacaaccguaacaauauacaauugaccuuugaacaacacggcuuugaacugugugggucuacauaauaugcaggcuguuuucaaccaaaugcggaucaaaaauucacagcauguuuucaaccaaaugcggaucagaaauucacuugcuuaugcagaaggucgccuuuuuguaugcuggagcuccacagagccagcugcaggacuugaauauggguggauuuugguguauguuggggguccuguaacuaauccccuguguauacugagagaugacuguacuguaauaaaaauaugugagugugguuggucucucucucucucucugucucugucaucuguuuucagacugcaguugacugcagguaacugugacugugggaagugaaaccaugaauaagaggggacuacuguacaucagauccagcaguaaccuaacuggauuuuucucuuuccugucuuuuccuuucugcaguaaccuccuaacuggauuuuucucuugucugaucugacaucugauccccucuccauaugauagagcaaucuuuugggacacuggaacagacugugacacuccuuuacagugccuguccauuguccuugguauuagguucaaaccccauaacaugguuuacaagaccguguccucuaauuuugugauucaucccuucucaguaucccucguuucuucaugugugccauaguuaauccccugguggguucauugacacccuaguuguccccuaaucucucuaaguuagaagagucugcugcuuuuuaugggcuuacccuuccuuuaauugguuauccugcaaguuuuuuccaaacucuugcucccugggugaucucagccucucccguagccucaguucucuccugagauagaggcuuacuugcggacggauguggauguauguucugugugcagcuguauaccccucccccaguucuccccagccuuccaugaccuccucuuuaccuguuaggaaguuuucccugucucucucgguguuuaucaccugugucauugcuugcucaauugucuggacuauuuuuaagucuuuuuaucuuucuguguccagagccgagcauguucuaaguauucaauguguauuuauugaauuaaugaauggauaauaguuuucucccuuuuaauuaaauaaauuuuauuaaaaguaacuuugagccaaaaccuauaaaugguuuuuagguuacauuuaacuucacaauuaacuuaaaauuuuuuuuuuauuuuuauggguacauaguagguguauacguuugugggguacaugagauauuuucauacgggcauacaaugcguaauaaucacaucaggguaaaugggauauccgucaccucaagcauucaucuuuuuuguauguugugaacauucuaauuaugcucuuaguuacuuuaaaauguacacuaaauuauugaacauguaaaguuuguuacaugucuuucgugccugacuuauuucacuuaacauguccuccaguuccaucccuacuguugcgaaugacaggaucgcauucuuuuuuuuggcugaauaguaguccauaauuaauuuuuucuuggugaguuuugaaaauauuuugccucccuuaauacuuguguuuuccaauuuuauuucagaaaagauuuaggucaugcucaaauggugguugaugagcucuuuuccucucacucugauuuggauucugauucugaacuagacagggcaguuacccaaaucaguguagaccugauggaugacuacccagcaucugacccacggugggcugagucugucccugaggguaagaauguuucaauuauggaacgguguguuuugaacauauucugguuucuuuauuagaagcaucucuuaaagcauauuuuuuagcuucucaaacaauuuaauauuaauucaauauuuuuuaaaauauugugaccuuccuuuuuuuuuuuuuuuuugagacagagcaaggcucugucacccaggcuggagugcaguggcgcgaucuuggcucacugcaagcuccaccucccagguucacgccauucuccugccucagccucccgaguagcugggacuacaggugcccgccaccauggcuggcuaauuuuuuuguauuuuugguagagacgggguuucacuguguuagccagguuggucuugaucuccugaccucgugauccacccaccucggccucccaaagugcugggauuacaggugugagccaccaggcccggccagguaaccuuccuuauaguauguuuugaaaaagggucagaacaggucuagauaacagaauggaaacuaaaggaacauuggagcaaauccuaauuguucuauccaaggcagauuaauugccuuacuuagcuuuccuggcuuuuauuucuaaaagaaaauugguugcauagguagacaguuggcacuuaccugccccccaaucccaguuuuuuuuuuuguuuuuuuuuuuuggaaacagggucucccuuacuuugucacccagacuggaaugcaguggcacgaucucagcuaacugcaaccuccaccuccuggguucaagugauacucccaccucagccuccugaguagcugagauuacaggugugcaccaccaugcccagcuaauuuuuguauuuuuaguagagauguaguuuuaccauguuggccaggcuggucuugaacuccugaccucaggugguccacccgcuuugaucucccaaagugcugggauuucagguguaagccaccacacccagccuacuuacccccaaauuaaaugauaauuuuggcauaaucaguauauuugacuaauagaaaugauccauuccccuaagagcagcagugaucaaaugucaauauguagaaguggacaagacaugucuagcugccugucccaggugacugccccucuuacucuuacuuccaccucagaaacucgaggggaacucugggguccccagauaccagggaacugucucaaacauguuucucucccuaauuauccuacuucuuagcaaguucacuaagcuccauuagagauuuaggaagaaaacaugagagcucaucuccuuucuuugacuguuuuuguuggcacugucaagcuuaaauuguuacaaaugauuaaacuaaaaacguauuuugcauuuugaauaaauacaguaugaauuguaucaaaccuccaaaauuuacucuuaaauuuuuaaaacuccugaguaacguuauaaacaacuguauuguaagguugauauuuuuauuuuguauagacuuuuuuuuuuuuucccuuuucuuuuuugagaccgagucucgcucugucgccaggcuggaaugcaguggcgcaaucucggcucacugcaacuuccaccuccccggguucaagcaauucucuugccucagccuccugaguagcugggacuacaggcaugcgccaccacgcucagcuaauuuuuguauuuuuaguagagaucggguuucaccauguuugccaggauggucucgaucucuugaccucgugaucugcccaccucgaccucccaaagugcucggauuacaggugugagccaccgugccuagccuuagcuuuuuauuuuaauagcaguuagccacugauauuaaaauaguauaguuguaaaaccacuauguucuaaguuuuaucacuguguuuuaacagaagcaccuggguucagcaauacgucacugauuauccuucaccagcuagaagacaagaugaaagcucacucuuuucuuauggacuuuauucaucaaguaagagcgcagggugcugggcacagggcucugccuuuggcagucucuccaacacagugggaagucucuucucucuauuuugagguguuucauuggguggggcaugacugguguuuuccauugucucugcugauuuaaaaguccguaauuccagggcuguguacaagccuguuaauccagguauaagaagcaggacuucauucagauuucccgugugcguuuguguaagaacuuaaguuuucaugagucgauuuuguauuugacagauuuuuauguaugacuuuuaauuuugaggugccauuagaaucaaauccucauugaaaguauuccuuuucuuuuuuuggguaaagguuauccucacauauauugugccuaaauuagaaaauguuuugcuacuggacagaauuguuacauaaauucacucauucuugucucgucaauaaaaguggcuugcagacauauuacguagccaaaugaaugaauuucaaccugcuugggguuuuguuuguuuguuuuauuuauuuauuuauuuauuuauugagacagggcacucuguugcccagucuggaguguaguggcacagucuuggcucacugcagccuugaccuccuaggcucaagcaguccucucacagccuccuggguagcugggacuacagguuugugccaccaugcccauauaauuuuuuuucaguuuuuguagagacagaaucuuacuacguugcccaggcuggucucgaacuccugggcucaagaaaucacugcacuucagccucccaaggugcugagguuacaggcaugagcuaccaggcccagucucuucccugauuguuuuucaaacucaguagugccuacucacuaccacacccggcuaauuuuuuauguuaaggagauucuagugagugcuguccaauccauugcuuucugugaucaugggaauguucuccuagugugaugucuagugggacagcugcuggccacaugugaccugaacaguugaaaugugacuagcaacugaagaacugaauuuuaacuuacuuaaauagccacuguggacaguggcuaccuuauuggacagugcagcacuagauaauuucagaaaugacuugauuguuccuaaucccacauucuuuuucaauuuugugcaugguuuaucuccugucuacucuuuuauuuucuuggcaagaaaacuccaaucauucauugagucucucuuuuuuuguuauuguuauuuuaggugggauauggauuaaugaggaaaaaacauauuuucucccgauauggucguuuaauuagccaaguguaucaguuaacuauuacugccauauaaaccaccccaaaacacaguggcuuaaaacaauucuguggguuaaucaggcaguucuucuguugguuucacccggaaucacucgaccugcauuuaggaugcacugagcuggagggucugcaagccucuucccgcuuucuggcaguugguuccaacugucaacagaggcuaugugguucuccuccauuuagucgcucauccugcucugggcuggacuggcuuccuguggucuuaacagaugaacauagaagcuguaggcuucuuaagggcucaucucagaugucacauaauguuacuuccaguaaagugacauuggucaaagcaagucacaaggacagcugggaugaaaaauuaaagaauuuauuauaccucuuuuuuuguaugugugugacaggguuucacucccaucgcccaggcuggaguacaguggcgcaaucucagcucacugcaaccuuugccuccugggcucaagugauucuccugccccagccuccccaguagcugggacuacaggcgcauggugcugaaccuggcuaauuuuguguauuuuuuguggagaacggguuuugccauauugcccaggcuaguuucgaacucuuaagcucaagugaucgccugccucugccucccaaagugcugcgauuacaggugugagccacugugcccagugugauuguaccucucgaugggaagaguggcaaagucauucucauuggaagaggauaugcauacugggccggcaggaccuugcccugaccugauucgccacacuaaaagcauggauuuaucagaggcccgaaagccaugagagcaugagcacucuugucucagccuuccuggguuccagagaacccucacgaaguuccacggcugcugguagcaguaucuguccuaaggcaaugucuagcuaguucugaaaaccccauuccagccaugccuuuuauguuucuauuuccuuuaauauuuagagcucauuuaacuaaugaggaagaauuuauguugauaauuaggaaaaagguauaacuagauacuaaggaaaguuuuuuuuguguguuuuuuguuuggauacagggucucuguugcccaagguggagugcaguggcacgaucgcagcucacugcaggcuugaccuccugggcucaagcaaucuucucaccacugccuccccaauagaugggaccacaggcacucacuaccacgcccggcuaauuuuuuuauuugcuguagagacagggucucauaauguugcccaggcuggucucaaauuccuggccucaagugauccucuugccuaggcuucccaaagugcugggauuacaagccugagccacugcacccagcccuagggaauauuucugaauacagagaaauauuccuuuucuccuugagccaaacuuggcaucugcagggccauauccucauucugaaggggguggaaguaacaccaacacuucagaacaguacccuugccucuaguuuucugauguugagggaagccucuguguucauacauuguguuuccauaccuuacagaagcagggagguaaucugaucauauucacugugugacuagaaugauuguacauauauauauauauauauauguauauuuaguuuuuuaauuuuuuugagacagggucucacucugucacccaggcuggagugcaguggcaugaucauagcucacuguagcuacagccuguccgggcucaggugaucuucccaucucagccucccaaguagcugggacuacaggcaugugccaccaaaucagcuacuuuuuguauuuuuuguacacauuacccaggugaucgccugcuucugccucccaaagugcugggauuacaggugugagccacugugccuggccuagaauaguuuuaaucuagagccauugcuucacugucagugcugcaaucaaagcaaaguaaagcaggcaauugggaugaccuugcaugaaaacuccaccuagauuuuuuuuuuuuuuuuuuuugagacggagucucgcucugucgcccaggcuggagugcaguggcgcaaucucugcucacugcaagcuccgcuucccugguucaugccauucuccugccucagccucccaaguagcugggacuacaggcgccugccaccacgcccggcuaauuuuuuguauuuuuaguagagacgggguuucacuguuucagccaggauggucucgaucuccugaacucgugauccgcccgccucggccucccaaagugcugggauuacaggcaugagccaucacgccuggccgauuacaccuaaaauauuuuugagggaaccaggaaauaaauucaagucaggaaagaccauguaacucuuauuuuaaaauaauaaggugaacagguuaaauacauuaggauucagugaauuauuaaccagucauuaaaaauaagaauaucuaaauguguuauaaaaaauaagauacuaucaaaacaagguacagaacaauauauacagugugaccccuuuuguguuauaaaaagauaucuccuagcauguaaauacuacaaaagcauauagaaaaugaaggauaagaaaaucaggucacuuauuaacgaaagagaauuauacuuaaaaugugaaaaaguauucauuauuuaugccugucuuuuggcucuuuccuaguucagguuauuguaaugucauaugcaaugagaaagcuuaggaaaaccccuagaagaucauaacacaggacagaugggcaccaagcaacucaguagaagaugcaaaggguuagagacacccccacccucccagcagcauuagggguauggaaaucaguccuugaagguggagguugcugaguuucugauuucugaaagucuggaaccuaggggaguuaauugauacagcuaguaaagggcagugugaagccaggugcagugguucacaccuguaauuccagugcuuugagaggccgagucaguaggcucgcuuguggccaggagaucuuguggccaagaucagccugggcaacauagugagaccccaucucuacaaaaauaaaguguaaaaauuauccuguugugguggcgugcugcuugggaggcugagguggaagauggcuugagcugaggguuuaagguuagggugaccugugauugugauuguaccacugcacuccagccugggcgacagagcaaaacccugucucaaaaaagacgaaaagagcagugugacuguuuugauaaccauaaacaauaauuugggaaacaugauaugcagagacaguaguaguggacagaagcccuggagugacccuguucuuagaacaggaauaucuacauuuccuuguggguguuaauggccuggcugaagugucuguguguuagaaacaguuaaaacaagagacagcuggagggacuugcugggggaaagcuggggccagugacugcccagggugcuucuggggaaaauacagcuaugguauuuugcauguuaccauaauugcuuucugagaauauguguuugccuuuuugcaagguuggcuuauuuggacgucuaggcaguuuuccaguuagagggacaccgauggccacucgacuguugcucugugagcaugccgaaaagcugucagccgccauuguucucaagaaccaccacucccggcuuucugaccuugucaacacagccauauugauugcuuugaacaagagggaguaugaaaucccauccaaccugacuccugcagaugucuuuuucagggagguaagaugaguccucuuucauguggcuuuguagaacugugccauuuagugaucaugcccuaggcaggaaagacggugaggacgaguuaaaucacaaaagaucucacugaaauuuuaaauuggacuccagauuuucuggcuagagugucacucagaagucucauugaucaguuaccuguaaagaagaguuugcaaaguugacuaagaagugcucccuguuuacuuuuuucccccaauaacugucuccaaguaccuauuugcuuugcaugcugaucuucuuuuuuuuuuuuuuugagauggagucucacucuguugcccggguuccagugauucuccuaccucagccucccgaguagcugggauuacaggugcuagccaccaccccggcuaauuuucauauuuuuaguagagaugggguuugaugucgaacuccugaccucaggugauccacucgccucagccucccaaagugcugggauuacaggcgugagcuacugcauccauccugaucuucuccuuugucucucucgaucuacucuuuuuucugggggcagggggcacuaagucuugcucuguugccaggcuggagugcaacagugcaaugucggcucacugcaaccucugccuccuggcuucaagcaauucuccugccucagccucccaaguagcugggacuacaggcaugugccaccaugcccagcuaauuuuuguauuuuuaguagagaccugguuucacccuuguuggccaggcagaucuacucuugacucugccacagcaagguggccuuccugaaugggcucccuugcccuccggcuucugccaggucagaugaaugugaggcccugccauaaggccagaaguuggaguaguuauucugccagcuuucuuccuugccugugcgcacuuuacauuggcugugccccucugucagggacugugccuccuguccaacugcuuucucuguguuuccaguagcugcccccuccuugugccucuucaggccugagguugauaaugccucauccuagggugcugccccaucccuuuuuggaccccuuaaucuugcccacaccuuugcaaacaguaccuucacugaacuccucagcuaccuccuaggauccuguugcuacaccuugcuuguagaaucagauuuauuuucagagaaaaaguaaagucugcuacaaacuucaaagacagaaaugguuaagaugcugggcagccaguggcagcuggacauuguggaaauagugacgcaguccucgugcuuuugugaagcuucacagccugaugaggcagcaaggcagacuucgcugucucccuuuaaaggugugacauuagaacuuagaccuguugucuuaacugagacugcagaacuaucugguuuuagaaacagggccagcucuucccugagcucugugaaauuuggaauuccuuaugcauuugaggaacuucaaacucuauuuggugucucaaauuuugcuuccuuccuccuauagccuagcuguauucuaacauguagcacacugugccgacaagucucuuuuucuuaauguuugauguacuguaaccuaaguuugauguacuauaaccuaaauucagucuuccuguugauuccauaaauguguuuagugugaauucuuugcuuuuaugcauuuggguuaguuccuggggaauggaaggaaaagcacuuuguuauguuuuguuuuuaaucuagacaguaugccagaaaucugaaagaaaaacaaaucaccucaaguuucaugaucuaacaaaucaaguuguugucauuuuuguguccuuuuuggucuuuauucauauauaauuuuauaugauaagacaauuuuuuaaaauuaauuacagacuacuuguaagaacugagcaagagccugguucauuauucugcauuuggaucaaagggcaaaguauaagugucaauuuaguguauguacauguuucaguuagcugaauuauuggagaagggucuggaaauuaucaguuggauacauauagaauaauauuuuaggaauaugauacagcaaaacuaaaaaugugauuggcuccucaaaagaauguuccauaugaaaaaugguaauguuuaggacuguuccugucacuauuuaucuucauuucucaugauguucguuggucuuuagcuucucugggguguaguuauaaagguuuucucccgugucauaaugaucaugaaaagagaauacaauagcuauaugcauauaguaguuuuucuuucuuuuuaccuguccuuccacuugggggugacaaguuaccugucuaaggaguauuuguguuuugggacgagcugguuaaccaaaaucaaucucugauuggugggccauauagaacgauauuuugacuuggcagcccugauagaaaguaaaacaauacagagcugccugagggugcgcucuccacuuugacucugucuccaguuugggaaggccuuguaccucccagggcucuggaaaagcagagcucacugcuuaaggaacagacuauguugacacggcauaugagcaauauuugaaaucacugaauauauacaugauaagagaauuuaacaaguguuuuggcauuuuaugugcuuuuauguuauuuucugucuuuuauauuauauaugcuuuccuuuuuuuuuuuuuuugagacugagucuugcucugucgccaggcuggagugcagugacacaaucucugcucaccgcagccucggccuccuugguucaagcaauucuccugccucagccucccaaguagccgggacuccaggugcacgccacgacgcccagcuaauuuuuguauuuuuaguggagacaggguuucaccauguuuuccaggauggucuugaucucuugaccuugugauccacccaccuccaaagugcugggauugcaggcaugagccaccgcacccggccauuauauaggcuuucauuguguuuuucauguuaacaauguaaaauauucuuacacuuaagcuuauaaauuaaaugugcuaaagauuucuugccugggcuguuaggaugccuuuggcuaacaucagaaaugcaaaaggaagaacaagguuugcaaaagggagggauuuuguuugggucauguuuuaucugugccuauauaacuuguuccuucagccaguuugugagguccuugagggcagcuaaucugauuuuucuuuccucuuaucucugaguguccauugcuaugcaaacucuaaauaauggggggaaagcuuaagugcagacuugaacuugaaacaggaguuucagugccugaugguauuuuugcacuguuaucuccauguauuaauuaaugacaaaggaagaguuagaaguuauguauuuaguucauucucuuauguugcuuacuucuguucuacaaauguuucuguuaugucugaagaaggggaauuccucaaagaaagaaauuagcaaguucacuuuuugaggucauuauuuuagucuauuaguucauuaguuugggguauuacauuguaaagugaugucaucuguaaccuagugcuauuuaaagaugcacugagcagaguagcuauaauaaaaaauaucaucgcuuaaaaaucucaguaacaauccagaauuugccuguuuauaagacuuauuugggcacucugacuuuuaaaaguuaggagaugugacuuuucuugauuuuugaauuuauuuuuaccaucaacugccaauaaauuuuccuccaucuauaggucugaggauauggcuuaaugaguaaaacucacuggguaguuguuacccaucaccauaauuuuuguuguaaguaguuuacuucuguguauucucucagguaucccaaguagauaccaucugugagugcuuacuggagcaugaggagcaagucuugagggaugcaccuauggauuccauugaaugggcugaaguggugaucaaugugaacaauauucucaagguacaaaaauauaguaaaggcuucagcaaaucaaagcccagggcauggauagacaaggaacugguuuccauguuccuacucuguauugccgauaauguauaagguuguagacauuuguuaaucccaaaaaaguuagaaaaaugucauuuuauuauuaaucagcuaaugaguauuuugaauguuagccuggugccuauuaauaaauuucuauaaucuugaguuucuauuugguagaauaauaaaccuuucauuugggaagauguguuuguaucuuugcaauuuuuuaguugguuuuuuuucugagagaaggucucacugucacccaagcuggagugcaguggcaccaucauagcucacuguaaccuugaacucugggcucacgacuuccuccugccucaaccuccaagaguguugggauuacagaacugagacaccaugccugauugcaaacguauuguuaauguaacugucuaaauauuucucauuucuauuuuuuuaauuacucaaaaccuugcuacuuuuacuauugacuaaaacguuccauuuaauuuuagcuaguggacuuguaguaaugauuuuccuacuuugccaaauaauuuuccuacuauuauuugccaaaacugaaguuaaauuauggaguaaaacaaauuucaaaagcagaaagaaccaaaaaguaaucaugcagaucugugcugacuuuuuucucucauuuucuuuucuuuucuuuuuuuuuuuuuuuuugugagacauggucucacuccauugcccaggcuggguuuauaguggcuugauuauagcucacugcagccuccaccuccugggcucaagcaguccuccugccucagucucccaaguagcugggacgguaggugcacgccacgaugcccagguaauuuuaaaaauuuuuuguacagauggggucucacuauguugucaggcuaggagcaauccuccuaccucagccucccaaagcacugggauuacaggugugagccaacauuccuggccccugaguauuuuuucuuacuaauuuacuuugcugucuuaaauuaucuucagaaauacugugauccaucaccuuuugcaugugauaacacauuaacuuuuuuuccaggauaugcugcaggcugcuagucauuaucgccaaaauagaaacucuuuguauagaagagaagaaucacuagaaaaagaaccugaauauguuccauggacggguaauauacugauuuauuaacaguuguucaaaauauauuucuaaugacccaucauuuuuagaaguuguguuauuccccuagcguagguuuguaagugaaaugaaaaagugccgucuccaaaaugagcagcucuugucaaaaucacuuuauucgucccuugcucuuauuuaucgaucucucuauaauuuauguauucaacugguacuuaugcauuuacuagguuuuaguucaaauaguuauucauagaagcaguccuggccccggagguauggacuauauuuuauguugauuuaauacaagaaaguaaguggaguagcauuaaaggaauuuagaaggaagaagagucauguuuaccuggcuuugcugaggaaaucuccuuggagaagaugggauucaagcagggcauugacagguaucaccugaaucccuguucaauguaauuuuccagcagugaugaagaggcauaauuuuuaugcuauuagucuuuccuuuagccaucacuagaucccuuacuuuaaccauauuauuuuguguaauuucacagcaacaagugguccugguggcauccgaacgguaauaauacgccagcaugagauuguccugaagguggcuuauccacaggcagacagcaaccuccgaaacaucgugaccgagcagcugguagcccugaucgauugcuuccuggaugguuauguuucucagcuuaagucuguggauaaauccaguaaucgggaaagauaugacaaucuggagauggaauaccuacagaaaagaucagaucucuuaucuccucuucguaaguucaugauacuuggcaagaguuuuaaauuugcugaauggaugaaaggguugaauaguuaauucaguauauucagugugguaguguuaauccaacuguaauaaagaacuuaaagcaaauaugcacagcuuucugugcucauuuauucaacuuuuuuuccaguacuaucuagguauaaguaccauagaugauacugaagacaauuaauaaauacauaaacaaacaacauguggagacuacccuuaaagagcuuagcaucacagaccuuuacgugaauaacuggauugcaaaguagagccuggugagggcugcuugagggguacagauaagauauuauggcuguuuggcaaaggacacauuauacuccaggcuaggacugggaagaguuugcuuuacucuuacaugaaggaagagaauagcguuuuggggaggcagugaugaaacaagggucugaauuugcaucuuuuuuuuuuguugagacagagcgucacucucucgcccaggcuguagugcagugguauaaucucagcucacugcaaccuccaucucccggguucaaacaauucuccugccucagccucccagguagcugggauuacaggcgugugccaccacaacuggcuaauuuuguauuuuugguagggaugggguuucaccauauuggccuggcgggacucgaacuccugaccucaggugauccacccgccucagccucccaaagugcugggauuacaggugugagccaccgcaccuggccugaauuugcaucuuuaagaaauugaugugaauugugaaacuaagugccaguaagugggaagguuuccauuccauuaaugauuguugguuuauaauaggaauaaagauaaaauuucaaguaacauuuuuuauuacagauuuuaaguuuugcuaacaggauuuuuucccaucuuuucucauucccacaguuucacuaggccaguaccugugggcugcuucucuagcagagaaauacugugacuuugauauauugguacaaaugugugagcagacugacaaccagagccgacuccagcgcuacaugacccaguuugcugaucaggugaugaguguuggguguguggccacugaguccuuuaguugccuuuucuugaaauggcuuugccauuucaaaucuguaaucagggcuuuuggaauaugauacgaucuuuuuguaguuaacuuugaugagaagauacuaauuuguaugucgcguuucuuuguaaauuuuguccaguagcgagaucacaguucacgacagccucaaccuccuggguccaaucacuucucccaccucacccccucccacaccuccugcuuuccaguagaugggaccacaggagcucgccaccaugccuggcuaauuuuguucauuuuucaguagagacaaagucucgcuauguuguccaggcuggucucaaacuccugggcucaagcgauccuccugcuucagccucccaaagugcugggauaacaggcaugagccaucgccugaccacacaauucuuuauauauaaauauuacugaaagauucuuugaccuuuggaaaauauaacuuucauuucuguuuauauauuuucuaguuauuauaaaaguacuuagguacaugaauauugguaaaguucuuaaaaauuguauagaagauacucgggagcauagaagacuacuuuaagagagcuuagcuuuacaaauacaccuaacauucucauuuuccuugagggauauuaugcuuccuguuuaaaaaacaaaguucccagccagccucaguggcucaugcuguaaucccagcacuuugagaggccaaggcgguaggaucacuugaggccaggaguuugaggccagccugggcaacauagacccugccuuuacaaaaaaaauuuuuuuaaaaaacaugccaccacacgcccauggccacacuuauucaggaggcuaagguggcaggaucguuugagcccaggaggucaaggccagugagccaagauugugccacuacaccacagcuaggugacagaggaagaccuaucuuuaaaaaaaaaaaaaauuuccauugugacacuaucuuaagugaauucaaaguuguugcuugaagccagucuauucagucaguugauuacuaugaaaagcuuauuuuuuauuacuguaaaagugauauuguauaaaauuuagaaaaccacuauaaacacaaaagauaaaaaucacucaaaaugccaccacccagagagaaccuuuuaagcauuugguuuauauuuucagucuuuccacucuauguauuauaaacaaacauguuuugucaacugcuuuuuucacuugauacauugcaaacauuuguucaugucauuaaauauucuacagcagcauuuuuaauggcauuauaguauuucauugacuggguaugacuuacuucaucaaagaucaguuguugggcugggcaagguggcucacgccuguaaucccagcacuuugggaggccgaggugggcagaucaccugaggucaggaguucgagaccagccuggccaacauggcaaaaccccgucucuucuaaaaauacaaaaauuagccagucaugguggcgugugccuguaauuccaucuguucuggagguugaggcaggagaaucccuugaacccaaaaggaggagguugcagugagccaagaucgugccacugcacuccaggcugggcaacagaacaagaauccgucucaaaaaaaaaaaaaaggucaguaguuggacauggcuuauuuaguauaucaaaacauugcuaaauaaauauuuuuugcacugaucaugauuuuaaaauuauuuuuauggauuuucuuucucuuuucaugcauuuuugcauuuuuucuuauauuuaacauguuuaaauguuauuuuaaaguccuuuugugcuuacucugaucaucuuugagucuguuuauguugccugcuuuuauguugcuugaaucauaguuuucugcuuccuauaucugguaauuuuuaaauuguauuuuagacauuguauauuuuuaaaacuccauaguauggaaauugauguuauuuguccccucguggauuuuccuuuuucucuguuaggcaauuuagaggagaggaagaugacucaguucauuaggaauagagguggcccaggacucggucucagcucuuguaauauucauuucauuucuggugucagaagucuuucauggcaggaucccugcuuuagggaaaguaucucuuaaacacugugagacuguagaacgucuuggucuuccucuccagcucagccuccacaccaccccaacacuccacaaacagccaguggggaaaacuggcugggcauuugggccucucuagauuuugauguaucaugccaggccauguggccagcuggcgcagaauucuggaauguuacagucucggugcugucccacagagcuuucugugauaauggagcuguugauaaugcgcuguccaaaugggagccacuggccacauggggcuacugagcacuugaaauguggcuaauguaccuaaggaacugaauuuuaaauuucaagcuaauuuuuuauuuaaguuaaacagcuacguauggccaguugcuaccauauuggccagcgcacaucuagauucugccauuaaucuugucagugaucuugagcaagaugcccuuucugaaucacaauguacacaucugucaaaugagaugauugaauuaagugauccuacaauauaggaaauuauuguuuagaacagguuuucuguuuuggaggccuuuagaacaaaguuauguuuuguuaucagaaauguguuuuuuuaaacuauuaugaaugaauucuauguucuguuauuuguagaauuuuucagacuuucucuuccguugguaucuggagaaaggaaagcgaggcaaauuauuaucucagcccauuucucagcauggacaguuggcaaauuuuuugcaagcucaugaacaucucagcugguuacaugaaauuaauagccaagaauuagaaaagguaagaaggauuuuucuauggagcagaugugugcaauuuauuuagguaguuuuaauuaguuuuguuuuuaguaauuaaaauacuguuuacugucauauaccugagaagggguuacuauccaaaauauauaagggagcugggcaugguggcuuauaccuguaaucccaguacuuugggaggcugaggcagguggaucucuugagugcaggaguucaagaccagccuaggaaacauaaauaacaaaaacauuagccagguguggugacacacaccuguagucccagcuacuugagaggcugaggcaggaggaucacuugagcucuggagguugaggcugcagugagcugagauugcaccauugcacuccagccuaggcaacagagugaggccuugucucaaaauaagugaaugaaugaauggcaaaagaccugaauagacauuucucaaaaaaagacaugcagaugaccaauagaugugugaaaaaaauguucugcaucacucaucauuagggaaaugcaaauuuauaucacaaugagacaucaccguacauuuguucgaauggcuguuaccaaaaaggugaagguaacaagugcuggagaagacauggagaaaagggaacccugaugcacucuugguggggauguaaguuaguacaaccauuaugggaaacuguauggagguuccugaaaaaguuaaaaauagaaauaccauaugaucuggcaaucccgcuugugaguauauauccagaggaguugaagucaguauguugaaaagguaccugcacucccauguucauugcagcauuuucacaguagccaaguuauggaauccaccuaaguguccaucaaucaguguaaaugauaaagaagauguuguauauagaauacacaaugcaguaauagccuuaagaaagaaggaaauucucucauuugcaacagcauugaugaagcuggagaacauuacacuaaaccaaauaagccagacacagacaaauaacucauauguggaauccaaaacaauugaacucauggaagcagaagaaugguggcugucagaagggugaggggauguuauacgcacacacacacagguacacacauacacauauacauauauacauacauauaaggaacucagcucaauugcaagaagacaaauaacccaauuuaaaaggggagaugggccggagaaguuggucaaaggguacaaguuucaguuagaaggaagaagauuauuuuuauuuuuguuuuuuuagagacagggucucacuguguugcccaggcuggucuugaauuccugggcucaagcaauccacccacaucagccucccaacguucugggauuacgggcaugagccacugcacccagccaggaacauuuuuuauauacauugcacaauaugauggcuaaaguuaauaauaguguauuguacauuuuagaauuuccaagagaacaaauuugaaauguucucaccacagugauagguauuugaggugaugggcauguuaauuagcuugauuuaaucauuccacaucacauacauauauuauuacuguguauccauaaauauauacaauuauaauucauuaguauacaauaauuuuuuuaaauuuaaaagcauuucuuauggauuauuuagaauguguacuccuauuuucccacauaauuugcauaaaacauucuuaauuugugaugguauugccauucuaauaucucaauaaaaauauguaguccaggcugggugccuguggcucaugccuguaaucccagcuacucaggagccugaggcaggagaaucacuugaacccgggaggcgaagguugagugagcugagacuauaucauugcacuccagccugggugacaaagugaggcucucucaaaaaaaaaaaaaaaaaaauguaguccaucaugauuugacaucacauuaaaaucacaaaaauuuuaaugaugugucuguaacagucauuggccuuuuugcaaugaguauauuguuguaauauucaaauuaugaguaaaaacauacaaauuaauuuuaaaauuuguucuugacaggauguucaggugaauauguaaguuuuagagcaaauguuuugugcaugucucuuuucccaauauuuagugaggaugguugauauuuugcuguguaauuacucucaauguuacguacugcucaguuuuuagguuugcuaacuguugacuucucauucauugauacggcuuaggggagaaaaacaaguuugggguuuacuuaccuuuguuucagcuugaauugguacucaguaucuuacgaugguuugcauauuuuauuguaggcucaugcaacacuucuggguuuggcaaauauggaaacucguuacuuugcaaagaagaaaacccuucuuggcuugaguaaauuggcugcauuagcuucagacuuuucagaggauaugcuacaagaaaaaauugaaggugaaagaauuugagcaaaaggauuuacaaauuggucaugccaucaauuaacucaugauguguuccugucaucaguuagcaggaucuaucucuuagaaacaggaccugucucuaagaggaaugcauuuaguuaauguccauguguaguuacucaauuauauacuuggaauuuuuuuagagaaaaguaguuuguauuuuaaauaagaauuccuaaagaauagacucaaaugauuuugauuggagaggucugauuauguaccuuuagugauaaauauuccaagggcaaaaagaacuacaaagcaaucuugaccuuuacacaguggguuuguuguagguagugugguauaggugcaauaauucugaacuauuuuguguauauuguagaugaaaacgauuacauauaguacaguuggcccuucauauucuuggauuccacaucugcagauucgaccaaacaucaaaaauauuuggggaaaaaagaauuaaaaauauucaacaacaauuaaaauuacaacaagagaauuaacaaaaaaauuaaaacaacaaaaauaaugcaaaauuaaaacaaaauaaugcaaauuuuaaaaaaccaauacaguauaacagcuauuuacuuagcauuuacguuguaugagguauuauaaucuagaggugauuuaagguauaugggaggauguauguggguuaugugcaaguaacuaccguuuuuauauaagggaguugagcuuuuugguauuccuauggguccuagaaccaguugucagcagauacugaggcaugaugcuauuauuuuuuagaaccaaggagagaggaguacaaauauagaaagacagugaagaaaaacucuguauuauugaauuugaauuggaaauaccagauagaaucugauuuuuaaaaacaauauauuuucuugcuugaggugauggguaugcuaauuacccugugaucauuacacaacauauacauguauugaagcaucacauuguaccccauaaauauguauaauuauuaugcgucaauuaaaaaaauacaucagcuggguuugguggcucacgccuguaaucccagcacuuugggaggcugacgugggaggauugcuugagcccaggagauugugccagccuaggcaacuuaguaacaaccugucucuacaaaaaauuuaaaacuuagccaggugugguggugugcgccuguagucccagcuacuggggaggcugaggugagaggaucacuugagcccaggagguugagguggcagugagaugugauugugccacugcccuccagcuggggcaacagagcaaaacucugccucagaaaaaaaaaaaaaaagucucucucuauauauauguagauagauagauauacauaauaaaauguguguguguauauauaaaauuguguguauauauauauacacaauacacauauauauacauuuuaucuauacacacacacacauacguauuucuugucucugcagugacaccccaguagcaugaguauaccuaguuccauauguugguuucugacuaccguuuuccaguaaaagaagugagggcuuauugaagaaaucuuggagagucuuauugggccagaaagcaagguuaauguagagauacuaaaauaauacaagagccuugaacagcucccacuguucaaguuuggggacuauuugaacaucaaaagauugguaguaaaggguauauuccacaguuuauaagacaaaaaaauucaugagucuacagugauuuucaaaaagggagagggucagugaaaugcuucuuuacaggagaaugccaacuaauaaaugugaaaacaauggcagaagucacuauuacaaccacggugaauaacuggucaccagaggaugcugagaccauugaguuuaggggcuaggggaacaggauauucccgugguuuuggaguaucaguagacaaaucuaauagacccugucaucaaccacaaaacaaaccacauuguguaccacuccugaagcaauguacuaccaucacguguguccuguucuugccaaaauguucacccuuauucuaauuacaagagaacaaucagacauaaccugcuggugggacauuguauaauacaguugcccuagacucuucaaaaacuuuaccaacaugaaagacaaaagacaggcuguuuuagaugaaaggaaccuaagagccaugacacagaagcaaaugcagagcgagauucuugauccugaaucacccucaaaauaaccguaacaguuauggugaauguuuuggaaacaagugggagaaaguuugaacauacuuaguauuagaugauauaacuguauugauguuaaauuauauaagccugauaaucguauugugguugaauguccuuguuuuuaggagauacaugcugaguauuuagaaaugaaaugucaugaugucugcaaccuucauaugcugaaaaaaaauuaccuauauacauagagaaagcaaaagggacagaguguuagcaacagaugacucuagcuggaggauauaacgugcacauuggcauuuuaaaauuuuuucuguagauuuggacuuuuucuguuuuuuauuuuuauuuauuuauuuucucugagacagggucucacucuguugcccaggcuggagcacaguggcacaaucauggcucacugcagccucggacuccuagacucaggugaugcucuugcuucagccuccccaguagcugggacuacaggugcaugcucccaugcccggcuaauuuuuguauuuuuuuguagagaugggguuucaccauguguacccaggcuggucucaaaacuucugggcucaagcagugugcccaccucggccuccaaagugcugggauuauagacaugagccaccacacccagccuggaauuuuucaaaauaaaaauuggagcggggaaucucagcuaugugguuuggaucaaguauaugcagauauggauaucugguuauguggcuuauccacagaguccagccuaagaucuggguuuaaauuauacugcugucauuuuuuuccuuuugagggaguggauauaguagaaagaauugggauuucaauauuuucuccagaacuuacuagcuuugugaccuuggauaguuaauuuaugcuccuucgccucaguuuguucaucuauaacaaggguaguuguaaggauugaggacacugucuugggaaaaauggcuugcauauauuaaguacucaauaaauuauagguauuagccccuuuuauuaaaauuauuuuuuacuguuugggauaaucuuccuucaaucuuuuuauuuuuugcacuaguagcgccuguucuaaaaaaaguguguuuauauucuauaggacuggcugauagucuaagaggggaagccauauuuuagccuggccaccagagguagaucauguuaaucaaagcauuuuaaccaaggcuuuccuguuucuucuuucucccugcuuugcauuugaucacuucuuagcuuuuauuucuuaacgcgaugggaacauuugcaggucucagugauucuacagacuguuagcacaaugugucuaaucggaggggauagacuuuuuaaaaauaacucuucugguaguuaaauaauuccucauggaaaauguguaaauuauagaaaaaauucaauaggaaaaauaaguugucuguaguccuaccuccccggagauagccacugguacuguuuuguggguuuccucccagucugauuuucuagguacagaaauggacaaaaguguuccauuuaauuuuuccaaaaccaggaucacggggaaugcugccaguauuugagcgaaaguaucuguguuuuggucacuguuuugcugugaaugcuguguuuaugaggcugccuagcaguuuucacccuuuccugcaacucagcacauucccuggggcggagucaggucaugggcugcaaccuggagaguuuauggcaaacagaagccccuguuaccucauccaauggagauaacccuugcugccuaggagaugugcuguauauucuuccaggucuuguuuuucuugauagacucaugguagcuuuuacaucauuuccauuugcgaaugaaacucaguugacccuugaacaacaugagcuugaacugcauggguccacuuacaugcagauuauuuucaaucaauauauuucggagauuuucaacaacaugaaaacacucauagauauacaccauguauaacuguguagccuagauauaccaaaaaaaaauuaagaaaaagacagguuaugaauacauaaaacauauguagucuauuuuaucauuuacuaccauagaacauacacaggucuguuauaaaaaguuaaaauuuaucaacacacaaacacagaccucacauagcaccauucacaguggaggcaaauguaaacaauguaaauaggcagcauuaaaucacagaauuaacuaauacauacuguacuuacuguaauaauuucauagccaccuccuauugcuauugugggcaaguguccgcuugcugaaguguuaacaguauucaauuaaaaccccaauuaaagugaugauccaguuaaaaugauucugaucaucucuguuugagaaguuugucuacaccccaguaaauugccuauugcagcaaaaaguaaauuuccuauugcaguaagaagugauuucucauaguucucgaguauuuuuuccuguguuuaaugcaauaccauaaaccuuaaauaacaccuugagacucauaugaagugccacuaggugaugcuagacaugcucccaagaagccuaggaaagucgugacauuacaagaaguggaauugcuugauaugcaccacagacugaggucugcaguuuuggcuauccccauuucaauauaaauuagucuagcuuaaugaccauuauuuuuuaaaaaauggaaauuugugaagcuggcagcagcaguuaagcuuuuggggagucgaaaguuacccucccaacacuuugggaggcuagaacaggaggaucacucaagcccaagaguuugagaccagccugggcagcauagcaagaccccaucucuuuaaaaaguuaugcugggauuuuugacagcacgggagcuuaguggcccaucccccuuguuauucaagggccaacuauauacuauaaauucuagugggaaaaauuuuacugaauuauaaaauaugauggagagaucuccacacuuaggaagcuuauaccucaugaaauagcuaucugcucuccaacuucuucaagcauugaacguauuuccuuacuuguucucuucccuccuauuucucguugcugugauaauucuuaggacuuugaucaaaccauggauauguuguaaacauaaccggcaaucaagaauaagaauuaaaagcauucugagaucauugaauaaagauagguuuaccucuggagcuauuuuuuucuuuuaaaauucagauuuguuuuaugacagcaaaaaugagagcaaaagucaaauuucaucauauucucuuucccucccucucaucuugaauacuagaaauggcugagcaggagcgcuuucuacugcaucaggagacccuaccugaacagcugcuggcggagaaacagcuaaaucucagugcgaugccaguauugacugcaccacaacucauugguguaugugcuuuucaaauccuuaacgcuauuucuuaaacucaaaaccuuuuugguguuuguugggccauguaguauaguuccuaagaggaguuauuguucuacugccuaccuuccagaaaacuccccuagaaaaacguuguuugaagcuguuugggaacagaaagcuaauuagagaaaaauuaaucagcaucugccuccccauacaccuccaccuaaaggugcuuuaucuaggugaccaggagaaauuacuuauauuuugcuuuucuaguauaggacaaauaaguaccaugagauaacuuuauuucccccacaaaauuacuuuucaagcucuucuauaagaaaaaauggauuaaggaacucaguuuacauggucuagcaguucuguccuuaccccuuuccucugcaacccaacacauccccgagggcagagccagaauacggacugcagucuagagaagaagcaucucuuugccagagugauguaggaucaccuuaaauguguucuaucuauaugaaaaggcaaacaauuaaaauacauuagcauuuuagccauuauuaguaacagauuuccuguuauaacugaauuuacaacagccucuccugauagaauauauauuuaauuuggaaauggaaguuacucucuauuguaacucacuauugaguaucacuaagaaaaaaguagugccgauuuuacucuaaugcauuauuaauuuuaauaccacaguccaauuucagagaugguggaguaaaaaggauguucaagaacaacaaaauaaaacuauuaucuuuugagugcuguaagacaaugaacacaagcagauagcuuuuuuucugaaauggucugaguauuguugcuauuaaaggauuacacauacaauuuuuaaaaaaugaaauuauaguuuuugggaaaggaagaugggaaaaauucaaauugauauuuuuaauaaggcaaguauuuuucugaccauaaaaauuacaggaaauuugaagaauacagaaaugaguaugcagucagcuguaaucuaaccagggauaaguguugguaacauguugauguguuuuuuuauuaagugaauauagaucaacuguacacuuuauuguaggucucaauuuuuuuuuagagacaagaucuugguauugcucgggcugucaggcuggagugcaguggcccugucacagcucacugcagccuugaccucccaagcucaggugacccuccuaccucagccucuggaguagcugggaccacaggugugcaccacuguacccagcuaauuuuuauacuuuuuguagagacgagguuucuccauguugcccaggcuggucucgaacuccuguucucaaggaaucugccugccucggccucccaaagagcugggauuauagacaugagccacugugccgugccuaaaauaugcauuuuuuaaaaagacaguuuauuuuaagguggaugcaauacaguuuccaaauaugagacuguuuuuacuauaaaaauacaacuggccaggugcaguggcucacgccuaaaaucccagcucuuuggauggccaaggcaggcggaucacuugaagucaggaguuugagaccagccuggccaacagggugaaaucuucucuacuaaaaauacaaaaauuagccagguguggugauggauuccuguaaucccagcuacucaggaggcugaggcaggagaaucacuugaaccugggaggcagaaguuucagugagcugagaucgugccacugcaauccagccugggugacagagcaagacuuugucucaaaaaaaacaaacaaacaaacaaacaaaaaacaaacuacaacuuccuuacaagacauaaugacuucuuuucuccauaaaugucucuaguauuaguuacaugauuguauaaucuucuaccuuauuuuaacuugucauagcuauauaucugugaagaaaauagaagagcuaaugaauaugauuucaagaaagcuuuggacuuguuggaauauauugaugagguaaguaaaauugcuugagaugaucucaggcaacugaauacauauauaaaaagagggagaucccucuuuuagucaaucaugaaaaugaauuaagcaaaaaagacuguaucugugguucaacuaccuuuaauccuuagaauguaaacaacucuucagaaaagcugucaaggucaagagacucccuuuugugauaauucucacacauuccuggguaucuuuuuuugugcacagauaaauacugcuuuucaaaguccugaaauauuuuuuugucuuucauuuauuaagucauuaguuucugaagguaauauacgacuuuaucaguuuauucuggcugggugcaguggcucacgccuguaaucccagcacuuugggaggccgaggcagacagaucaccugagguugggaguuugaggccagccuggcaaacauggugaaacuccaccucuacuaaaaauacaaaaaaauacaaaaaaaaaaaaauuagauggguaugguggcgcacgccuguaaucccagcuacuugggaggcugaggcaugagucucuugaauccaggaggcagagguugcagugagccaagaucaugccacugaacucaagccugggcgacagagugagacugucucaaaaaaaaaaaaaaaaaaaaaaaaaauauauauauauauauauauauaaaaucuucauaguauucauccuaagaguagcuguuucuuguguuucaacagguuauagugaaaauucuguaggauaaguaguucuauuaccugucgaugcaauugaaaguaauuugguagauuuuagaaacauaauauguugacuuuuacauuaccuuauuuuaaaaucuuaccccucucaggccgggcgagguggcuuacaccuguaauccuagcacuuugggagaccaaggugggcggauugccugaggucagaaguucgagaccagucuggccaacaugcugaaacccugucucuacuaaaaauacaaaaaaaauuagcugggcgugguggugugugccuauaaucccagcuacuugggaggcugagguaggggaauugcuugaacuagggaggcagagguugccaugagcugagaucgcgccacugcacuccagcuugggcgacagagcgagacuccgucucaaaaaaaaaaaaaaagaaaaacucuuaccccucucaagguugcugauaaaaucaucaucaccacagaguaaccugaaaguaauucauagauauuaauuggcuucuauguauguaguauuaacauaaugaaaauuuaggcauguauuucuuucagagccaggauuuaaucaggauuuuuuuuguuuugcugugaaggaagaagauauaaauauaaaugaucuaaaacuggaaauccuuugcaaagcucuucagagagauaaguaagugcucguggcauugcuucuuuggaaaguauagaaacugcuuuuccucugcucucaccacaugacagucaauaacagaagacuucugugaccagacguguugggauuucccaccuccuacacugggcaaccagugaguucuguuggugggcaccagcugaauguccuuuaauuuaguucaguccugauacaaucuacaaccacagguugagggcucagacugccccugacuuugaugccaauuuaagcaccaggggguuuugccuguguuccucaccgaccagcuauaaauugggguucccacaacccccuccuuggguuugauuaauuugcuagagcagcucauagaacucaggaaaacacaccuaccaauuuauuauaaaggguguuguuaccagagagcggucccgaugaccccaggagaggcuucuuggaucucgugcaagaaacaauuuggggcaaguccacagaguaaagugaaagcaaauuuauuagagaagaaaauaaaagaauggcuacuucuuacacagagcagcggcgugggcugcuugacuugaguauacuuaugguuauuuguugauuaugugcuaaacaaggggugcauuauucaugaguuuuucuggaaaggcaugagacguucccagaacugaggguuccuccccuuuuuauuuuuauuuuuuuauuuuuuuauuuugagacagaguuuagcucuuguugcccagccuggagugcaguggugcgaucuugacucacugcaaccucugccucccggguucaagcaauucuccugccucagccucccaaguaaaugggauuacaggcauguaccaccagcccuggcuaauuuuguauuuuuaguagagauaggguuucaccauguuugucaggcugcuguggaacgccagaccucaggugaucugcccaccucagccucccaaaaugcugggauuacaggcgugagccaccacgcccggcuccucccguuuuuagacuauauaagguaacuucccaacguugguugccacagucuuuguaaacuauuguggugcuggugggagugucuuuuagcaugcuaaugcuuuguaauuaguguauaaugagcagcgaggacgacuagagaccacucucuugguuuuggcggguuuuggcggguuuuggcuggcuucuuuaccacauccugucuuaucaguggggucacugugaccugugucuugugauaccaguccugcugaccuccugucucauccugugacuaagaauuccuaaccuccugggaaugcugauucuaacgcaucugaaaguaucacauagaauacagaugaggagaucauggggugagguauaggggaaggggcuuggaacuuccaaagccucucuggcccuccaccuuccaggaaccuccacgugucagcuaucaggaagcucuucaaacccugucguuuuguguuuuuauggaagcuucguuauguagacaugauugauuaaaguuggugaccaauuuaaccuucagccccucuucccucccuggauauugaggaacagggcugaaaagucccaacucuaauuaugcuuuuucuggugaccagccccuauccugaagcuagcugggggcugccagcugucagccaacucaauaguauuaaaaaaaaaaaaagacaucuauggagauccuaaggauuuuaggaguugcaaagcaggaaguggggugaagaagaagaccaaauacauauuucacaguauuacaggaagauuaugauauuauaugucaaaugguuuuauaaccuucuaaccauauuguaacauacauauuaugaaaauuuuaaugguuacauuaguaauauuuauuuagucuuggucuucucuauuuuaauaguuaagaauagcaagaauagccuaaagacuuaggaccacucauauaauaaaucacuacuuuugauuuuaaaauuuagguugucaguuugcauagaaauacacaucccuuauuuucuuucuuuuuuugugauggaguuucacucuuguugcccaggcuggagugcaauggcacagucucggcucaccacaaccuccgccucccggauucaagugauucuccugcuucaaccucccgaguagcugggauugcaggcguguaccaccacgccuggcuaauuuuguauuuuuaguagagacaggguuucuucauguuggucaggcuggucucgaacuccugaccuugugaucugccugccucggccucccaaagugcuaggauuacagacgugagccaccaugcccggccacaucccuuauuuuugcagaagugaggcuugucaugccaaacgagacucgaagcuaugauuuuguuuuauuuauuuauuuuuauuuuuuauuaaaaaaaaauuuuuuuuuugagauggagucuggcuguguugcccaggcuggagugcaguggcacaaucuuggcucacugcaagcuccaccucucggguucaugccauucucccgccucagccucccgauuaguugggacuacaggugccugccaccacacccagcuaauuuuuuuuaauguauuuuuaguagagaugggguuucacuuuguuagccaggauguucucgaucuucuggccuauuuuguuuuuuaaguuacuacaauuugagggucagugcccuuuucuaaggcauuaaguacuacuuucucuuuuuuuuguuuguucguuuuguuuuuuguuuuugagacagagccucacucugucaccuaggcuggagugcaguggcucaaucucggcucgccgcaaccuccgccucccaaguucaagcgauucuccuaccucagucucccaaguagcugggauuacaggcaugcgccaccacgcccagcuaauuuuuuuguauuuuuaguagagaccggguuucuccauguuggucaggcuggucucaaacucccaaccucaggugaucugucugccucggccucccaaagugcugggauuacagacaugagccaccgcgccuggcaaguacuacuuucucacaaucauauccuuucugcagaggaggacuuccaccuauggaaaugguguuuauguuacgauucaaugacaaagacuaagaauaaucaguugaaggaacaaauucuuuccaggaaaagaauuuuaaacaaagcaugaauugacugcuaaaagccuucuccuacucacaauuuuccuuuuuccugugguaaaauauuauagaagagcuauuuuuacuaaagcauuucuucccuccucugaucauuccaaaauaguuaaaauugcuguuaaguuuagucuuagaggucagucccugaagcuucuagcuuucugccuacuugauuguuuggucccaucccagucauacaaaaggaugcuaucauuuugauuagaauuccuugucuuaguuucuuguuuaaaaauuuuaaaguuaucauguccauugauuacagagcagugguuugguauuuuuauuuuaguaguagauagucacaacuacauaaagaaagcuucuggcuggguccaguggcucaugccugcaaucccagcacuuugggaggccaagacaggaggauugcuggaccccaggaguucaagaccagccugggaacauagcgagacuuugucucuacacaaaaguaaaaaauuagccaggcacaaagugguugcaugccuaugguccuagcuacucgggaggcugaggugggaggaacacuugagcuggaggaguucgaagcugcagugagucauacuuugggguccauacugaauauguuacuuacuaauagaauuuucuucagaaagauaccucacuacuugguuucugaaaucaaauagguaagaguuauauugagucaguagcuaccuugaguauaacaucuuuuuuuaaauguguuuuccuuggcgucucuugcauguucccuagaguguaaugucuuauaucuaauguagaaacugucaggguauucagcauguaaagugccuuuauuuaaaugauuugaaacaguaucacaaaacucagauucuccaucccccacagccaucaaaauaaaaccaugauagcaaacaaaucauuuaauucagcuauaucagugauuucauuuuucccucauaaugauuuuguuuucuagcugguccaguucugauggcaaagaugauccaauugaaguaucuaaagacaguauauuugugaagaucuuacagaaacuuuuaaaagaugguaagugguuuguuacuauaccguuggaaauuacagugucauuccucaguuuuuuggguuuuuuuuugagacggagucuugcucugucacucaggcuggagugcagugguaugaucucggcucagugcagccuccaccucccggguucaagcaauucuucugccucagccccuggaguagcuggaacuacagaccugugcuaccaugccuggcuaauuuuuguauuuuuaguaaaagcaggguuucaccauauuggccaggcuggucucgaacuccugaccucaugauccaccugccuuggccucugucuaaagaaaaaaaaaaaagaaccaagaagcuuucauuuggagucuguccacacugaucuccaagcauuaguauucagauuuguagcuuccuuucauagcuguaaaaaugccacagacugaauugugucuaauuaaguaucuagcacuaauauuuaagggcagcuuugcaguuuuuguuauucuuaguggauuauaaaacaggugaaaaacaggaauggaaagucauaauuucauaaaggacaagaacaguggaaacuuuuuuuuuucuuuuuuuugagacggagucucauucuguugcccaggcuggagugcaguggcucaaucucagcuuacuacaaccuccaccuccuggguucaagugauucuccugccucagccuccugaguagcugggauuacaggcacgcaccaccaugucuggcuaauuuuuguauuuuuaguagagacaggguuucaccauguuggucaggcuggccucgaacuccugaccucgugaucugcccgccucagccucccaaauugcugggauuacaggcaugagccaccacgcccagcugaaacuuuuauuuaaauaaaaauauaggcaggugcaguggcucacacuuugggaggccaaggugggagaaucacuugagcccaguaguucaagaccagcuggagcaacauagggagauccugucccuauuuuaaaaaaaaaaaaaaaaaaaaaaaagaguugagcacaggggugcaugccuguguuuccagcuacuggggaggcugagguaggaggauugcuugagcccaggaggugaaggcugcagugaguucugauggugccacugcacuucagccugggugacagagcgagacuccgucucaaaaaaaaaaaaaaaaaaaaaaauuauauauguguguguauuauauauguauauuuuacauauauaaggcgugcgguuuuuuaauaacaggacaaauguacuuuuggaaccuucuuaauauggcuuucauguacaauaguguuuuuaaaggacagauucugaagguagggagauacagauaaccuugcauuauauuucauaggcauugacagugcaacagcuacuucagccugugcauucuuccugcagacauauuuaaauuacccacaagguuuguuuuuacauguuaccugaaauacauuauacauacagaacaaaaugcaugucucauuaaauggaguuuaaauuuuuuucuaguuagucaccaacauuuaauaguugagaaugguguuauaaaagucuuauuuugccaggcacgguagcucacgccuguaaucccagcacuuugggaggccgaggcaggagaaucccuugagcucaggaguucaagaccagccugggccacauagcaagacccccaccucuacagaaaaaaaaaaaaaaauuagcuaggcuucguggugcaugccuauagucccugcuacucaggaagcugaggugggaggaucacuugagcucgaaaggucaaaggauugaagcuacagugagcuacgaucguaccauuccacuccagccugggugacagaguggagacccugucucaauaaaaaauaaaaacuacaauuaagaaccaaaaaauaggcugggcacaguggcucaugccuguaaucccaacacuuuaggagacugagguggguggaucacuugaagucaggaguucaagaccagccuggccaacauggugaaacaccauuucuacuaaaaauacaaaaaauuagccggguguaguggugggcaccuguaauccuaguuaccgggguggcugaggcaggagaaucgcuugaacccagaaggcagagguugcugugagccgagaucgcgccauugccuggccagcagagugagacuccgccugaaaaaaaaaaaaaaaaagaaccaaaaaaugaugcaaggcccuuugaguuuuuuuuuuaaaccaguaucugauuuugagaaucuuaugguaauguaacaaauuauaaaaauauuauuggcuuauuaauuugaaaauuuucauccaguuuucucuauuugucaaaugagaaaauuguguauguuuguuuguaacuacacagaugucaaacaauccauuuaguucauguucacugucuuuucagcucuauggaugacuugugaagaaaugauucuuuugccuaucuaauuuuagauuuauacuguaaacacauuuugagauccuguagcuagcguucauaacaguguuucuacuaaauuauucccuaaauaggggaucauauaaguguuugaaauacuuguuuucaagcuugggaauacaugaaaacguuucagaucuuauuaaacacuuuaaauagaauggcuauuuugaccacuggagggaaaaacacucaggcagccccuguaaaggauaucacauuguuagacuugaaaguauguuugacagauggaaggaauuuagaagagaguauuucccaacagcaaagugacguuauauuuaaauagaagcacaggugcuuuugucaucaaucaucagaauucauuugagcauuuuauaauaauugaaaaaugacuucuuguguuuguguuuauaggcauucagcucagugaguacuuaccggaggugaaagaccugcuacaagcggaucagcuuggaagcuuaaaguccaauccuuacuucgaguuuguuuugaaagcaaauuaugaauauuauguucagggacaaauauaacuuuuucuaaaaauggccauuguuuaugaaaucuguauaaguguguccuuauacaaauuuuaggccauaaacaaguguaaguuuguacaauuucauaacauguauagcugaguuuuuauacuuuauauguaggaagcuaauauaaaauaguuauguaacugugauuuugguuuucaguuaugugacuuguuuuuuccaccugaaaugugucaguuguuguuccuguacucggugcccuuucuuuuuacucucacguggucccagguucuggaguucuuguccugguucuagcugcucacauguacaaaucacuucuaggccucaguuucugcgacuaugaaaauuacuagauugcacuagcuugucucuaaaauugcugugacuccagauacuuugcacugaagagaaucuaggguguuugauaucuguuucaguuagggcuaaugggaaaugucuaguaagauaaaugucaacuuuugcugacuuauuaugagaugaaaaaccaaaggagagugggccuaacucaugugagcuugauaacugaugaacucauugggagcauuuuaaacuuuucuacauaaauaauaaaugagcacuaaugaaagua

SEQ ID NO: 192000 - RNA, 42114 nt, Homo sapiens
uaaaguucacuauaaauuuuaaucuaugauauaaaauauuaccuaaagauaaaauugaacaucauguaucagaaaauaaaacauaacaaugaaaugcaauuucguaaauacuucuauggcacaaggauuauuuuccucagauucaaccuuguaauuguguuguuugcuuucugaaaaucacacuuuauaaagaacacaaguagagcuuguuaaaaaugauugucacagauguacuguuuacuaauucaaagaacacuauauucauucauaucaauuuuauucauuaauuaugaacaauaaaauauaauauuccaugcuuuucaugaaauagugguuucuucuuccagucuaaucagggaacuaauaaaugcuuaguucaugggaaaacuuccauuugauuuacauugacuuaauuacuucuuagggucuagccucauccauggagaaaaagcacuuuuucuugaggcaacagcaaauuaacagcacugauacaaaauauggcaaauucaaugguuguagcauugcuuuaggaauuuugagacuauaaauaaaacuauaaccauaaauaaaagggcuuauuaauaucuucuuuucaggagagugauacauucugaaguuuucuuguuauucuguugaauagcaaggacuuccaaacuuaaaugucuuaaggcugaaaauuaguuauauuccucaaauuuuagccuuauuaaugaaauuccaaaaguauuauaaaauaagauucaauuugucuugaaauuauaaauuuguaacagauauuuuucaaaauacaugccuucaaacaacuuaaaugcaaaaaucauucauucuuaauaauaccuagcaguucaugccuugcuucgcaaaaguacucauacaaacaugugaauuuaaaaaacauguuuuccuguucaaaaaauaaagcuucugcccuuuuaaaaacuugucaggcuuucaugugccaaaauguugaaaacugcacauauucaaacauaguucccauaggaacacauauuccucagcucucacaccuuugaagacacaggagaugggcaauauaaauguucccuucuuuccagcugauguuaaauaguuagguuugcuucaugagauuaucggaauaaaggguuaaauuuucaauuuccauuauucuaucuguaaaauuagacuuaaaaguagguagaauacuaccagaagaauuacacagugauugguaaacuggccuaaaauaaucaggcuuuuuauuuauaauugccuuuuuaaaguugucauuugacaauagcuucaaucuuuaacagcaggcaaaagaaaaugaggugccaugcuauauuaauuaaaauauuccacaagaaaagaaaauacaaaaccugaaaauaacuucagugcuauagacauuuaaaaaguuacaauuauuaaaacucugaauaaaaagaucuugagaacagguacguuucaaaacaaucuuuuacacacuuuggaaaaaaauagguauuuuucaaauaacuugauauaugguuuauguauuucauagucucugaguuuuuuuucugcaacacuguuuugcauuaaagucucauauuguuuaccaguaauugcuuccuuaugcugaaauaaaacuuuguuuguucauuaguuuucuguauaucccauuugguuuugaaagcagcucuucauguuuuccauauucaguaauuuuuccuuggucaagaacagcaaccauauuagcauucuuaaugguggacagacgaugggcaauaacuaacaccguucuuccauccaucagucgaucuagagcuucuugaacaagguacucauuuucggcauccagcgcacugacacaggagcacacacacaagaaagcaaagacgucagugacacccaugugcuuccugauacacacagcagcccuuccugagcaaugaauuuuuaccaugaucaaaauuucaacuguuuaggacuuucugaucuccauaaaacuauacugugauguaaggagaaaagcauucugcacaguuacagcuuacagagugauuaggauugauggcaaccaugucugaaguggaccuagaacucucaacuaggacucagucugcccacugguuuucaacugucauuauuaauucagcuucccucacuuuagaguaaaggggggaaaaaggauuuucaguuguaucacuuugagguacagaauuaaaaguguuuuggugaaggaagaauuugguuuaauacacacaauggcauauauuauuaagauauccucaccugguugcuucaucuaggagaagaauuuugggauucugaagaaggaaaaaaaaggaaaagauaaaauaauuuuauuggaaaaauacaaacucucagcaauaaaaaaggaauaaaauucugacacaugcuacaauguggaugagccuuggaaacuuaugcuaagugaaagaagccagacacaaagaaucacauacuguaugaguucacuuauaugaaauguccacaacaggcacuucuacagaugguggauaucuggggcuggguucaaugcaggaaauaaggaaggggaguugcauggcugcuaaagaguagagggucccugggggggugaugaaaauguuuucuaaaauugugaugauggaugcacaacacagaauacacuaaaaaccaaugaauuuauuuuuuaaaugggcaaauuauguaguaugugaauuauaucucaaagcuguuacaaaaaaaccccacaaauuacuaagugucugggauaaguacauaaaugaaagaauuagagacuauuuuaaaugaucaucagaguaaucacuagaccagguaucguucauagcacaguuuuauccugccaucagaguaaucacuagaccggguauccuuuauagcacaguuuuauccugcuggucagugagaugagaaucuaaaaugaguaagauggccggacgugguggcucacgacuguaaucccggcaauuugggaggccgaggcagguggaucaccugaggucaggaguuugggacuagccuggccaacauggcaaaaccccgucucuacuaaaaauacaaaaaaauuagcuggccugguggcacaugccuguaaucccagcuacucuggaugcugaggcaggagaaucgcuugaacucgggaaguggaggcugcagugagccaagcucacaccacugcacuccagccugggcgacagagugagacucugucucagaaaauaaauaaauaaaguaaguaaguaaguaaauaaauaaauaaaaugaguaaggcugaguacgguggcucacaccuguaaucccaacacucuggcaggcugaggggggaggacugcuugagcccaggaguucaagaccagccugggcaaaauagcaagaccccaucucuaccaaaaaaauuuuuuuuuaaauuagcuggguuugguaugguaugcaccuauaguccuagcucccugggaggcugagacagguagauuacugaagcccaggaggucaaggcuacaagugagccaugaucacaccacugcacuccagccugggugacagaaugagaccgucacaaauuuaaaaauaaaauuaaauuaaaauuaaaaagauaugucuauaacuuucaagguccugcuuauaguuaauuuagaaauaauaaacuaacuuugggaggccaagguggguggaucacuugaggucaggaguucaagaccagccuggcgaacauggugaaaccccaccucuacuaaaaauacaaaaaucagccgggugugguggcgugcaucugugaucccagcuacuugggaggcugaggcaugaguaucacuugcaaccugggaggcagaguuugcaaugcgcugagaucgaccacugcacuccagccugggugauacagcgagacucugucucaaaaaaaagaaaaaaagaaaaaagaaaagcuaacacaugagaccaaaaaaaaaaaaaagagacuaaucugauguagauaaaacauuacaaguccagcuuugcaaaugaaaacacacacccucacaaaaagguagcuacuauucuuuauauauuauucacaauagccccaaacuggaaaugacccaagcguuuaucagcuggugaacagaucaacaaauagggauccauccauacuacuuaacaguagaagggaauaaaguacugauacaaacuacaaauuggagaaaucucaaaaacacuccaccuguacuaagugaaagaagcuagaugccaaaaaccauauaucgucugauuccauuuaucugaaaugucuggaaaagcaaaucuagacagacagaaaguagauucguggcauccuggggccggaaacaaggaacgacugacugcaagugggcacaagagaucuuuuuagggugacagaaauguucugaaacuggacuuugugugcaaccaacuccgcaaauuuacuaaaagucacuggaaaguacauuuaaaauaaaugaauuuuauauauguaaauucugcuucaguaaagcugcuuuuuuuuuuuaaucaccuauaagccugagaagaacaguuguauaacaaagggaaggcuauugcuuccuuaaaaagagaaugcccgccuuucagcuaaaauggcucuucccuuuccuucuaggaaucuugucuaaguacuucaagucuguacuauucacuuuagcagcugauuacagauuguacaaauaugcauacuuacgcuguuuuauauuuugcauuaauaaucacuguuucacuggcuagacuguaugcuucuugauggaggguccauguguuaaauucuucuaccuccaacaaccuuagcacaguacugagcucaugauaccuaagaaauacuuguuaaauuuggacaauauacuacacuaacuuaccuuucaccagaacugucacccucccacuccaagaaaaaaaaaaaaacaaaaaacaggaaaaggaagaagacaaauaguaaauuacaaauuacaaggucccuaauaaaaauaaucccuaauuuaaaaaacauccaagucgcuucaggcuuaccuuuagcagagcacgggcaaucgcaauccgcuguuucugcccaccugacaaagacaacauuuaaaaaaagaaggccucaacaaaaaaucuuaguaauaggcuuuuaugauaaaccauauagcaauuugaaggcaagcuucuucuaguuagucauagcugacacagauagaccagaaaccuauuuuaaaauauagguuuaaaauauaucaaucccaaaauuaauaauuauuaucauagccaaaauguauugaugacuuccuauauaccaaguauuuucuuuucuuucuguuuuugagacagggccucacucugucacccaugcuggagugcaguggcaugaucacggcucauugcagccucaaucuccugggcucaagugauccucccaccucagccucccaaguagcugagacuacaggugugcaccaacacaccuggcuaauuuuugguaaagaugggguuuugccauguugcccaggcuggucucaagcuccugggcucaagcaauccgcccaccucagccucccaaagugcugggauuauaggcgggagccacagugcccggccaauaccaggcauuuucuauaugcacugcauguauuaucucauuuaauguuuuuauuuuaaauaauuucaaacaaggucuugcucugucacccagcuggagugcaauggcaugaacacggcucauugcagcuucaaccuccuggacucaagugauccuccugccucagccuccugaguagcugggaccacaggcccauaccaccaaaccuggcuaauuuuuaaaauuuuuuggagacauggucuugcucuguugcccaggcuggugucaaacuccuggacucaagagauccuccugccuuggucucccaaagugcugagauugggagccacugugugagccacugugccugacuaaucuuuuuaaaaauccuaugagacagacccuauaauuauucccauuuuacagaugauaaacugagauacaaaguagcauguccaggaucucauaguugguaaguaguggaacugagaucugaaccuacacagugcaagggguaugcucuuaaaagcauguaaagaucuaugcuguucaucacuacacauauuuccucccuagcagaauauccaauguagcaaggaaaccagaaacucaagauauuugcaguuuccaaagaacacuugaaaugucugggagcaaaggacaucaguggugcugagacugauaauucuaauauucccacauuauagcaauucuuuuuuuauuuuuuuugagacaagagucuugcucugucuuccagguggaguacaguagugcaaucauggcucacugcaaccucucgcuccugggcucaagugauucuccugccucagccuccccaguaccugggacuacaggcagugccaccaugcccggcuaacauagcacuuauucuuuaugauguucuuuuuuuccccuccucuagaggaaaaaauaguaauauguguguauguaugacacugaaaauuacaguaagucacucuaauccugucuuuuuaagcucaaauucuacuaaaagugagggaacaaacuggaaguaggugugggagaaggugggauggaguggagucagcaggaucuguguugauucccucccuaucuuugucucaccccauccucccuccuuuccuccaggaacgcuacuccuaagucauacuuggaaagucucagagugcucacuccucccaacuuacauuguuuauaaaacccaauuccauuuuuggggauaaaaaacauuccuuuuugauuuuauuggcugaacauacuuaucaacaguaguugcuggacaucauuuuauuucauauaagagagguucauccucuacaucugagguguguggugcugcuaaaugcugcucuaaacaggaaaccagugcacacaaggagggcagugaggaaaacccucuccugagccucugauuggugaggcugucugagugcccugagguagguccuuagagcagccugcugauggcuuagguccccucugagucauguguggugccaaucaguacccugggaaucuauuacuaggugcucugucuuccucccagaaagcaagagcagacuggaaccucugguuacuucgcugagaaacggaacuggaggauccuaccagagggaaggacaugcagaaucugugucaagggaggugacgugcucuuaggacaagccucacacuucaauguucaauaauuucaccacgagcaguuuacacugguuuucugccccguuucucagauauguuucagagauggaguagcaguucacuuucacacagcagucaggaauucuacuccuggaacaucucagaucuaucaaagacgccuuuucaucuacugcuuauauauauauauauauuuuaaaucauauacaauaagcuuaaaacccuuuuguuuuauauuuucuguggucuaacuucaaaugaaaaguuuagcauaggaaaagacuguuguuuuagucuaaucugccagccuucacugucacaaagaggcaaccacccucugcucaaacagagacaaguuuuuuguuuuuuuuuuuaagacagaggcucacucacucugucauuaaggguggagugcaguggugcgaucccagcucacugcaaccucugccucgcugggcucaagcaguacuccuaccucagccucccgaguagcugggaccauaagugcucaccaccacaccuggcuauuguuuuguauuuuugguagagagggggucucaccauguugcccaggcuggucucgaacuacugagcucaagcaaucagccugucuuggccucccagagugcuaggacuacaggcaugagccaccaugcccggccaggaacuuguuaucuugcaaggaaacauuucaauauuuguauugaaaaaaaaaaguguuuagcugaacauuuauuucucuuaaaguucuacucauugguucauuucugcacuuuaaagaaauacaaacugagucuucucucuccucaaaauauggcaaccauaaugugauccagaaugauagguguggucugacaccacagggaaucgcucacuuugccucacagccgugagucuauucagcaaauuauggcccacaggccagaccugaaccauggcaugucuaugcacggcccucaagcuaagaauguguuuuacauuuuuaaaguugcuuaaaagcacacacacacaaagaaggaugugugacagccaucauaugugacccauaaaacccacaauuuuuuuuuuuuugggacagagucucauucugucucccaggcuggagugcaauggcacaaucuuggcucacugcaaccuccgccuccugaguucaagcaauucucaugccucagccucccgaguagcugggauuacaggugcccaccaccacgcccagcuaacuuuuuguaucuuuaguagagacaggguuucaccauguucaccaggcuagucuugaacuccugaucucaagugauccaccugccucggccucccaaagugcugggauuacaggugugagccaccgugccuggccaaaacccacaauauuuacugucuggcucuuuaaagaaaaguuugucaaacccuggucuaguauguagggaguaaauaauucuuucaauuucagcuuuguuccugaugcacauucccugacucccugggcaaaucauccugccacuucuuauuuucuuuaauuuuugagggucucagguugcaaagcacauuuguuguuguuguuguuguuguuguuuuucagaugaaaaaaagcuugcuguggcugaguacuacucagaauuuuuggaacacauaugggguagaaagugaaagaaaacacuggggaauuuuccacauauaagagagcaagugguaaggcuaauuucaaaaacucuaaagaugaaaaccuaauuagaaaauaauacugcaauauagaaacaugugggcugggcacgguggcucacgccuguaaucccagcacuuugcgaggccaaggugggcggaucacgaggucaggagaucaagacuauccuggcuaacacggugaaacccugucucuacuaaaaaauuagcuggacgugguggcaggcaccuguggucccagcuacucgggaggcugaggcaggagaauggcaugaacccaggaggaggagcuugcagagagccgagauugcgccacugccacugcacuccagccugggugacagagcaagacucaagacuccgucucaaaaacaaaacaaacaaacaaaaaaaacaagaaacaugugaaaaguucuuuggauauagagacuuugcuacaaagcaguaaagaaaugcaccugagaggagaacacccuuuucuccaaccacaguguugaacccuugggggaaauuccggaugaaggccacugcauuggccacuucagccacucucuggauuuccucagcggucacagaggaagggucaucagcaccauaagcaauguucucagcaauagagcaagaaaacaaaauggguuccuacaaauuggaaauaaaacauaucacgaauuucaaacagacuuaaaacaugucuaauaaauuuagaccuagcagucuuuuuuaaaauuuauguuuugccaugaacaggauuuuaucaucuguaguucucaccaugcugcaagcaaugagaccucacagcaggugcccgcaaggcaccuggcacaugguaggaacuuuguaaaugucaguccccugccuuaggaaucaggaggcaccaggagaccccaaguccaccugcauuuuccagcugccugccuuccacucaggacaaagcggggaauccaucuccauccauuacuuuuugaaauacacacaaaccacaugggaacaaacaauucugacagaacccuauggaguaguccuaaaaaauaagcaaacuuccaggcucuuuucuccaucccuaaucauauacaccacugaugucccuacacuccugagcacccaucaccauccaccugcccucacccaaguggaguggggagaggaugagcuaaucacaaagagagguucagaaauggggggaggcucagguuuguaugcugugugcacagccugguaauaaaaauuaaaacagcugcagcaacauuucccugccccaaagggucuugugaaaauggccuuaucaaagugaccacauuacauuaacacucugcuuugaaaucugcaacuucuuugcaaggaggacucuggcucuugccauagucuuugcucacuuuucccugaaacucauuaugcagaauaguagacuguggcuggugaugaaaaugggaaguggggaagaaucaguaaaagcuaaaaaagagucaauaaaaucuucuaucauuuccuccccauccucuagacuaucuaguaaugguagucuccagcuuucaauaaaaagucaaugcuucacccuugcucaaacauuuaggguuuucaggaaacagcgcuacuugcaaaccuaaacaaccugccaugugagaugagcuuaauacaucccaaagacuuccauuccuucucucuugagaaguucgagacaaaaaaaaaaaaaagcaaaagacaaaaguaauuuuaaaagaaagugaaauagaaauggaagccucucuucuuaccugacucacugucccaauuuuggaucucagccacacuggguuuagcugacggaugucauggccaucaagacuaauaguuccuuguugagaggaaaggaaaggaaagagucacugagugugaugaggcugaugaccaacacagaaaggauccggugggaaaauuccagacucauuuuuuaaagaucaaaauguacugaaaaucuccagauggacucuaaaacuaacauauuucaugaaauuucagagcuaaaagggacuuucuggauuguccaaguuauugucucccgauaguagcuggaugacuaucucaccgaguccaucuguccagcuugccuuccuguacuccggagguuguagggaguuuucccaaaacucccuagugacuuaggauuccaccgauaagaugcacuugugcaaagcuuuaauucagaagggaggggcaagccaugaggcauccacuugcuggcacgaauacuggcagagguggcacagcucugaagcuggcauucaugacagcaacugccuaaauuuguagcuuccugaccaugccagugucagcagcuaccuugaaggccugguucugggguggaguucugcaaacuguccuggaaguacaaucuagaaucuauuuugucauuccugccagugauuuuugagcucuuuuauuacuccuuaaaauaucccuuucuguaauaagcuuaguuggugaggaaucuguugucugcaacuaagaaucuggucgauaccauggcagagcuuuuaaauaaucagacgcuaucuuuaugacuuuugcuaacagaauucuucacauugagggugcucaacaaaacuuggugaugaugacaacagugacagcauaagaaaugccauuucuucucaguuaauguuguggaauuauagaagccagcuggaaauguucacaaacuggcaaaaacuugaggucuuugacgaaaaagcacaaagcucuuuauagacuacacauggcagacauuuaacugcaguuugcuuuguccuggauuuauucauugugaugaagaaacuagagacucaguauuuuuacuugaauuacagcaaccuaaauaggauuuuuuuuggucuuuuuuuuuuuuccuuuuuauggagaacaaggucucacuauauugcccaagcaggucucaaacucccgggcucaagcuauccucccaccucugccucccuaagagcugagauuacaggugugaacuacugugcccagcuaacuaggauuuuuuuaaacuccaaauuuuauagcaagugaauggugaaucaagaaagugauuccagagacaaacaauguaguaagccccauuuuaacacagguggugauuccaugggucaggauuugcaagucacauauuuaucugacauguaaccagcucucacauuguuuuaaccaaaaagcauaagcacaaagacacaaaacauucauuuuuuaaauuacagaauuuuuuuuuuuuaauaaauagugacagggucucacuauguuacccgggcuggucuccaacuuguggccucaagugauccucccaccucagccucccaaaguguugcaauuacagguguggggcuccacaucuggccaaaauauucuuucuaaauucaugauuugauuuuuacuaagaguuguuugcuugcugacauuguugucuacuacagggaagauagaaguaaaaucaugugcucuuugcucuuaaagauguuauaauccaguuaaaaauaaaauaaaaacuagaaugagaaaaaucauccauuaagaaaaucccggcugggcgcgguggcucacgccuguaaucccagcacucugggggacugaggaggguggaucacgaggucaggagaucgagaccauccuggcuaacacggugaaaccccaucucuacuaaaaauacaaaaaaaauuagccgggcaugguggcaggcgccuguggucccagcuacucgggaggcugaggcaggagaauggcgugaacccgggaggcggagcuugcagcagugagcugagaucgugccacugcacuccagccugggcaacagagcaagacuccgucucaaaaaaaaaaaaaaaaaaaaaaaaaaaaaaaaaagaaaaucccuacuaggucaaaauaguuucaauggaacagucacauagaaguuaaucacuggccaggcacgguggcucacaccuguaaucccagcacuuugggaggccaaggcggguggaucacgaggucaggagaucgagaccauccuggcuaacacggugaaaccccaacucuauuaaaaauacaaaaaauuagcugggcgugguggcaggcaccuguagucccagcuacucgggaggcugaggcaggagaauggcgggaacccaggaggcagagcuugcagugagcugagaucgcgccacugcacuccagccugggcgacagagcaagacugucucaaaaaaaaaaaaaaaaaaaaaaaaaagaagugaaucacugauggccaaguuaacugugugcacaauaagcauucaauggcucacaggcagaggcagagguucuccaggagcucccuaucacuccugcgcccagcacgcgcacuggcacacggugguucuccagggugcugcuggagcaccccaggcacucuguccuggcugcugagcacagccucguccaccugcucccaguagagggcauguccagaggagauacccgcaugggagaugaggagguagaucuggggaagucacucugggcuugaagagguaggacacauuacacacaaaaagcucuaaaggccucuguaugagcugucaugccccugcaaaugacaccuucuguuugagggauuucuuuccacuggcacuuagaaaagaagguacucuacaaaauaagguauuugcaugguuugagcaucuccuagggcgcaaaagugggagcagagcucgggagagucccucggugcuacaguguggugaacugcuuaccagaagcagggucguacaaccucagcaggagugaaagcacuguugauuugccagaaccacuugggccaaccagugccgugacagauccugacggaauggaaaggcugaaauccugaaauaugggcaccucugggcgagcuggauaggcaaaaugcacguucuuaaacuccaaagcacccuggaagcuuuucucauuuaagaugacccccucugaaacauaaaauggaauauuaauuacuuacagcaaaaaauuaaacucaaaagcugaacucgguucuccuacucaucuggcuauggaugggugacuccaccacagcuaauccugguauaugagcucuuaaagggcaagucagaagcaaaccuaggcuaaaugcuuaccacgugccaacucugcaccuacuauguccaagguacuauauacguagacggucuuacuugauccuuacaacccugagagguagaaauuauaauuccaauuuugcugaugaggacauugaagaccacagacaacaaccugcuuaagcuaacaaguaguggaguuaagauccacccuuguuagucugguuucaaauccgauggccuucucucuaugccacugccucuguguagcuccagaguuuaucuuaccuacccggaauaaauauuuuggaagaguuaugaugaaacggggagcgcugcacagcagccgcagaacuggaggggucagaggucuguucugcccugguguucaccuacugugcuuugggagacacuacugaaacucucucagcuggaccuauuuccuaggccuaucacauuggagaauauugggcuuucauuuauggaccuggggcuaccugacaauguccuaggaagucaauaagcagcugggagugguuacuacucauagccauuucuccugauuccuggcuaguugguuuaggcccuacagcuccagggaagucacugauaaggaaggagauggcuccagccaaugaguaccagccuccccuaccccacaccaaaaugccaagaaacuuagauauuuucuuaugucugauuccuccucccuuauucccacccuagcccuccacagagaugucagaaucacuagggaagaucaauuugguaaacuagcugggacacagcccugggccacacugacuuccauccugcccuuugcgguaacacccagauggagggaggggaacagagggcagcacacuauguggccagcccaugcauccagggacacccuggcccacaacagugccccagcagcugucccacccccucucauagaaaaccugaccaccuccucacccggcccgccaugcagcaggagccacauccuuacuguggcucaucccucacucccuugcagacaggggaagagcuggucucauuguucaaagccacauuuguuaauccuagcaaagaaacaauuuucagacccaccguuaaaaggcagcuugggcucucucuccaggagcucccagaggcgccccccugcacccaguccuuucaucagcuccgaguagaaagagcucagaccugaggaugagaagcagaauccacacacauguccaucacuggcacuggcacuggccaccacuccucugagaggagugacaaugauugcuuuuaauauaaaaucuguuauuaauauuuucaaaaaacaacuugaggcagcuuccugggaacugauacucagaauugcuugucucauacucuaguuuuccuuuggcuucuccuccuccaguuucauaguuuuuuuuuuuuuuuuuuuuuuugagacagaucaucacucugucacccaggcuggagugcacuggcacaaucucagcucacugcaaucuccaucuccccaguucaagugauucuccugccuuagccucccgaguagcugggauuacaggcgcaagccaccaggccuggcuaauuuuuuuauuuuuaguagagaugggguuucgcauguuggcaaggcugcucucaaacuccugaccuuaggugauccacccgccucagccucccaaagugugggauuauaggcaugggccacugcaccuggccacauuucacugauuucuaauaaggacuuaauguuugaucagggauugaaaaacauauauagucauacucaucaaccacuggauuaaaaucauaaugccgcagaggaaaucuaccuaguuaaaagcauuguaauuuaacugaaauguaaugcuaucucauaauuuaaaaaaauauaaaauacuucaauguugauuuuaaagacaaauccacaaaauaauaccucaccuucagccacucaauaaauacaacuuugauacgcuacucacauacucccauauacuucaaguaaucucuagauuacuuauaauaccucauacaauguaaugcuauguuuaaaaaaaaaaaaagggccaggcaaaaugguucauggcuguaaucucaacacuuugggaggccaaggugggaggauugcuagagcccaggaguucaacaucagccugggcaacauagagagaacccuguuucuacaaaaaauaacuguaaggccaggccugguagcaugugccuauauuccuaauuacuugggaggcugaggcaggaggauugcuugaguccaagagguuaaggcugcaaugagguauuacugcaccacugcacucuggcagcacucagagcaacagagcgagacccugucucaaaacaaaaaacaacaacaacaaaacuuucacaguaguaaaaacugaaauaaauuugguuaauguuaaacauuccagcaaucucuuuauuuuuauuuuuuuguggagacagggucucacuauguucccuagacuggucuuaaacuccugggcucaagcaauccuccugccuuggccucccaaagugcuggaauuacaagugugugucaccgucccuggucucuagccaucccuuuuuaaagucagcuuugaaccauuauuauuauuuuuuuuugagacggagucuugcucugcugugguguaguaucuaucacugaaccucugccucccagguucaagcaauucucccugccucagccucccgaguagcugggauuacaggugccccccaccaugccuggcuaaucuuuguauuuuuaguagagaugggguuucaccauguuggccaggcuggucuccaacucccaaccucaagugauguacccaccucagccucccaaagugcugggauuauagguguaagccaccaugccuagccugaaccauuuaacaacuuaaaccccaaaugcaauggucuacaucaaaugugaggacauacauuuguaacauuuucccucagugaggaugcugaaaaaauacaauucaaauauucuacaguaugaauauuuaugcaagauacaauggacuaaaauuuuuaggcugaauuaaaaaugcauuuggcaaaaauagacccccauaaacagucaacugauuuuugacacagaagcaaacgcaauacaauggagaugcaacggcaauauacauauuaucuuuuuaacaaaugguucuagaacaacugaauauccacaugcaaagaaggaaucuagacacagaccuuacaccuuucccaaaaacuaauguagagugaauuacagaccuaauguaaaacacaaaacaauaaacuccuagaaggcaaccuaggagcaaguguagaugaccuugaauuuggugaugacuuuuuagauacaauaccaaagguacaauccaugaaagaaagaagcuggacuucauuaaaauuaaaaauguaugcuuugcaaaagacaaugugaaaagaagaggaccagccacaaacuggaagaaaauaucuguaaaagaccuauccaauaaaggauugcuacccaaaauauacgaagaacucuuaaaacucaacaauacggaaacaugaagacuuacuuaaaaauggucaaaaguccugaacagacaacucaccagagaaaauauacagagagcaaauaagcauaugaacagacgcucaacaucauaugucaucagggaaaugccaacuaaaacaacaaugaaauaccaugcaucuaucagaauggcuaaaagcuagaacacugacgccacuaaaugcugggguggauguggagcaacaagaacucucauuccuugcuaguggggaugcaaaugggacacacauuuuggaaggcaguuugggaguuucuuacaaaacuaaaauuuuuuuuguaagaaaaaaauucauucggucaccauagagaugucaaaaauugccaaugcuggccgggugcgguggcucacaccuguaaucccagcacuuugggaggccaaggugggcagaucacuugaggccaggaguucaagaccagccuggccaacagggugaaacccugucucuacuaaaaaaaaaaauacaaaaauuaggccaggcguggauggcucaugccuguaaucccaggacuuugggaggccgaggcagguggaucaccugaggucaggaguucaagaucagccuggccaacauggugaaaccccgucucuacuaaaaauacaaaaaaaauagcuggacgcaguggcacgcacccguagucccagcuacucgggaggcugaggcuggagaaucgcuugaaccuggggggguggagguugcagugagccaagaccgcgccacugcacuccagccugggugacagagcaagacuccaucucaaaaaaaaaaaaaaaaaaaaaggccaagcaugguggcggaugccuguaaucccagcucuuugggaggcugaggcacaagaauugcuugagcccgggagguggagguugcagugagcugagaugaugccacugcacuccagccugggcaacagaaugagacucccuuuaaaaaaaaaaaaaaaaaaaaaaaaaaaaaaccuugccaaugcugacuacauugcaagucaucacagaaggguaucgagaaaaguuuucaauuggcaauaaucacgccucggauaaaccucacugccuaugauacugccacugugcuaagcuaaacauauucuuaccauccaaucaagcgguuauacuccuugguauuuaccuaaaugagcugaaaacuccuaucuacacaaaaaccuacacauggauguuuauagcagcuuuauucaucauugccaaaacuuagaagcagccaagugcccuuuaguaggugaaugaauaaacuguuguacauccacacaauggaauauuauucagugcuaaaaauaaaugagcuaucaagccauaaaaagacauggagaaaccuuaaaugcauauuucugugaaaagagccaaucaaaugcuacauacugcaagauuacaaauauaugacauucuagaaaaggcauaaccauggaaacaguagguugcagaagggugaugaauaagcagagcucagaggaucuuugaggcaguaaaacuacucuguaugauacaggaauguuggauacaugucauuuugcauuuguccaaacccauagaauguacaacaccaagagugaacccuaauguaaacuguggacuuuggguguaaugcugugucaauguaggcucuuuuuuuuuuuuuugagacagagucucacucugucacccaggcuggagugcaguggcacaaucccagcucgcugcaaccuccaccucccagguucaagcaauucuccugucucagucucccgaguagcugggauuacgggcaugaaccagcacacccagcuaauuuuuguauuuuuaguagagacaggguuuugccauguuggccaggcuggucucgaacuccuggucucaagugaucugcccgccucagccucgcaaagugcugggauuacaggagugagccacugcgcccagcuguagguucauuaauugcaucaaauguaccacucugcgggggauguuaauagggaggcugugcauguaugggggcagggguauacaccccuaucuccacacaauuuugcuaugaacguaaaacuacuuugaaaaugguauuaauuuuuaaaaagaagggagugagggaaaaaagaaagaagaaaaaaaaaguaaggcugggcaugguggugcacaccuauaaucccagcacuuugggaggccgaggcaggaggaucacuugagcccaggaguuugagaccagccugggcaacacaacauagcaagacccugucucuccaaaaaauaaaaauaauuaccugaauaugguuguguaugccugcaguccuagcuacucaggaggcugaggcggaaggaucacuugagcccaggaggucgaggcugcagugagcuaggauugugcuacugcacuccugccuggagacagaguaagacccugucucuaaaacaaaacaaaacaaaaaagaaguaaagguaaagagucaaaaguaguuuaacauaguuaagagcuuugacucugaacaacaaaagcacaauggcccuggaaaaauaaaaugcaaucucucgcuauaaugaaauauuauucaaccauaaaaaggaaugacauacuagcccaguugcgguggcucaugccugucaucccagcacucugggaagcagaggcaggcagauugcuugagcccagaaguucaagaccagccugggaaacaugucgaaacucugucucuacaaaaacuacaaaaacuagccaggcaugguggcgcaugccuguaagucucagcuacucagggggcugaggugagaggacugcuugagcccaggaggucaaggcugcccuacugcacuccagccugggugacagagcaagccccugucucaggaaaaaagaaaagaaaaaaaaaaaaaggaaugaaguacugauaccugcuacaauauagaugaacuuugaaaauauuaugcuaaguguaagaagccaggcacaggaggacauauauuguaugauuccuuuuauaugaaauagcuacaauagguaaauacauagagacagaaagcaaacuuugguugccaggagcuggcaggaggaaguaaaguagauagacugcuuaaugaauauugguuuucuuuuaggugaugaaaugguuugggaacuagauggagguagugguugcacagcauuaugaauguacuaaacaccacugaauuguaaacuugaaaaugguuagguuuugcuuuucuucauacaguacuucugacuucaucuuagcagagaauguacuuagaaucauugggguuuuuaccccuaguaugucuuucuaggcagaaaccaaaauaaaaauucuuauuuaauaaauaaaauagaauuucuugcuuuguagauuauagaaucauuuuagacagcgauucuauaaaaguauaaaauuacuuuaaaaacauaaaagcauggcugggugcaguggcucacaccuguaauccuagcaauuugggaggcugaggcgggcggauugccugagcucaggaguucaagacuagccugggcaacauggugaaaccccgucucuauuaaaaaaauccaaaaaauuagccagguguggcagcacgugccuguagucccagcuacuuggaaggcugaggcaggagaacugcuucaacccgggaggcggggguugcagugagccgacaucaugccaccacacuccagcuugggcgacagagcaagacuccaucuccaaauaaauaaacaaacaaacaaacaaacaaacauaaaagcacuuaaaaucuaauuuaaguuguugggcauuggugguucagugguagaauucucaccugcuaauucaaguuguuggauuaaauuccuaucaccuuaggcaucuauguuauaaauguggaagaacugguggcaacagauguacacugaccuacccauauuuucucuuaucccuccucgcaccagauggcagauccugaacaagacaguugaccagaguugugggcuagccugugguuaagaaagccaaauuacccaaucucugcacgcagacaaagccuuagcagcaccucccauaaccaguggugguaacugacuauagcaauggauuagaacuguguuuuccaacccauucuguggaaggcacaguugugaauuuguccguugugaacagagagggcaauagaacaaccacaaacagaaauaacgucuaucaugccaaaugauucagaggagggaagaggaggggcugagaaagaucaugucuagcauggcagaaaacauuaagaugaggggaggccagggaggaaaccuggaacgugaacagaaaggccagggagaggggaaguaggguagguaguccacuugaaggaggacagaagaccuaggggaacaggaccacaacagggugugaaaccuccagcccagcaggcucaauccaggaaacggagagggaagagcuacauacugucuguggguccuccugaaccgguccaccuucucguuucccaaaccagccagcaccccaaaacaucuuaaaaucaguuuuuauuuaagaccagccagcagaacuaaaaugcuuuuuucaggggucucugaaaaucucauuccagaaaaaaauccucacuugccugcagaugucuacggaaaugccucuaccuucaacaauuagacagauacaaaacccugaaaauaaaacucucugguugaggcaacaccauaggauaccugauaauguuccauuaaucagaccuuaagcuacuuaccugaccuuuccaucuugauuuucaaagacaagaagggaaacaaaaaccaggaaaucauuugucccaaguugacuggggaugcauuccuguuuuccuuuauccgggaaugaaaaauaaaagcugaacucucacagauucuuaauaaaagcaggcaacucuguuucauacacuugauaauuuauaaauauuuuuugauugcucauuaauuuugaauauggucgacuuugugcaaaaggaauuuuauucuccacugauuugccaaucacgaaaccaugacuaacacaggacuauggguuucuguguccacacuugcucagcgccgcccuccuccugccugcaccugugagcaagugaacaaauggucugaagacacaggcugggaaauaaccacuccagagcgaugcugagcuauaagaggccugcaaagauccccaaacuucccaaccaaggagcuguuugcucaccugcuggggagggucacacucauuuuacuucuuuaaaagcccaguuggaauaauaacauucuaggaaaugcuuuuucaguggaaguuaauugaaguaaugugaaaguucaguuucucuuucagaaaugaugcucugauuuuuaauuuguaacaccccaagccuauuuaaauuauuuaccuccaaugcuuauuccaacccagaaagcauacauuaggaaggaagagaguucacccacggucaugugggcacugcccaucagcagcccuccuuuguacaggacagaaagcacgaucagguuuccggagagcccagucugucgaaugaagaaaacacagaagucaggugggaaucaaggacccagaaugugaaaagcaugaacacggccuguaaugucccuuuuucauucaacugucacagcaagauuuuuccaaaauauuaauuucaccugaguuucaaauuaaaaaugguuuuguaauauugcaauaaugaagaaaacaaucucaucaccaugaaaaccuauaagcuaagucucccaucagauccugauuuuaucccaucuacucaguuugcaaaagauaaaaguaauauuaaagguuccuucccuaacuagaggaaacaaauaaauaucuacuguauagguuuauauaauauaaucagauguucugggcaaggacaccagccugaggagcuggacuccuguauguauggccugcuuuuaccaugguuacgugugugguugucuuagguauaggggaggccuucuccgggccacugcuccuuaucuguuaaucauagcaaugacggaauugccucugaaguucuuuucaguuuacacauaucuggaauuugcccucauggugauuuucuauuucaguguccuauuugagugcauugugauugauuuuuuguacuuguuucuugaaacacacugaggugauuuugguuaauccuuagacuuugcuggcaucagaaugaccuggaaggccuguuaaacagauugcuggccccaguuuccuacccagcagaccugggguggagcugagucuuggugaggcagaccagugcucaggcaaagcugaugccgcuggccugcaccgcacaaagaaucagugcccgaucacaccaugcacugacuuuucucuaaggacauuuacuuguuucuuccuuuuucacaaaaauauuuuaaagaaagucauucuuggccuugaaauuaagacuaaaauuuuaaaaauuaaaauuauuuucuacuuaugcugagcaccacagaauaaaacucucaccauucuaacauuugccaauuuuacuuuuuccaaagugaucuacuuacugcuccaaagaaaccagcccgggcgaaugccucuuuccuugcuaacugcauuacaugguccacuuugcuggcauauuucucgauuucagucauuucuuucccaaaagcucgaacaguucuuacauuuccaauacguuccucagcuagcugggagaauaauaaauacauuucaggaggagaagggucauauuucaagagcuucuaagaaggaaaaauaaaaugugguucucauuuuguuauucauuagaaagaaaagaaaagaaauagugauaguaagaagugagaacuccacaaaagacacuaucaauggaaagccacucuugauacaugacuaagucaaaaaagagugacaaagcagaguauacaaaacaauccuaguugugggggaaaaaaaucuauaccuaaacauaucagaaaaacauagaggcagaaaaacaggaguauauguagaugcagaaaugcauuuuuaugcagagaaaaagacagacuccaaaauguuaauaauguuaauucgaaaagacaggauuaugcguguuuuuguuuucucucuuuauauuuucaaauuuuucaacaauaaacaugcaugguuuuuguaacaugcaaguauaaugguuauuuuuuauuuuucuuuuuuuucuggagcggaguuucacucuugucacccaggcuggagugcaauggcgcaaucucggcuuacugcaaccuccaccucccagguucaagcgauucuccugucucggccucucaaguagcugggauuacaggcacaaaccagcacgcccagcuaauuuuucuauuuuuaguagaaacaagguuucaccauguuggccaggcuggucucaaacuccugaccucaggugauccaccugccuuggccucccaaugugcugggauuauaggcaugagccaccgcaccuggccauuuuuaauuuuugaaaagauaacguugcacagcacugcaaagcuagauuuauuaaauuaaugaaacacuuaucuaguaacuauuuucaaaaccugauuaacuguuuuguccuauaacaaauagugauaguggcuagguauggugguucaugccuguaaucccagcacuccgggacgccaaggugggaggauuacuugagcccaggaauuugaaaccagccugggcaacacaguaagaucaugucucuacaaaaaauuuuaaaaauuagugggcaugguggcauggggcgauagucccagcuacuaaggaggcugaggugggagaucacucgagccugggagguuaaagcuucacuaagcugugauuguaccacugcgcuccagccuagagugcaugaaaaaacuuuucucauguaccuugucucaaaaaaaaaaaacaaaaaaaaaaagaaagaaaagaaauagugauaguaacaagugaggacuccauaaaauguuuagugaaguuagaucuacuuugagauauggguagaaaucuagucuagaaaacagaguaguuuaaguuucauggaucuugggguaauuucuaaugaaaggaaaggcaggcacuucauugaaaaaccuaaguacaucccuuaggaucugcccucuaggauccuggcuaugaccccauucugcuggaaaccacgcggacaggaaggggccuuuaccugaguggcuugugccagggaauccugagugacuuuggucaguuuccguagauaucgcccauaaauuacagcaaugauugacacuggaggcaccacgcucaaaacaaagguggccagauuaggugagacaaaaaacugucaaaaacaaaaaaaaauucagagguguuuguuacauuggguggcaagacauucucauuaccuacgaaaggggagugugugugugggugugucuguguguguguguguuuaaauuaacagcaggcuugaagguacuguccccaaguuguuacauccuguuuugauggaauuuuucagacaucuuuauucuucacaaaaccccauaaauauucagcaugccacauagaagaaaugugacaagaaauugcugaagaaagaauccucaggccaauacuagaucagaccacgcgguuuaacaacagagugggaagagacaggauggggguuuggcagaggcccauucugcuccacgcuccaguccaccucaggaguuguauauucaggucugaaccaccugcaggcacugaacaaccacagcaacacgucccaucaaaaugaccaagauggugaagucaccaaaaaaccccauuaucggguggggugugguggcucacgccuguaaucucaguacuuugggaggccgaggcgggcagaucaccugaggucaggaguucgagaccagccugaccaacguggugaaaccccaucucuacuaaaaauacaaaaauuagcuggguguuggggcacgugccuguaaucccagcuacucgggaggcugaggaaggagaaucgcuugaacccgggagguggagguugcagugagccaagauugagccacugcacuccgccugggcaacaagagcaaaacuccaucucaaaaaaaaaaaaaaaaaaaacagcacauugcauaacagucaacagaggacuuggaggacacaacuaacaagucgaagaagaauuagagcugcuuuuauggcucaguggacugaagucagcaggauggaucugggcucaauauacugaggagcuucuagcaauuggaauugcugaaagaauaaccuaacuucuggaaguaaguaacagaggguuuuccugucaacauugcaauuuggugauuguacuuucaauaguacuggcaucucuucgacaaauuacuaaaaucuaccauaucucauuugcacagaaaauaguauaaucaguacacggcuaaauaauacuaaggaaaaacugcaaacugaaacauaaguggauggaucaaccaaucauucacucauucauuuacucauucaacaaguuauuacugagagcccacguuacugagugcaagcacuauuccaggcaccugggagauaaccaacccucacagaguuuucaugcaagaaagaagaggugagacuuagauaauaaacaaguaaaagaaagagaaaguaucacugcagauguaacacaaucuuggaagaccucucccccaagagggaagagccauugcauaaaggcccugaggcagaaaggagguuggcaccuucacagaggagcaagcagaugugcauaggaaugucccacccugagaagacaaguccaucaggacaccuggggugagucuuggggaacauaaucauaucucugauggucaccaucaggacaugagaccaacagggcaggucuaacacuucuggggccugaacacaacugaugucaaaaugaaccaacuggacagguguccucuguguagggcaggcacaguccaucaagauucuccuagaacuguccagaaccaccccccucccuucacucugguuccacacuuaaugaaaaaccuucugaugacuaauacagggugcuggcaccauaaugaaguguuuugaauagcagaaaugggcuaggcauaguggcucacgucuguaauccuagcauuucgggaggcugaggcaggcggaucgcuugagcccaggaguucaaaaccagugggcugggcaacauggugagacacugucucuauaaaaaauacaaaaauuagccgggcaugguggcgcacgccugugguuccagcuacucaggaggcugacgugggaggaucacucgagcucgggaggcagagguugcagugagccaagaugacaccacugcacuacagccuaggcaacagggugagaccuucucucaaaaaaaaaaaaaaaaaaaaaaaaaggaauagcagaaacacaacuuaaugguggguaggcccacuauguaaauuaauaaauuggcaguaugccauacacaauaucagguucucauaacuggacuuccccuaugucagguccaugaguuugugcaggagaaacaaagucacauuucugauccccuagagccaaagaucagauccuaggugaagccacuuccugaggcccuuuuacagacugaauggaaauucccccugaaauucacauguugaagccuuaauccccaccauggcuguauuuggagauggggccucuaagaaaguaacuaagguuaaaugaggucguuaaguguggggccaugauccaauaggauuaguguccuuauaagagacacuagagcacacucucucuccacuaugugagcacauggcaagauggcagcugccuaccagccaagagaaaaggccucagaaugaagcuauuuugcuagcaccuugacccuggacuucuaaccuccagaauugugagaaauacauuucuguuguuucagccaagccacaagaaaaggccucagaaugaaacuauuuugcuagcaccuugacccuggacuucuaaccuccagaauugugagaaauacauuucuguuguuucagccacccagucugugguauuauuauggcaucccaaacagaccccuuugaauugcucaucugaccuacacugaauucccuuuccuuguuacaaaaaguaccccaagugauuuuucccagcuugaacucuuccugauccccaaaacuauucauauuuggaaaacggcauguuagugcaggaaggguccucuuccagagguuugcuucucucuuagcuggaaaaucaugagauuucaaagcuguuuuucauuccguaagucagaucuaauaggcaacacacccuuccucucuaagugcuucaugggacacaaaggacagaauccaagcuuuuccacuugugagaaaggauuauuuacaguucuuauuccacgagucuagaacugcacugcccaaaacgauagcccuacuggaaacuugaaauguggcagguaugacugagacauugacuuuuuaauuguauuuagguuuaauuaaaauuuaaaagccuauacuccauucaguuauuggcaaacuauuaaguaugucuggaaaacuugaguaugucaaacuacuuuuucaauuguacauuuuauaaaaucuaaauauagaucaaguacuuucaaugaaaauuuagcauccgaauuaagauguuccuuaaguagagaauacacaccagauuuggaaauucaguugaccuuugaacaacauuggucugaaaugcaugggucaacuuauacauagauuuucuuccaucucugccaccccugagacagcaagaacaaccuuucuuccuccucucagucuacucagugugaagacaaugaggauaaauacuuuugugaugagccgggcgcaguggcucacgccagcaaucccaacacuuugggaggcugaggcaggcagaucacgaggucaggaguucaagaccagccuggccaacauagugaaaccccaucucuacuaaaaauacaaaaaaauuagcgaggcgugguggcuggcaccuauaaucccagcuacucgggaggcugaggcaggagaaucacuugaacccgggaggaggagguugcagugagccaagaucgugccauugcacuucagcccggaugacagugcgauacuccgucucaaaaaaaaaaaaaaaaagcuuuuaugaugauccacuuccacuuaauaaauaauaaauauauuuuaccuuccuuaugauuuucuuaauaccauuucuuuuuucuagcuuacucuguuauaagaacauaguauauaauacauauaccaaauacaugguaauugacuguuaauguuaucaguaaggcuucuggucaacaguaggcuauuaguaguugaguuuuuagggagucaaaaguuauacuuugauuuuugacugugugggcuucagugucccaaccccugcauuguucaagggucaacuauaauaugaaagaaauaauauaaaauaccucauuaauaauuuugauauuaauuacaucuugagaugacaauauuuuguuuauacuggcuuaaacaaaacauuauuaaaauuaaucucagccagguacaguggcucaagccuguaaucccagcacuucaggaggccgaggcaggaggaucacuugaggccaagaguuugagaccagccugggcaacauagagagacccugccucuacaaaaaauauauauauauauucuuuaaauuagccagacuugguggugugugccuguagucccagauacuugggagacugaggugggagaaucacuugagcccaggaguuuaagacugcagugagcuaugaucuugccacuguacuccagccuggguaacagagugagacugucucuaaaaaaauuaaaauuaaaaaaaaaauuaaucucauuggcuucuuuuugcuuuuuuaaauguggcuacuaaaacauuaaaaucacauauguggcuugcauugccucuccaaugaccugcagcacugggcugaauagaaauacugguugaagagguaaggcaagcagacaggacaggcacaagccacccaguuaaggaaaggaaaaaaggccaugggagugaagagcucuccccuuaaaagagcacaguucgacuuacacacacagaggaauggaauuuagucaccgcuuggugccacccacaggguaguacccagugcuccuucuaccugaugcucuuuucugccuuaauaccccggguacacacaucucagaauacccagcaguaacacaugaguccauuuuccagauaaucacucauucuggagaaaugaagguacaagaggccaugcaggcagaggcaauccccacguuccagcagcuucugcaacagcacuuuuggcucuaggcacuuacagaaugaugcgaaccgcucagcuugagcucgucucacacgugagaggccuggugcaagccaagcccuggcaggaagguaccaaggggaaccaggcccacauaccaucauacugaugccuacggaagccugggccccggcccugagcccaucugagagguuuucagucacugagcgccccaggagugcagugucugaugagaggcgguuaaucaauucuccugugcgagucuugucaaagaaagcaaccuccugccucagaauggaggagaauaaugaaguucucagccuauucacaaugcgcugaccugcaaaagcaaacacgaacaggcucaccaaggguaaagacauccauuaccauuauggggcagccacuuacugugcagcagcuuggccuggaguuguaacccuccugagcaaugcagccucugagcgugucugcugcacuguaucccauggguggaaagagacuuucccaaaccaggcacauuaacugucaugcacuacuaacacuacuuuucucuuauuaacuacagacugugggcgcuagugagaggauacaggaauaaaauaaauauaacaugacucagaggccuuuuuuauuuuuacuuuuuuuuuuuuuuuaagagacugggucuugcucuaucacccaggccugaaugaaguggcacgaucacaguucacuguaaccucaaccuugugggcucaagccauccucccaccucagccuccuggguagcugaaacuacagauguccgccacuacacccagcuaacuuauuuuuauuuuuuauauagacggagucuugcuauguagcucaggcuggucucaaacucaugggcucaagcaauccuccugccucagccucccaaagugcuaggauuacaggcaugagccaccacacuuggccgagauuuuuuuaagguauuauuuacaaagaaguuuuauuacauuaacuuccaaaagcucauuuuguuccucccuggaaacccuuuccuguauugaaccuucaaauggcaagaauugguuaauuauccacagagauaaauggagagcaacagacuucgaguuggugucccagguucucucauuauuguggcagugaccugccuguaaaaacaagaccucuucagagaaauacuaacaaaguuaucaucccagcugcuacuuaaggagaaacacaagcauggggcauguaaauggguuucugaagccuucaggaagccucagaaguccagcuucauggccaggggccucauuuucuuuuuuuuucuuuuuuuuuuuuuugagauggagucucgcucugucccccaugcuggagugcagugguaugaucugggcucacugcaaccucugccucccagguucaagcgauucuccugccucagccuccugaguagcugagauuacaggcacacaccaccacgcccggguaauuuuuguauuucuaguagagacgggguuucaccauguuggccaggcuggucucgaacuccugaccucaugauccaccugccucagccucccaaagugcugggauuacaggcaugagccacggcacccagcccgaggggcuuauuuucaaaccucccauaagaccgacaugauugcccuuacagcucaacuucaacuauaaaagaagaguugagagugcuugaucuaaaauaaucuguaacuccaacaucugggcagucauuggacucuauccccacuuaaugggaugccaggaagagaggaagagaauggagccuggagcacaugagauuugagcccgaacaaacccacaggacucuacaucuucuucaggaugacucacaucccugagaggagagacuguuaccugaaguuugcaugagguagacacgaauggcauuggcggcagcaccacacagaaacacggcacugagcccuaggcagaggcgggucagguugucgcuguaguccacagugggguugguauagaugacaucaaugaucuuccccaggaagaaaggggcagacauggagauaacacuggacaucgugagaaauccaaccgcagcuagaaaacacaagcacucucaauguucagguugcuucagcaaaggggcugcggugcugaguccaggaggcuuccuugccaaauaagcuguugucagaguaugcguugaucucagucucuagcaguuuccucccuuuugcuccucgaucucugacucaagggaagaaccaaaugguuccaggugagaacaagcagguugacuaaggaagugagugaucauaucugaaucagagaagaugacuucuuagucugaucaacucuuccucaccaagaaaaacugggagccaacuauggaaccguucuggccagccccuuccuccccaucucuugauuuugguguucaucagauuguauuuuuccuccauucaugcuauacaugcuauacuccuuggcaucuaacuauauuguaacuugaagaucaagcugucuaguuaaagcccuugauuacaucuaguaucucaaaacacucugucuacggccauacacucugaacgcacccaaucuugucugaccucagaagcuacgcagggcgaggccucacuaguacuuggaugggagacugccugggaauacaaggugcugcaggcuuuaaacaaacaaacaacccauuccagauaacuuuuggaaaaccguuucacggaucauuacacagaagcaaaugucaauaaaacaugugauauauugcuucuuaauauuguauuauugcuuugcgaaauaucaacaugauaugaaaauaaauaugaacaggauuguucaugcaccuaaaaaacaggcaaacaagauagagucuuaucugaagagaaaauauuggcuuggcacaguggcucaugccuguaaucccagcacuucaggaggcugagguggguggauuguuugagcccaggagauccagaccagccuagacaacauggcaaaacccugucucuacagaaaauacagaaacuagccagggugguagcaugcaccuguagucccagcuacucagaagccugagguaggaggauuacuugagcccaggaggucgagacugcagugagccaugauuaugccacugcacuccagccugggugacacagcaauaugcugucuccaaaaaaaaaaaaaaaaaaaaaaauuuuagaaaauccacauaaauaggccagguaugguggcucacgccuguaaucccagcacuuugggaggccaaggcggguaggucacuucagcucaggaguucaagacuaccauggccaacauggugaaacccugucucuacuaaaaaaaaaaaaaaauacaaaaaauuagccagguguguuggugcgcaccuguaguccuagcuacuugggaggcugaggcaagagaaucgcuugaacccaggagguggagguugcagugagccaagauugugcugcuacacuccagccuggaugacagagcaagacucugucucaaaaaaaaaaaagaaaagaaaagaaaauccaauuaguaacaacacauaucacagauaacugcauucauaauaagacaaaugcauuuuuuuaaaagauagugaugggggucucacuauguugcccaggcugguaucaaacuccuggccucaagcaguccucccaucucagccuugcaaagugcugggauugugggcaugagccacugcacccagcaaaaaguauuacuguuauauaaccuuaauaaagaguccagagcaaacucagugccaacuggacauuuagucgacaaacagaguucuaggaaaaacaugggccuuuuuaaguggggaacauuuagaaaaauugcucuugccccuccuuaaggucuuuauaaaguccccuccccaaaaaggccugcucugacagccucacuuaaaauacagacacccuacacuacccaccucacucccucuccauuuguguucucgaagcuccuaccuuucagcauucuaaauguuucacuuguuuauuuaguuucucucuccauuaggacauaaaagauuuuggucugcuuugucacugauugccuacagugacaggcacauaggagaaucucaaucacuauuuuguuggaugaacaaacaaauaaauugaacuuuggcaauggaagcaauaacgucuaucagaucaaaauucuucaauagccuaagcagaaaugugaauucuggcagcucauaaaguccauaugccuggcuuaaaaucccauaaucacaaucuaacugaauaauaggaagcugggcaagggucacuucauuuugacguaaagcccggggucuuguuucaaagcaccaugcuucuuacaacagugcccaaaggggcuugaaggcccaaaggacagggagugugucuaacuugagguuccgaguaccucagccucgaugaacuggcagcuccagaaagagucauccuggcaaauucaggauucagcagaaaauucuuuuuguccuucaucaguagcuaaucucuguucuuucgccucagugaauaauuccgaaagcacaguguaugugaccugcuauauaaagguccaccucuucccuccuccucuaguuuucuaaaucaguuaugauucuacaauacgaauccauaugacaugaaugaaaugcccccuaauuaugauucugagucuuguucucacauaguaauaaugcugauuacaaagaggaaguaauuuagcugaauccaaauuaauuucaggauauccccccacacuuuuacuuuuuaauaaucauuuaaaaauuaucagcuuguuuuauugucauuugcuucuuuguccaauuugaauguaagaaaaguaaaauauuuuuuggcuuuuaguuaacuggauucuuguuaaucaagaucugacuacauaucacugucuucugauauuaaugaauacuuuagacuugcuccauaaacaucauuucagauuccaccacaagcccuggacacaacugagcauacugcaauucugaaauucucccacaccuuuucuccauaguuaagucucuugcuugcccccacccuugccugaugcggccccagcaacuucucccauuaucuauuucuugacagauaccuucaaguaucuuuguuaccucauucuacugaauugcagcaaagauggaaacaaauauccuucaaaagaaaggggaaggaaaaucugaauugcagauugcuggacaacagcgcuggauagaagagguugggggugguuggaggaagcuguacacugugccuaccaccugcccacugcugaacagggcacccaucugguuauaucaggcagguacagcaauccccacugucauucaaggacucaaaggcagcacuucagaguccucaccauuaucugaaggaucuggcauccaucaucuuaaauccucccuuucacccucaucuuauccucguuuuucagagaggaaucucgaacacagagagagggagccuacgcaaggucucccaauuuacacaucacagaaccacauucugcgacaaagccugucuuuggcaucuucccacaucccaagcagaggaagaggaagcacaggccucaccuuggaaucagggaagggagcagaaagccuggcaggauggagcaggggcagagaccucaugggugcacaggaaggagaacugagaaaugaaaugaagccucuagauuauagaacagaaggauuuuguggcaaggucggccuaaaagggcuuuacacuggggaaugauccagccagauuugcuuuuuuuuuuugagauagaguuucccucuuguugcccagugcaauggcgcaaucucagcucacugcaaccuccaccucccagguucaagcgauucucccgccucagccucccgaguggcugggauuacaggcaugcgccacuaugccuggcuaauuuuguauuuuuaguagagaugagguuucuccauguuggucaggcuggucuugaacugccgaccucaggugauccgcccgccucagccucccaaaguacugggauuacaggcgugagccaccgcacccagccagauuugcauuuuuaaaugauccacucuggcuacagagcgaaaggagcagcggacagagcacuguucuagugcccuaggugagaagcaaacuuagggcgaaguaggcuggggacagagggauaaagggcagaguauaggacuacagauauuuuuaagaacuaggacgugaugacugguuggaugugagcauuuuuccucucugaaaaaugaggauaagaugaggguuaaagggaggauuuaggaugaggaaugccuaaccuaggagggccguuuugagguugaguuggucagcauugggucggaacccugacgaacucaaccucagaaccggcccuccuagguuaggcauucguuaucuuaaguucuccuuuuaagcucugccaucuagcuguuugaccuugcauaagucacuccaucucucugugcccaguuuccucauuuguaaaauggcaauagaaacaaucccucccucacagaauuaugaguaaacuacacacauauucaaagcaucugguacaaugcccagggcugaguacacaagaaauauuaacuauuaucuuuauuacuaccauuauaagaacaacccaugucucuggccaaggccaagagguucgcacugcagucucucucacugaaccaagagacagaagaggaaagaugcuuugcggagaaagguaacuuugguuuuuagacauguuugguuugcuggagucugggacacauuuccacggaugcaggugggugugauggagaacacaggaguugagggugugggggagauggaggcugagugaagagacucggcaucugcgcuggguagagaaugagugaggacaugagcggcugacagaugagaagggaguagaggaagaagccagggacuccagguucuggaaaucuggagaagaaagaucugagcccccaugugucuggugcaagaucagacugucucuguccaugcuauuagcaugcucuagaguuaggaguaucccaaagacaaaauuaaaauaaaacaguuagggguaccugucccaugaaccacaggaggguucgccauggacucuaacagacauacgaugggagccaccuagguaauuuaaacuucucuaguugccacauuauaaaaaggaauacguaaaauuaauuuuaauaacauuuuacuugacccaauauauccaaaauauuauccacacaugaucaacauaaaaaauuaguaagauauuuuacauuuuuucucuacuguccuucuggaaucugaugugacagcacagcuacagaaugcucaguuucgcugaaacaauguauuucuguagcacacgcacaucccuggcuuucgggggcaguuccgauuucaaagguucauccaucccagcccccacagggcacugucccugcgggaucuccauccucacugggcuucaggaaguagcuacucuggccuccuugcccaccauacccacugcuuuugucacuauauucacuguggucacucacggcccaucuucauaaaaugcaacuacaaacucagcaaaagcugccagcaggcuucagguucucagagcaguccugcccucaaaccacacaccagccccuuaucaguaacugcagugagaggagcccuccugaguccuccacacaggcaccaacugaacaugccccagcggaggggauacaugugugcaguccacaguuuaaugaaggcaugcugcccaccccgccgaagccccccacacaaaaaaccuccaggaggcagcuuugcccuaaucucacaguacuguaggggcccacauuugcuccuaaaacccugccccuaacucacucaggucagagccucaucuaucugccaggcacagccagacgguucugaugaagugucgcuuaucccaucaauccacacccugcuccuccucaagcaccugcaucuuuuaagaguccuucuggccaaagugauacgauggagaauuaucagugaaaagggaccuuacaucuguaugaagacagcugcgaauuccuccccaaaggggcggcuuaggccuuccuuuagaagaggaauguaacacaguuaugcuaaagcugcuuucagcacacgucuguacauauuucaugguagacuguguuuuuaaaguuucugaugcaaucaaaguuuucuguucacacaguuuaggaggcauacccagcaaaaugcugagacagauggagguauuauuauuaaaauauaaagcugcauuuuugaaaaaagauuuuuguauuuuucuaaaaauuaacaaauuaacauuggaauuccuuuucagcucagcuuuuuuaguguuuugauuagaaaauacacacacgcaauugcucuuuaccuccagcauuucaaagagaugugccaacaccucaggcugcucuuagaaugauaaauuacacauuuuuuuuuaauuacaaauuaacaaugaccaccacuuccucuuaauccuaacuggcuuuaauauauaauaacuucucaggaaaucauacaucuaaauaagggcuuuuuaucagauauccuuauccucauaacauacaauauguauuuaucuguuugaaaagcaaaaaaaaaaaaaaaaauagugugccaacccuaggcuuguuucuucaaauuauauauucauaauuucucaaugugguggaacaaaauauauucuguucuuaaaauaaaaagaaggccgggugcaguggcucacaccuguaaucccagcaccuuuggaaggccaaggugggcagaucacccgaggucgggaguucgagaccacccugaccaacauggagaaacucugucuccaaaaauacaaaauuagccggguaugauggcacaugccuguaaucccagcuacuugggaggcugaggcaggaagaucgcuugaacccgggaggcggagguugcggugaggugagaucacgccauugcacuccagccugggcaacaagagcaaaacuccaucucaaaaaaaaaaaaaaaagguacgagcugggugugguggcacaugccuguagucccaacuacucaggagguagaggcagagcugcuugagcugaggaguucaacacaagucucagcaacacagugagaccccuaucccagaaaaacaaaagaagaaagaaaaaaggaggcagucucgucuuguuuaaggcugucaccaaaacauacuagcauggcaggauaucuggggacagagugaggggucacaggaacaauggucauggcauaagaggacugggcacguguaggccaccaaagccugacaccuaaacacccuuccugacaucuaguauuucagaaacaaaacagaacuggauuuccuuacacuuacuuugagucacauacagaaguggugggcgcacccgaugaugcucaggguuucuaaaggccucacucugugccuggugguauggucauuuauuccuucacugaaggcacucugagcgccugcucugugccgugcacaugcuaagaacuagagacagaaagaugaaucgcacaguccccgucucaagcagcucaaaguccagugagagcuccuagucuccaauguuuuuaaaaagaggaaagagaaaaagauauuuuacaacaaaaucuacacucaaccaacugaacaaugaaauaauucucuuuacacccgagugauaucaacagcccccuaagcuuucauagcaacugguagaugaaaagucgccacccuaacugcucuccuccacugugcaaaccuacucuaaaucccaaaucacuacccaggaggguccuuucuaaagcaauggauuugcagcaaagaaugcuuuucugguguugcaccugacaaccucacaggccccacaggcccccuuccacagcccacaggugcagguuuaccucuauacauacgaauauuucauagaugcuucuccccacuaaccuagaagccccagcagaagugaggaccauguuuccuugugcaugccacuguaaacccagggcccaguccagaaugagggcucaacagauguuuauagaaggagugaagauuuagagaaaucgaaaaaauuuuagaucuuacaaggcccuugcaucuaaacacuccuccaauuauggcuaaaaaaugaggagcuauagaaaacuguccuauuuaaauuuuguuucuaaaaacauucauuuuggcuucuuuuaaaaaaguuacucaauuacugaacagaucacugguguggccuguugaacacagugcuguaacuuccugcacaagagacaagucugaaaguuuugcuuuccgcugugaaagcauuggugacugcuugacagacucgcuugaagcaaauaauguguuuuugguuaaaaaaaaaaaguauaaacgccuaauaacaaaauaggcauauuuuuggcuagaauuuuuuuuuccaaggaaaaaccuccagcucauuuugcugccuaagccaaaacagaugcucccacuaaguuggugguggaacagacccaaagauuccaauaaugacauauauaacgugugucaacaagaaaacaaguguaaaaucugcaaacgaguccccagcuaaggcgaaaucuugacaacgcuacucugaggugagcgauccccucccuccuccgggguuaggaguggcccaggagaggcggcggugacacgcgcucugcggcccggccgugucccucucggcgccccgggaccccgcguguggagaaggagaggcccggcggagggaaguggccggggaggacccuaccugccagccuccggcgcucaggguacgccagccccaggagcuuccgggccuccgggaguccggccgcugcggggcgcagccgccccuuguccccgggaggcgccgccggcccgcgccgccaggccucguccccugcccaggcagcggcugcgggaccgcccgggaaccgggcgcgcgggagccgaggagcgccuggcccggcaaaagccccgcaccugcagcugccggggccgcgagcccacagccccaggagccgcgcgaggcccaggacgccccgcgaggcgcccggacccccgccccggcagccgcuccuccagcggcgcgcggcuccaacgccccagagcagcgcgggccccgcgccccauagccgcgccggccucaggccagugaacggcgauagggacccgggaacgcggcuggccgcggcccacacgcaggcuaccggcaggagccgaccuggcucggcagggcucgguggcucgagcagccgcagcggccaggcaggggggccucgcauggcgcugcgugcgacccguacgccucagcccgccggccaggcg

SEQ ID NO: 192001 - RNA, 214920 nt, Homo sapiens
ccaccgcgcccgcggccggcccaggcagcacucgcgagcagcggcggccccgccggcggccgaguugggagaaugcggcggcgcucgcggaugcugcucugcuucgccuuccugugggugcugggcaucgccuacuacauguacucggggggcggcucugcgcuggccgggggcgcgggcggcggcgccggcaggaaggugaguggagcgcccugccgcggccgggccccugcgcccaccccccacccugcgccccuguccccugcccucuccgcgccgccccugcgcuccuccgcccggaccuccgcucgcgucgcccgcccucgucccgggccuccgcgccgagugcccagggcaggggugcacccggccccucugcgcacgccgggcuccgaaagggcggcccccgcagccuuucucugcccccucucguggacgucgccccucucucugcucgucguaauucgagucuuguccggccgccgggagccccauccccugcgguuggaaguuuagggauggggguguugggaaacacaaaggggguggggaggagaggagagagaggcgaccgcuuuuccaacgcgucauguacagcaggagagaggaguccaaguuucuuuucagcccuuugauaccagcggcugcaaauccucgucccuuucccccugucacuccgcggggcguggguuccguguuucugccaccuucuuugcccuuuaccuuuggggggcaggggcggccgcucccgugccaaguaaagccccagggcccgugcgagccaggggccagugcgccccugcgccccgagcgaggccagucccggccguucccuugcggccccagcguuacccucugcccaacccggcccccggcccucccgcgcgagccggacguggccuccugcgcuugcauuuuccauccccacuccccgcuucagggagaaucccucuucuguggcuguguuuuuaacaugcuccaggggccgagugaucuggcuguggggaccgugugagccgcucugcgguuccgcguccucgugccgccgcuccggacggccgggcccugggcauucgggaggauggugagcgccgagaggagccgggacagcgcgguccugcggccgagcgccggccgggagagcagggcgucgggcugugugcuggagcaugccggcaggggacguuuguaguguuuuacuggcuccucggcuuugaaagcagcguuaucuuuuccgaauuccuguaacccucguuacugugacauuuagugucaccgcaaacccagaaaauucugaguuaauggagauggacuacgggugguuggguuggaacaagagagugguauccugaaacaagccagagggaacuaacuagaugaacagacuucaguucugaagucagaccccuaaauguccacgccgggguuuggcugcuucagagguuuuuucuuugcuucauucauucauucauagccgaagauguuagguggaaugggugccuuaugugguuucugguaaauuacguggauuuguuuuaucuagaagggcagaaauaaagcccucuuuccacgugcugaaucggccuagcuucugagcugacauuguacucuuagcguuguuuuuguaaaaaaugguauagguaguauauguacgcgaagacuugguuuauucuugaacagcaaagagcaugcaggcagcaaaagccgugcaguccauucagagauauaaucguguaaaacuggaaugauuuuuaaaacuuugcuucccgguaaacugugccuuggccacucugcauagccuggugugcuggugagaccuggcaaagcuuucugccuuucaugcaaagaaaaccaaacacauaagccacccuuggcguuucucuuuccuuagucugccacuuucauuaguacacgugauuagaaagagcaagcgugcucguucgccucccggaggcugauuccucacucuggugggcuucaguuccuggauggugugaggggucuuccaugcagaagucuucagacacuccugaagugugugauucuuaguuuguuuuuuuuuguuuuguuuuguuuuguuuuguuuuuuuuaaagaauuccugguggcaauauagacagguacggagaccagguagaaaaagugggggaaaugaacaauuaauuacacauggauuggugauuugggauucuauucuuucugucaacgaaccauaaaauuuaaugcuaccccuuaggaugcuuuagugauuugucgguugaggaagagguguguaaaugcaauagcuuuugaaauugcaguggaagacucauuaacuucgugugguggacccaggguuaaagagaagccuuaagaugguuucugaaggagguaaauagagcccugcugucacgaaugccugauguauaggaaaaucguguagucuucuuucuuccccaauuguuuccauggauuuagacacuagaagugucucuaaauuuauuucauucucauaccaaaaaaaaaaugugguuuguuuggcuuguaaaguauggacauaaaaaaagauagcgggccaugcacagaaaggcagaauuuaaaagcuagcuauaguuuuuuuagagauaaguggaccuauauuuuuucucuugccucauacuguucaagucagggcuuuuauuccauauuuagccaguuucugcacauccugacguuuuucauaggguacuaggcugcaguauugggcuuuagggaucgucugaggggaguccaacuaggauuucugcugcuucagcagcccagcccaggcuugucauugugugcccugccuguuaaguaacucaucacagaacuguuauucuccacuuggcaaaacccagagagccagcucaccucagauugcagguuuaguaaacuaagcaggagggagugcugaagaccaaucucaggcacugccgcacaacucgggacucaacacccaggcucaggacauguauguuaaagcaguuuauucaaaauauuguuuaaaauuauguuucauuuacauuuguguccauacccuuuccccccauauuuugcucuuucccccuaaauugaugauuugcacuucaagcgugccuuuccuuugagcuucuuaaaugcuuuaaaauuuuaaccauguuaagucuccccugggcuuugguacguuggcaguggauggagccgcagaagagaggaagggauuucucuggaaaugaagcugccugugggugaaguguggcuguuuaggguggaaagggaaggguuuucucucugcuguaagaguguguggagccugagaccccuugccugugugccugcaugcugggagguaagggacgguguuaguugagggacaugauccggagcccugggagccuguccacuuugcacaguagcaucacccuuauucccugagcuggcacgaguccuguggcccuugcccgagaguccaagggugggggacuuugggugggaucuucuaggaaucaugcggggaggcgggcagguuauuucuuggaacagugaaggaccuugccgggcuagaccaugguacacauggaggggaacguuaggguguaaaguuggagaaauucagaacuaaauuguaacgggcuucaaaugccaagcugaaccauuugggaacuaguaauguuuuugagcuaguaguagacauuaaagggaaauggcacaaauccacuuauuggcauugagugagaccuagcuguuuaccucuuugugcuuagugaccuucacugaugcauugaaccucucugacccucaguuuccucaucuuugcagugggaguaaucauucuuaccucauggccuuguucggagaguuaaauacuguuagugggugcugaauaacugcuaucucuaaaagaggaaaaugaaaaaauaaaagccuaaauauccccuugaaaguguagugaaccaggaaucuuaaguucacgguauuccugauacaauucuugauuucuggaaaauagucgucuuucuuuuuuuuauccguuacccccaccucugagauugaucugacugguucauuugggguuugggcuaugaaucuuaaaugcuguuagagacggacuuuuugggaaguuguccagacaccaugccagcucucuuguacccaauuguggugucagaauggggaucccaguagugggcagccaucgggaauguggguggagggugcagcuugccuuggcgguuaggcaguuguaguguccaacaguggacagacgugucccugaacgagggguuccuguggugggaucccagguucugagcuccacugcucucccucuguagcccugccccucuuguuagaagggcaggucgcugugaucccuggaagcaugcaugacuugagguggagcauggggcccucacgugguuuaaugggugccaaaaaucugugagcaucuugguggaugcggaggggaacacccauaccacuccuugccaccuaucaucaguuuggaguuuaaagaaaguccacuucaaaugagaguuugaaguugacacagggaggacaguagcagggaaaaccacuguauagccagauaauccgacaguggcacuguaacauaaacuucucucuuuaaagaaaauaaaguuucccaauucuggagugaagcuguggcugccucugggucagcaaacauaauggaaacagauugugugacugcugaacagugcaaaaguaacgagcucuucccuagacccuugagcaaaaaugaaaaagcaacugcuuuacccagcacugaguggggucagcuugcccaggcucuguuggaccuuggggugggggacaccugggaggcuggugaagguuuuaugagucuucagacccgcugucaguuuccccacccuagcuccuguuuggaugaaugaugggugagugguuggucuccuguuuggaacagaggaagagguggucagaaaaaugaugggagagggggugggggagauuggguuggggaagacauaauuucuucuugcuacugcucauguuucuuagggcuuuggggagagggaagucaguuugggaagauacugauuuuagugucaaagcaggcaaggccacuguccugccuaacuucuagcaaguccagaggcagugggcuuagugaaagcaggugugguggggcggggguggcggggggugcggugaggcugccugggacagagacacagguguaagcaggagucgacugugaggcucuggcugagaucccaggaagggaagcuagguauuccugggaaaagccugugaagucuccuggagugcccagcagaauucacgugaugagaaaacacacaaaccuggccaagucuaugcucccuguugguuuuugugcuuuuguccuugugaagccucuucuggaagcucugcaugggugaugcugagccguacaagucaguggauauccagauggaaacacacuggcuuagccaugccacucacauguaacaguggggcacuuccaugcugguuguuaaauaugcucugccuugagacccccugagugcccuccgguuccuagcugcccuggucuuuccuugggaucucuuucccauguucagcaaucaaaggguugaauccugacacuugaggggccucuuggacccacuucugugccugugccauagugaacaugcugauugucaccccugcaaaugugccacuuggauagaaggaggccuagccccacuuccaugaugggaacaaucccuuuucccucugaguaagucuugauucacuguuacuguugagaguucugguuccaccauuguaaucuuguggccuugccucuagacugccuuaugggugagguguuuuuaaggaggagggaugucuugguacuuccauaugcaaaccccccugaaugggucugggauaggcugggccuggcggggaacucuccucuauggagaauuacauugaauucauugaugugugcucaccagugaucacuccuguccuuagaguggaacuugaccuuguucucuuaacagugugaagauuccuuuaccuuggcccugugcuugaucuucaugaugaacccaguauggaguuggcaggaaagcugucuucagauuaccugcccaguccagaaagccucucccaccuuucucuauuguaaaccauggaaauaaaaggggcucaagacacuaauccaucuucccugaugggcccccaccuuucuaggguucccugcucuaagcagguggcacugugcuccugccuggcucuugccuccugcagcacagggugaaacacuggcauuuuugcacuuagucaugucuacuaguaugggccccagaagcaugggguguuuuauauggauuagguuucuuagcaugcugaaauguagaugacagugauucaucagggccggauuuggagauaaacaaaaacugucacauagagucucacucauaggcuuacauuuaaaaagcuuucccaggcuaugggaguuauaugagccccuugucucacugaggcgggcugucacaaagaagcaguuaagggcuggcugccugggggcugggaaaugggccgaucccucauggcucagccugcccuugcuggcugcuugcccuggucaacugucccuucugccgcagccuuccaggagcuccccauggaacagagagucucuccuaggccacucugcugaccaccuccuccugcccauggcuggcaguuuucugucccuaacucuuagggaagaggaauggccaggaggguuggggguagaguuacugaauuuccagaguucaggucaggacaugcauuugggcagggacaaggguacuuucgggacugugguugcucugguucaguuucuuaacucuggcaccauugacauuuuuggcuggcuuuuuuuuuuuuuuaagacaguuguacucugccacccagguuagagcucagugguacaaccagagcuaacuguagccucaaacuccugggcucaggugauccuuucaccucacccuaccgaguagcuaagacuauaggcaugugucaccacagcaggcuaauuuuuaaauuuuuuguagggacaggguuucacuauguugcccaggcugggcucaagcgguccuccugccuuggccucccaaagcauugggauuccaggugugagcgacugcacugggcuggaucauucuuuguugugcaaggcuguccucugcauuguaugauguguagcagcuuccccagccucuccccacuagaugccaguaguucucccaccccugaucuuccaaguuguaacaaccaaaaaugugcagacauugccaaguguccuggcgagggugggaggugggcagaauugcccuugguagagaaccacugccuuaguccguuaauuuugauuucauuccuucugucugagccauuaugguuagaccuucuuguaaugagacugccuuucuguguggucuggggugaaccacuguggggagggcuaauauauuaauacguuuuaauuuucaaaauuuaauaaacacuuucauggcacucacugugcauagaaauaaaagggcugcauuucaucucagcccuuuuauuucuucuaguguacugaugaaacugaagcacagaaagguuaagugacuuucccaaggucacagagcucacagguggcagacccaggguugucugguggaagagaucuccucagggccucuggaggcagugggguuuuucugcaacuccuggccgaggguuucugccagccagcagugaaccuggcuugcuccugcucccugggccucccaugccccuuccuugcauuggcagugcccucauacugcggccucauuuggaaaguuccuggaaggcaucuuggagcagaugcacacuugauaaugcuuugauaguagugcuggucuguuuugcuuuuuuuuuuuuuuuuuuuuuugagacaaagucucacucugucgcccaggcuggagugcaguggcacaaucucggcucacugcaaccuccgccucccggguucaagcgauucuugugccucagccuccugaguggcuaggauuacaggcaccuaccaccaugcccagcugauuuuuguauuuuuaauagagacaggguuucaccacccaggcuggucucaaacuccugaccucaagugauccacccaccucggccucccaaagugcugggauuacaggcgugagccaccgugcccggcugcucuuuucuucauuuuuaccuuuugcuccauggaauuuguguuccuacccuccaggccucugccuguccugaaggccgcaauccucagcugccccuccggaaggagcagagaugaaaacuggcucugguucuuuucauuuauucuuucagugaguaucucuugagacccuccuaugugccaggcacugcuugaguguuugggaguacaccaguuguuguagcagacacggaauccuuguggucuuggagcuuucauucuaguggggggcugcggggagccagacaguagacaugaagucaguuacgucgugugcagaaaggugcugugugcuguggaaaaaauagagcaguguauggggauuagggaugagggcggaaggauaguugcaguauuaaaguggugaucacguaggcucauggggaaggcaggauuggagcugagacuaagagggagccauugugguucccucugcuucagagguagccccugguuucaucuucguccagccucuuuuucggugaucucucuacuccuugguuucuuuugcuaaacaaaugagccaguuuucuuucccgaaggauguugccuuugguuggcuagugguggaguuucccuccaugcuguagacaucuuggucaccuguucuuguucuggucuccucgaugaggcaugaaugcauccugguuaaaagguuguguguacucucauaaucgcuucccuuacuacagaccugcagcugcucgaggcaguuuuaauuuagacugcuccagcaguuuaauuugcugaucagcuucgugggauaugcuuguggaacaaucucauuucuugauuccugagcugacuucugugaagcaccaagcaucggguaagucauucauuguuaggugcaccauugaagaacaguacacauucuuaaagugcuuucugcacauauugcuguuuaacgagaaaucccccugggucccugugcaccuuuuccagcacaggauuuccgcugugaugugaucuuugggaguugcugcgggugggagugggguuuguugauucauauuugcaggaaaccagagaucagaugccugccugauacccaggcuuuggagagggggguuauucuuggcaauguggguaacacugagcuucugugauagauaguauuguacuuggggacaguaaaauggagaugugacuucauggccaaucucagggaggcggaacugugggaaguuguggcugguccugguucucaaggugagggcaugcaggugcuuuucauagaggccauucucauuuaugaagggucauuagauauuuuaucggauugguagguaccaaucccauaaaaccauugggaugguuaggcaccgugcguccaguguacuucuggauaaaacaacuggagcauuuacauggcgggaaaaagaacagguaauuugagaggccuucacauucaagaguggccaucaagguuucuuccucucugcgucagagaccaguccagggagugaacucuuuucuuucugacaggcugcugcccuagaaaaaugacgcacuucaaaugaagggucuuucuuagcuaaauugcccugugagagcuugaggagccggugcaaauuaaaggccuguguuuuggagaugcccaugaauuaaguacucuguuaucaguauuuggguaaguguagaugacuguuggguaggggcauuuguauggcuguccuggaugaugagaggguuggcccagugugggaugccucccagucucauuguuuccuccuugcugccucuggggcuuuccccuugaccuagauguugagcuuuugcucugugaccuucaaaaggccugcccugccgcacucuccuuccccuccugcccuuguccugccccauccccugugccagggagcucacuuaguugucuuccugucucacuuuugaucaucacuaauuuccccugugucuggaauacaacuuuuucaucaauuccgagaggccauuauuugucaaacaugccauuauuuuguggaccacuaggaaagaaaaaacacuguccauugaccugugacacaacggguucuuaucaguuggcauucuuauuuucuacuuauugaaagagcucuuucagaccgagacaucaauuuuuccauauaucacucucgggcauagauagauacaaaggaaaauacaagugaaauacauugagcaaaguguucuaaaaguuuuucagaguccaagcacucugagucacuuuuugacucagauguuagugccuauuuucuucaaacagagucauccacugugccaccaaaagcgcuggugauguagcauuuccuaaggaaaaaaauccauaaaaauacuaagagccauugguucuggacuuugaagacagcuuggcaaugaagucgagguagccagccuuugacucuucugggaauuuugccuaacuccucaauucaccauccauuccuaucccaccaugauuugguuuuuagggauuaagagugcuugcuucauugucguuucuuggauuuucuucuaagccauugacguauauguccugcagauguggaugauugagcaugggcugguaagaaugcaucaugggccuugcccagcccauagcauugccgacgucauugauugugagcugcauuccagucgggggugguggaggaaagggcaucuuagaauugaccaauuacagccuuucuuuuucucgugugucacauugcaguugggccuucauaucugcggguugcacaucugcaauuaaggcaauuccuacuuuauuagugguuauauuauuaaaaauccuuauuuuuugaagaacaauacaaacuguggauacaaugugucguauuuggggggggaucauggaagaagccagaugugcuguugaaguugaccaguggguucauggaguucauucuacuguuuuauuuuuguguacuuuugaaaaguucauuuaaaaaauuuaaaaagauauuuacucauguaugcagcauaaauuaaagaagcagcugaaaacuaguauuuuuguaaaaagcagcucaaaggguuugugaucguauuaguccagaggugcuucugccucacagcucuucuguaguuugggauauuccacagugauucuuuucauagggagcaucagagaucacguuagauccugacuuaguaccuguaucaccagggaagcauucuuacauugguugcuguuucuucugugaggaguaucuacauucuuuggaaauugcuaauccuggugcaguuucuggugguagaggaugagcucaggcggucugugaggucauuucugccuaagcagacugcccgguggaccaaagacccuguuacccaccagaguucacuguagauguuuuauuuuauuuuauuuauuuauuuuuagagucagggucucacccuaucacccaggcuggaguauaguggcaugaucaugaucauagcucacugcagccucaaacuccugggcucaggcgauucuccacuucagccucccaaguagcugggacaacaggcaugagccacugcguccagccagauguuuuauuaucuugacuacacccuucucauuugccaggcaccucuuuauguucagucuuucugccagauuuuucacucaugcuaggcagcuuugcuugugguuauaagcuauccaucaggagcuguggaugacuugggaagcugagugggagaccguuaauaaauauguguuaguccuuuugguucucccaacaagauauugaugcuaaaggcuauuuuacgugguauuugucaauaagagauuuuggcaaauuaugauacugcguaucuucuguaagguauaauuccugguacuucaaauuuaugucagcuuugucucugagaugucugaaaugcuuuagagccauugcucauuugucuugcuuuucagcaugccugggagaaugaacagcuggggagaaagaacagcuuuucuucccacauucacacacaguuucugauggacccacagguuacuagccugccccacgggucaugcaguagcaaaguugggacuagaauuucaguguuccuccaccugccuaaaguacggcucuggagaaagucagcccuggcuguccuggucuuaguaaagcuauaguucgugaaacaucagguuacaaauagcagguuucccucuugcugacgcagagcugcagcuucaggcuuggaaggugcugauuacuggggcuggugaucuacuaacccuuuauugaaacugcugauguggaugaucgagaagcagagagccgggaggagaauguaauucaagucuggguucuuggauggucuaagcuccaggccugaggcuggccgucaugaaaggaacauaacuguggcuguccaggccucauaauugggcucauggaggcagacgggcucaugaggaaugucccuauggagaggguugcugaggcucagccuccaucugcacuucaguaacuuaggagcucacacauucuuaugggucaagaaguaaucugggucacuaagcauuugccuaggaagaugugaauuuggcguccuuuguuuuagaaagaaaagggauagagguaaaguuuccccucuuccugguaauaaaugugacuuggcauaugucauaauugcaguaguguuuguacuuaagacauagguuuuaguuuagaggauuuuucucccuaacuggcaguggagaguguguggagucauuuuccuuguacuggcccuggaaggauauuuuuggugaucuaauuuuuuuauuccaguguugcaaagcgccgacaucauuaucaaaugugccauaguuguuuggaagcgaagcucucaucagcuauguaaguuuuuauuuuagguuacuguggagaaggggaggccucgguggaggacugauguguguucagagucggagcuuucugcagaaauucgaguccuguugacccagggagcaggccuugacaucaggccccgugcaugaagcagugugaugucccaagcaguggugcucugaccacuugccauuuagguccuggugccagcgggaaggucuagcaucagcagguugccagggugacucuguaaauccauacugggggcuuuggaaacaguuuugccuguuucuggcccuagccucguuugacagcagaagcccaggaggcuugugcaugggagcucuugguggacagcuagcucugggugucuuucuggggcugcugugacauggcagagaggaugcauagcacaggggccacuggccugggcuccggagcagacucugggugugcauucuggcuuauccaguuagcucuguggccucaggcaagucacuuaacccuucagugccucaguuuccccauucaccuaucaucagguuguucaaugaugaauaaauuaguuuauguaaaaugcucagaauggugccugguacauacauaguaagugcuuaaaaguguuaacugcuguugcuaaugucaacugucacuuugaaggcggggagguguugacacggguucuuggggaagcugcaucagugugcucucacaucacaugugacacgucgcaggcauucacgagcccagaggcuccuguuccccagccagagccagccuccucugccagguuugaagugaaccaaccuacuuuccucgaaagcgccuccagccuccgcagaccaugccugaaacugucauuccuagguagguggguuguuuuggaaggagugugaggaugaaggggcuccugcagcccuuugcuucuuccuuggguggggaaucugagccccagacagcaugaggaagcuggucagggucccccccagcuggugugaggaccgaguggccccugggguucugcagguagcuucaggccagaacccuuuccccauccaguguucaguggccaggagauuauuucccaauuccacccuuaaucuuuuccagcuugucuuugaaaaauuauaccgagauaugguuuuaagugcgugcuguuuaauuuuuuaauacucuuauuggcaauuggauuuuucaacaucuugagcuguuacuaucugaauauagcguguuaauuugaaaacuuuucugcaagguuuuaauuaggaaauguucuuucauuaguucaguuucuggcuugcuuuugaaacugcagaugagugacaaguggaagacaaauuaauaauuguggcaaugcaacaaagccccccugugagggcugaggacuaguucugucaauuagaaaagugcucacguggcuuugcugauggcucuaauuaagacaacucacaacuggauugcagaucaauagauacacucugugaugauuuuaaggaggaaugaccugugugaaaacccacguuuggucaugcuaaccaugacgaggaaggauggcacagugguugggagccuggccugucauguuagaccugguucagauccugcuguuacuacggaguagcugugggacauuggcuugcguuuccuugucuggaaaagagaguuagugaguugaugaagaugaugcugacgagcuuagugaggacguuuauuugugcuugcucucccuuccugcagguacuucuggggcuggucuggcuugacuucucugacccaggacgggucuugcuuagagcagaccugcaggucaguggugacaucaggugugaauuuuuggacuaggagugucagucggggugcagaggcaccuggugaggcaggcuuuuccauccuucuucucuaguccgugucccuccuuugggcaauguggaguugccuucaaucugggaaggucucuguuucuuuguguaaggugaagcuguggugcugaaugaagcaggugucacauuuggguuacauuuuuaagguucucuaaucggucaaagugcuguguaaguuuccaggggcaccguagaacaaagcaggcuuaauggauuaauggacaugauugagugagcugauggguuggugauuucauaggugucuggcuuuaagcccugccuugccuuugcaguuccacagccauucaggcuggucaucucuuccuagggccucuggaguuggccuaccuuggagagaucuccaaugugccauuccuccugcagccgacucuccuuaucccuacuuccucagugcugagccagaggagaguaccuuuuaucacuucuguaucauuuauuuauuucgggaagggaguguaguggcugccaggagagggaggcacacauauaaauuguggacaaagccuagaaaccuaggcauugccccugcucauaggaagucauaugcauggaacauacgcacuggagugcuaguuagacagcugggaugauagagcaggggauccaggcugauacaucaggggaacuugcagagagaauaggggauccaggaugauagagcaggauaaggacagcuguggauggagcaggacgacuggauaauggagcauggagccaggaugauggaacaagcagccaggaugauggacagggagcugggaugauggagccgggagcugggaugauggagcagagcagcugggaugauggagcagggcagcugggaugaaacagcagggagcuggaaugauagagcacggcaguugggaugauggaggagggaagcugggaugauggagcagggaagccgggaugauggagcagggaagccgggaugauggagcagggagccaggaugauggagcagggagccuagaugauggagcuggcagcugggaugacagaguggggagcaggaugauggagcagggagccaggaugauggagcgggggggccaggaugauggagcggggagcugggaugauggagcaggcagccaggaugauggaguggggagcccagauguuggagcaggcagccaggaugauggaguggggagcgaggaugauggagcaggggagccgggaugagggagcaggcagcugggaugacggagcagggagugggaugauggagcagggagcgggaugauggagcggggagccaagaugauggagcagggagcugggauguuggagcagacaguugggaugauggagcagggggcugggaugauggagcuggggggcccaaugauggaacaagaagccagacugauagaacagaggaaaugaucugagaaacaacuuugaaaggucaccugcagcccccugaugcuugcauuauguuaaaauguuugaaaauuuagaauccucauuuuaaggcauugaucuuuccuucagaaagcuguccuugcuguuaaacgguguccggagaguaaggagauggucagcacugagcauuuaguuucuucagaggaaugacaguggggguuacucuguuuuuacuuggaguaucuggauuguucaggaccaaguaaaacucuguaagaaaggguuggaaauccuggugggccucuguuagcccuuccaauagaagggggccggagggggcccacugucuguguccuuggaccugcaugcaagcugaaggaaauggugccugcugcacauggaggagcuggagccguggacaggccugagcucaucuccaucagcacccggauguuggcguacaugccugugaaggugagggucugcacuuccagcagcccucccccuuuguaugucacuuuggacacccgagauuucccugauuugccuggagccucuguguaauuuuuaauuugauccccugcgucccaguggacugugagugucuugaggccagcacaggcuuggccccucccacagcagggagacaguggggagccaggcuaacaugggcccagggauguauauucuggaaggagggcaggcugggggacggucacgccaauaucagagugugaaguggggcuccaugagaggugaguccucaucaggaagggccgaggaggggaccugugggcgaggccuguugaccagaaugauccaguguggcagaaggcugucugggcuuggagaagauccugugcagagauccuggggccagaaugaacuuggcaugucugggcaaccaaaggaggagggcaagcuggugaaugggacgugaggucagagagacagccgggggauggugagcauuuaggaucugauuuugucugcccuggcacuuccugugucuggcucagcaccgagacguugcuaggugagggagaugaggcugagacuggugggcucgggggagaauggcugagagccaggguuguggagggucugccacaugggggaccaugccucacagguucaaggcaucccuggccccuggcucccuccuacucuccuucagcuguuugccugcugggugacucagcuaugggcuaccaagucauuuugcccuuuucugcugggaucugcgugcugagucucugacugguaacaugcugugguuuggcagcaugcuugggaguugacaucauuucugggugcaagucuggcuuuuucucccuggugcagggugaacaugggauuaggggagacaagaaugucugcuuuuucguccagacaugcugccuugcucuugcagcugaacagaccccagcuguauuuguaaguuaagcccuuaaauccugugcccuaaagguggaggugccauuucaucuccgagaaguggagaaagauugugcagugaugcugagguacaggagagagcugaugaggaauagaaugaucaguuguuuguaagcaaucuccucucuucuggcucucuuuagcaaaaguuuuuauuauuaacucuccuuucaccacugcggauggcagacauaccugacggcaaaacugaagcauacccugacagugacccuguggggcagacacaccugaauguguguuuggaguuuugagcuaaggaauccgggaguggccaaccuggagauucauuccuuguuuaugaggaacaucugagccccuauccugucccguggaacacugggcauacagaugagcgaggcccuuuguuuuggguuaaaugaagguugccccguggaggcuguuagaggaugcuagguggaaacucuauuuauaaaccacaggcuucaagcaguugcaguuuuccugcccaguccacugccacugggccaucccuguguacagguuucccacucguaagccccugugucucauuugcuggcucugggucuccuucagcuucuuggaccuggugccgucccuguaggaguucauuaggggucuggcaugauccaguucaucacuggaaaaugguucugaauguaggcgguaauguuugugauugucuagguugaaguccggggcagucuaccuguuuaggcaagaugcaggauuaggcaucugagguucucuuauucauugcauuuuggaucuucuggagcuccuccuggcugguuauuuuaaugcucuauaccuuagccaaccacuuacagaacuguuuugauaggccacugacuucugguguagacguugggggugaaggauguuugacagaugggacggagauggauuuauguuugugaaauguuggggaaacccgaggcaauaccuggagcccagaagagugggcucaccguauguccacagcucuaucagugccccuaaggugauuggaaacugcuugcugaccugccugguuaaggaacgaacucggguuccaccagaaacgugcugagagauuuccguccaccuucauggaauucacagaacaaaugacaagauuuuaauccaggucuugguauuccuagggugccagaggugaaacugagaaaauuuugcucucaauuauuuggcgaguuuguagguagagaauaauacgagcuccuggagggcuggaaucuggaggcauuucagcaaggguuuagaaagggugggugauggugacuagggauacagcacguugcucagcucugggcugagaggugguuaguucagccugacgacccagcagagcaccuccuggucauucugccggcccuuuaucuggugagguagggcaaggagggaguuggagugaggaaaaaugccuaagucaagggaauagagggagggcaagauaagagauggcccuugugcgagaacugucugcauugcucacucuuuggagauugaugcuuucuccauuuuacaguuuuuagggggauguucuuacuggcaaaggaggaaaacagcuguaaagugagcaguuuuuuuuucccccguguguuaagggaauuuauuuuccuuuucauucuuuguuccuccuuggcucaccccugcucaggacauaacuuuugcagaaaugaggauuuugcugcagccugaaucuccuggguuggaucucuuagagcaauuaauaacuuguuauucauguguucggggcacagcccuuuguacucaguggugcguccgucaugcuguuugugcuauuggggaccacuaagagugcucuagaaaguuggugugggcagugcugagcuuuggagucauggaguggcucaggugucagcccugccacuuaccugugugcccuuagacaaguaccuuucuaugucucuguuacuccucuacgagauggaguuuaucacaggguuuacugcaugaagcugucacaaggguucaacaagauguugccuggugagcacuuaacccacaccaggcacguagggagaaagagcucaguagagugugugugggaggggucuucuuccaucccagggagggagguauuucaccugggaagguccuggcugggagcugucuucuaccccuucuuuaugcagcgggcucuaagccagcaucuggcaccgcccuuuccaaaccagugcacacucuccccauagggaaggggccuggccugcuggggcaugcuuaguuucuguauuuuaagagcucccucaucugaugaccgguacuaauuaccgaauuucacaaaugaaauaugugcagggugaaggaauaugccuguugauugcacucgaauuacugcaguaaaauuaaauuucaaggacugcaggagccuaagauccuucugcuguccuccacuucccccaucuuaauugguuuuccuugccaucugucuuucuugccuuuacucccccauaacugccagcccgcacuguuaaccagcgguuuucaaucuggcuguacguuaggaacaccuggggaaaacuuugagcuguagaugccuaucacccacccuagacugauucagucagaaugucuggcuguggggcccaaguguguuuuagaaaaagcuccccaugugugaaugacucucacgcagucaggucuggggacagcugguuaggaaggcgucgcugagagucuccaucuuuugggaguaacugcugauggucauggagcccuugaauaucuguuuggacuuuuugagggcucugagcuugagcuuggucuucucuuuuggaauacuuggguguuugcuuuaauauucagaguuaaauauugaugggcauauaaugaaaugccuacuggauuacuggacgaugcuuuuagcuaugaguacuuacucuggaagcucugagaauaauaaaaacgaugaacagcagauauuaagugacaguuuagaacagaagaaaaauacaaguuuucuuacaggcucuuggcuaaaugaauauggggguggacugggguauucaguaguugagcaauccuggauucuauuuuuccauauuugcaucuccccccgcccccaauguuuuugcuuuauuuaacaauuuuugggguaaaaaccauguaacauaaaguuuacugucuuaaccauuuuuaaguguacaguuuuguaguguuaaguguaguccuguugugaaacuuugucaucuugcagaucuggaacucuguauccauuaaacaguaacucccauucucaccagccccuggcacccaccauucugcuuucugccucugugcacuugacaccucuaggugcuucauguaaguggaaucuuguaauauuuguccuuuucugauuggcuuguuuucacuagcaugaugucuucaagauucaucucuguuguucugugugacaggguuuuuuuuuuaauucauuuuuauugaggugaaauucauguaacauaaaauuagccauuguaaaguauacaguucagugacauuuacuacaguuguacagcuaccacuucugucuaguuuuuuuuuuuuuuucuuugagacagagucuugcucugucacccaggcuggagugcaguggcgcuaucucggcucagugcaagcuccgcuacccagguucaccccauucuccugccucagccucccaaguggcugggacuauaggggccugccaccaugccuggcuaauuuuucauaguuuuaguacagacgggguuucauuguguuggccaggcuggucuugaucuccugaccucaugauccaccugccucagccuuccaaagugcugggauuacaggugugagccaccgcgcccggccacuucugucuaguuuuaaaacauuuucauccaaauggaaacccuaugcccauuaagcaguuguuccccauuuccucaucuccccagucccuggcaaccacuaguguacuuucugcgucuguggauuuauccauucuagauauuucguauaaauugacucaagcacuguguguccuuuagugucugaguucuuccacuugccauaguuuuugagguucauucagguaguggcauguaucaacuuucccccccgacaguuuuuauuaugguaaaauacauauaacaaaacugaccauuuuaaccauuucuuucuuucuuuuuuuuuuuuuuugagauggagucgcucuguggcccaggauggagugcaauggugugaucucgccucacagcaaccuccgccucccggguucaagcgauucuucugccuuagccuccugaguagcugggacuacaggugcacaccaccaugcccggcuguuuuuugcguguguguguguguguuuuuaguggagaugggguuucgccauguuggccaggcuggucuugaccucaagugaugugcccaccucggccucccaaagugcugggauuacaggugugagccgcagugcccauaaccauuucuaagugaacaguucagugacauuguguucacauuguuaccaccauccgucuuuagaacucuuuucaucuagcaaaacugauacucuguacccaaaaaacaguaacucuccauucucccucccugcagccacuggcggccaggguucuaccuucugucucugugaauuugacucuucuagguagcucauguaaguggagucauucaguauuuauccuuuugaauuggcuuauuucacuuagcauaauaccuacaagguuuauccauguagcaugugacaggauuuccuuucuuuuuaaagcuggguaauaguucauucuauggacauacaacguuguguuuauacauuacgcugcuaacacgugcaacacauuugcuauucauccuacugugaacacaggugugcacauuucccuucgagacccugcuuuucauucuuuugggaguacaccugguggaacugcuggaucauaugggaguucuguuuuuuaauauacugaggaaccuccauacugcuuuccacagugacuacaccaauuuuacauucccaccaacuguacacaaggguuccaguuucuccacauccucaccaauacuuguuauuuucuguuguuugauaguagccauccuaauggauaugaagugguaucuugugauuuugauuaucaucuuuuuuuuggaugagggaaaguuugaccccauaugugggugucugucaccaagauagaaugaauguaauuuccaaggaaaaauaaucccaggcaaccucuucuggauuaugucccaacugauuggaaaugcugggaacuuucugugguugaaggaccuugacauuuguugucaaacugccugugagucacuuaucuucugggggaaaauaaacauaaccgugucuuccagucugaaguggggugggugggugauaugaagcauugcacacagcagagccugcugccccuccacagccucugcaaaugccgugugaaggugguggaccugcuaccagaacugguguccugcugucucuguaguuaacucuuaggagaaauaacgguuguguguguggaggugaagaaugggaagggaaggagggguggggagggcuggugcuucugagguucccaaaguuccuggacucgaauuuucuguuggcaaauaagcuggucagaacuuaggaaugugguaaguugauccaggaagaaguugaagguuucuaucuguguuuuucugugcgguuguguauguguaacacguuugcagaaauaguugaagcuuauuauuuucuucaaaagaucuuauuuucuaguguguaaaucacagguaauuaaauaugaguuaaaguaagagagagacccuugggcuaucucagacuuagcuuugagagagagaaugaucaugggucuaaggcaucacucuugguuuuauagguuuggaaacucaauguuauuaguuccaucuaggaguuaucaaugggggauugggguuuacaugcaucagaauuguaagauacugcuaagaaugacaguucauuaauugaugagaacugugccucgcugagaaagccagcacuccugggguguguguacuccgcagaccuuuucuuuuguuuguuucuuucuuucuuuuuuuuuuugagacggaaucucuguugcccaggcuggaguacaguggcacgaucucagcucacugcagccuccgccuccuggguucaaucuauucuccugccucagccucccaaguagcugggauuacaggugugugucaccacauacuaauuuuuuguauuuuuuuuuuuuuuaguagagacaggguuucaccguguuggccaggauggucuugaucuccugaccuugugauacggccaccuuggccucccaaagugcugggauuacaggugugagccauugugcccgguccucagcaaaccuuuucuaucggccuauuucuaucuauuuucuaucggccaccuuuucuauuggccuauuuccaucugucugaggaaucuugaugcaucggccuucucguucuggggaucuuucuguguauagaaucaauacccucuccuuaggguagugauggagauugauuuuucaaaaaucccaacauguaauuuaugaaauuauuguuucagcuccagacucugugcucuguucugcaguguuggagcuaggaccgcacaucccagcugcuuugccaguggcuuccgggccaccuccaucagcaggaggcgguagaagcaccagcaagauggggcuuugguccuuccuguuggcuuccuguugccccagcuguagcuguugaauucagucuucaguuaucccagcacuggccagccagccucaucguccacacucccugcagaucccaccacuccuccaaggaagucucuaccucagggcccuuuggcuacgcuucuaagguuaagucuaaccgguucccucaggccuaggggugguggcugcuuccugucguugcuacuucccugauaucuagaauuuuccuuuuucuacccaguuaccugguuacugacuuucuacccaguuaacaauuuauauuaaagcccuucuguucaaaaagcuuauguaguuucugcguucuaauuggauccugacuaauacaucugacuuucaacauucuuuaguaaucagucagcaaaaugauuucaugagauagacguauuauauuuaauuggauuacaguucaccuuauauuccuuuaguuuuuuuuuuuuuuuuuuuugcacugaucuuucugauuuucguuaggcucgucuauguaauuugagacauaacuccucucauuagcuacuuucuaaaucaucagacuugaguucuuuccuggaaagaucaccacagauggcuaaugucauucauuuuguuggcucuuuuggcuuuauaguagagggugacaauucuuuuguuuuugguuuuuuuuuuugagcuggggucuugcaugaccucacugcaaccucugccucccggguucaaaugauucuucugccucagccuccuaaguagcugggauuacaggcacgcgccaccaagccuggcuaguuuuuguauuuuuaguagagaugggguuucaccauguuggccaggcugaucucgaacuccugaccucaggugaucugccugccucggccucccaaagugcugggauuacaggugugagccaccgcaccuggccaagggugacauuucuaaaccuuaucucuaaauucuguguccauuauucaguauuccuuuaacuuguagagcauggcuauuacguguuuaagcaacauauaucucuaaaaagauucgaggccgcuuauaagagaaaguauauuauguguaagcacagauucauuaaaauaagaguuuaaaaaucuggggucaaauuuaggggguagaggggaugagggauaaaaaggugaaggaaaaaagaaguggauggagaauuaaagaaugaaggagaauuaacacugaacacccacccccauggagccggauccuggcuagguguuugccaucuguguuuaguuuaaugcucagcauaauccugcguggcagguauguuacccccaucuauaggucaagaaccugaaacccaaagugcuggccgauugugcucuagucccccuauacauuucagcuuacgucuacugacacuaagccaaggggagcuccuucaguugaacgugcaauuguaucuugguagccaaagcaagaaaggaagcauguuggguugcauaguucucauuugauaauacaaugaaacauuuucuugagagagagaaacauuuucuuagccuucaagcuugauaagaaucuaguggauauuaacuuaaagggcacugaacaugauaauaguguccgucagggggagaaauaacagaaaccaaaagcagagaugcacacguggccguuuauuuaaaucaaaccugaagcagaaggaggagcauuagaucacaguuguguaaaggcaauucuaggagaaaacgauggacuguagcuagcuuucugcaguccugaccuggccaaggguaaaacuagaucggcugcgggcuguguucccugggcuuccugcugcuucacuccugggaggcagcacagagugguuguuacggggaagguuuucauaagugcugugaauccacccugggccguuuacuggccuugcacaugugggcaagguacggucaagcucagcaugaugacauuuuagccaaugacagaucgaauacccaaugguggucucauaagauuauauacuguauuuuuacuguaccucuguguuuagauacacaaauacuauuauguuauaguugcauacaguauucaguacaguaacaagcaguccagguuugcagccuagguguguaguaggcuauaccaccucguuuuguguaagugcaugcuaucauguugccacaauaaugaaaucaccuaagggcacauuucucagaagguaucccugucauuaagcaacacaugacaguacuuaaucucucuaagccuuagcuucaucccuucuuaaaugaggguaauaauacuguuucguccaccuguguguguguguuugagauagggucucgcucuguugcccaggcuggaaugcaguggcacaaacaucacugcaaccucgaucuccugggcucaagcaauccuccugccucagcauccugaguagcuaagaauacaggugugugccaccaugcuggcuaauuuuuuuuuuuuuuuuuuuuuuuuuuugguagagauuggguuuugcuauguugcucaggguggugucaaacuccuggcuucaagugauccucccaccuuggccucuuaaaaugcugggauuacaggcaugagccaccaugccuggccuuauuuuuauauauuuaagaacauaugcuuucggccgggguggcagcucaugccuguaaucccagcacuuugggaggucgaggcgggugggaggcggguggauuaccugagcucaggaguuugagaccagccuggccaacauagugaaaccccccucucuacuaaaaauacaaaaaaauuagccaggcgugguagcaggcaccuguaaucccagcuacuugggaggcugaggcaggagaaucacuugaacccgggaggcggagguugcagugagcugagacugcaucacugcacuccagccugggcaacaagaaugaaacuccgucucaaacaaaaacaaaaacaccauaugcuuucccaacacaucuggacagcugauauuaaaaaaggguguauguaguagaauuaaaacuauuacaagagaaacagagccagacaguuuggggaagggagaaaacagagagguugugggggcacuuaccuugaaucuucuuaggucccuuguguguuguuuugccuaauccuucccacacgucugcaaagaggaugaucuccccacguagagacaggaagcggauuccgauaccucgccuucccuguguuagaugugccguagcuccuacugagggugaggauuaauuggagaugaugcaaguggaccucuaagcacgggccgcgaugaugucguaguucacggucacaggacugucacugcuguuacaaacuggcccuucugcuccgagucugcugguccucauacgguuccuuucugucucugguuguguugguuaagacagaguagcugcaaucagggagagugucgacccugaccccaacaagcagggagagcuagugcagaaugugggcaguggcagcagacccgcggggcugugacacuguccuuucuguggcuuggguggacuucagggugacccaucuagcagaguaaaaauaguaaccccacaugcugaccauguacccccugcuuucacgcacuuuuaugggugaauucaccuauccguuauagaaacuccaugaggcguuuuuauuauccccauuuuacagaugaagcugucagggagagagguugaguugccggcagucucacauguagaaguggugaagugggaauucagacccaccccugcgggcuccucagccaggccugcucuuagcaucccagugugcugcucugugacgagccccaguauugggauccacucuccagaugagguuugaagaguuccgaaguggaacgucuuucuggguuggcuggcuguagagggguuggugacuccaguguccuguggugguagacagucuccagccaagggcauguacuucucaccucccugccucgugaaucuggucagucuggugucaaacuugaaccaguagacugcuguggaugugacacugggcguggugcaggcucuguccuugaggggccugguagccccaccuggguccccuggggcccaacugccaugcuagaagacguccaggcugcucugcuggagaaagaaaccgugugggguugccuggagggugagacauguuggaggggagggagggagaggccaaggccucagacaggugagagagccccagccgcgaggcaccuguggucucaccaugggacauaagaacuuguuuaagccaugacguuuugggagggcuuuugugcaggaauggcacccggaacuccugcuucccaugaacccagggcugugggccuggcugcugggagugagccauuugcugggccagggauuugcccugcugcagggacuuuucuaacccagccgggccaggcucaccugggggcccuuuugauuuugagaggacgcauaccucagccugcauuuugguguccucuugcuagcaccugccagcugagguugagccaugguggacaauuuuuccuuuuaagacgauucuaguuacugaaccaaagauauuaauuaugugcuuaucugugguaauuacaacuaaagcauucuuuaucacugcagcuuagucauuugcuuacgugauuuaaaugugauauauguuaauaugcauaucucgucaaagggagucauggggguggcaugguuagagcaugcuggcugagggcaggaggccagaggugucugcgucucccucguccaucucguucuccccucccgccuuccuuccccuuuccccucucucccuucuuucugucccaccaggauuucuuuaagguuuguguuucaucaccaucauccuguuugaaaguuuuuuuuuguuguuaauccaucagucuuucucaauucauaauuaauuucuuccaaccucccucccugcucccauccuuggcagccugggggcagcagguugggaacuaccaccaauguugcaccuucuuaauauucuuuuauguaucucuucucaaagauagaauuaguuuggucugaauuauacauacaaucauagaaucaaagugacuugaaacuuagaaggugcauuuucuuuuaggguuuaauucacucagagguccuccaacccagccucucauucaguaaagacuucccuucagcaacagaugguaaauagauucugcagaaugaguaauuccuucauuucugucugaaugguuuguuuagaagcaaacacaaugauucccucuccuuauuaaauuuguugggagaacaucaggaucauacuaaguuacuguccaaagcuacaacugugaagagggggugcacggugacaaaaaagagaaaugucgcuugacauuucagaauucaggcccaguaucaucggugcccucauaacauuacacgccaaacccuuuaauaaaacugucaauccagauuguuaaaacacugagcgguuugcucaggagauagaauauuuaucauacugagguucccaguuuuuaaugagccaaauauauuuccuuauuuuuuucaugaucuuuaauuuaucaacuuaaccauuuuuaaguguacagguaagugguauuaaguacauucauauuauugugcagccauguccaccguacauccacggagcucuuucaacuugcagaacugagacucugugcccauuaaacacaacucccacuccccacucucccagcuccuggcaaccaccauucuacuuucugucuccgaaucugacuacucuagauacuucuauuaguggaaucauacaguauuuguccuuuugugacuggcucauuucacuuaacauaauguccucaagauucaucccuguuagagcgugugucggaauugccuuuugaaggcugaguaauauuccauuuuggaggcugaguaauauguacaugugcacauuuuguauauccauuuaucugucagcugacuuuuggguuguuuccgcuuucuggauaucaugacuaguaaugcuguuccucacauuuuaacauucaaaugacacaucauaauuucauuuauucuugauaucucaggaaaauuuuaaauaccguuuaauaguggagaauuaugguaacacgcaccaaauguacauuauauuuuuaauugcuuggcaauuugggacaacuuacaaauucugucuuuagguuuggucgcuauacaacagauaaugcugcuauuucugcuuuaguuucagggaucaaaaugaguuaauacguaugaauguccuuuguaaagagagaauguaaauguuugucgauagaaccagaauacauucugaacuuucuugcuuguauucuggguagguagacauuuaaaguagagauuuggcauaacuuaguucuuccagaaacuucaagcacuuuacacucacucuuuuuagcccagguuugaauuauguggggucauucaugggguuuaugagguuugaagacauacuuaaauaacauguggguucucuagaaugaauguggaaggaaacauuguacuccuguggaaugcuggcacccuaacaggagugacuuucucuuuucucucucuuuucuccuuuuggucaacucuguuuguauguagugugagcucuauacugugggauagcauucuuuuuagaaugcaugcaugugaauuguguagugcagagauuugcuauauccauuuccagaauguacauauugaacacuguuuugcgaaaggcaggucuaugcaaacuaccccaaaguccgaggaagcugagaggcugaaggaagagccugacaaaucccguuucuuagaaagaaacauuuaauagagaccuacaagcagaagccgcaucugugucuagggcagcgguaagacgagaugggggagccccacgccauuaccccccagacccagggcuucuaugccauagcggggagggaggagugguuccaaagggauacguaggacaauugaaguaagauaacaucaagguuguuugaucugagggcaggauuuacuguaagcaccugcucuuacacaggaauaguagauaaaugggaagucuuagaggccuucuuggauaggggguuaaucagaagccaacguggcagauuagcauccaagauggaguugcuuuagccuccacaagcacugacuguaugccaggaguugaccaugauguguuaugaggcacuggggaauucauuccuauaugaaucugggugauugacaagaaauucuaguggaagugacauguagguugagcugugcauugagcgggcuggucacgugccccccuuuagauguucccgaucgcgcggaaucacgacaugagaggaugagaucagaguucugucagcuucauguagccaaggacuuucaaguucuuccuugaggaguuggcccucccuagucuccucuguuacaccagucauugcuacguuagcagcuuugcaaaguagguaucacgcuccaugugcucugugccugcuguuggccugaagcauugucauggccuugcccagguuugcuuuccuuaagggcaccauuuggucccuuuugucaaacccauuugcuuacacaggcugcugcacuauuucuaugauugcaauuccagaguuuccgagucccgggaugggggugucugauguuaguagcaugccauggucagaugucuuggggaaucuggggguaagcauaguugaauacacucucugcugcaaguuucucaaaaaugugaauacaccaaugguguuucaugaauccaccaagaccauacagcacuauagcuuugccuggagaguuuucucuccucagcaaagcucuccaccugucccaagcugugauucccaagaaaugccagcugggaagccugguuugaggguagcauaugcuccauugccauggccaagucaguacaagccuuuuagcaauggugcguucccucagaagguuugcuguggcccauuuagccauauuuuggcuuugguuccuggaagggaggugucugccuucuuccuaguggugugcugcccaccaggcaugcccaguggcucaucugucucugcagauagcuuggcugaacccaaaagggcucaguccuuccugugggcuugaugccuguaggaagggccagucuuguccccaugucugcagugugccacagccuccuuuccaauuuguuuccauuauaggauuaugagaccuccugacucuaaggaacuguuuuaucuggggcuugguguugcgggcacagcaccugugaauaguuaaugacauuuuuuauucccaaccaagaccuaggcuccuuuagggcaagggccaguguugaucugaggauauauucccagcuucucacacagucuguggugcagacuaggaguuccauagaucguugaaugaaugguuuaaaaaaugaagggaucaaguccuggaagugguuuuaauuugcugugacuccagguagcuugcuuaaacacucuauguuuucuaaauuuuaaaauagagcuaauauuucucaaauggcuccauaggacauuggugacacucaguucugcaccagcucuuugccugguaaugugcaggaugggggaugcccaggguaucuuuuuauuccuuuuuuuuuuuuuuuuuuuuuuuuuugagauggagucucgcucuguugcccaggcucccaggcuggagugcaauggcgcgaccucggcucacugcaaacuccgccuccggguucaagugauucuccugccucagcuucccgaguagcugggauuacaggcaccugccaccacacccggcuaauuuuuguauuuuuaguagagacaggguuucaccaugcuagucaggcuggucucgaacucgccaccucaggcgaucugcccgccucggccucccaaagugcugggauuacaggcgugagccacagcacccggcguuuuuauucuuaaaauaauccugugaggcguauguaguguucaccugauuuuguaaauguguaggcacagggaaccgaauaacuugcucaagaucacaaaggcuuuaaguuugagaagugcagugaaaaugcggggcugcuucacuccaaagucgauguguguauauguacauauaaguguauaugcauguguacauguacauauaaacaaaaguacacauuuaggaaguguaugggaaauauacauguacacaugcguauacagucauaaggacguuucaguuaacaguagacugcauauaucacaguggucccguaagauuauaaucuuguauuuuuacuguaucuuuucuauuuuagauaacaaauaccauuguguuaccuacaguauucaggacagucacaugcuauacagguuuguagccuagaagcaguaggcuguaccaucuagccuagguguggagaaggcuguaccauuuaguuuuguguaaguacacucugaucacacgagcaagaaauagcauaaugaugcauuucuuagaccagaucuccauuguuaagugaugcaugacuggauauacacauacacauauguguaugccuguauagaugcguguauucuacauacuccuaaaugugucauauggcaagggugccucauuguaauucuggcuuuuuccauaaauguuaaacaagcaucuucucccaccgccaguccuuuucuuccuucaaggggacagggccucuggagcuuaugcccagcuccugucggaugcccccguguucuggucacucgugugcccgucucuucacacucaguuuucccaccccugagcaccucaggugccaagguguguuuguugaacugaaauucuuaagccugcugaguacauucucaguuugucaagacagauaaacaaauaccuuuuuuagaugauuuaaaagauucuugacacagucccagugguguuuuaacaacuuuucagguccugaucagccaaacucugggccaaaaguaaauguuuaauaaacaacauaagagugauggaggaaaaauguaucuuaaguggaacuguguguucuguaaaucuaugacagauuacuguuccugcuuuuguuguguauaauuauucuuguuccuccugagaauugcccucucuuucaucaugaaacguauaagauggccuccuccucugguaauuuggagcaauuggccugggagaggauugauguguaguaaggacaguccguaggagagauuuagugggggcaguuuccuuaucuucuauucugucccuuugccagacagaagcacaaaaaguaguuggacugaaaaugcugcuuccuaaaauuagcucuccucuuuguuuuccgaaugguuuuacugguugaugcgggcacaauuugcccuucuuggggagccuucugcauuguguaaagugcaaagacacaucuaucagagaagcuaauuuuaggugcuaguaaguuuuaagggcaugcaaagcucaaaacuuugccuguucucuuggaagaagauuuuucccuccugaaaaacaagcuuccuuucaaagucagaaaaggggagcuuagacgaagccccaggagggcagguaugucuuguucacugcagucuccagugccuugcgagggcccggcaugcugagcgcucaguaacccuuggccuaauguacaguuuuucauucugugaaucaggaauagagcaacauaaggggagcuucugcuugagacagcaauggcagcaucaaaauaaacguggcaauuuuggucuucaagagugaaguugugucucugaaauuguaagcccaaauggaucauuuccuuuuuuagguuuuagaauuccagguuuauuuucuggaagagcuugcagcagaugggcuucuguaggggaacguuuauaccuuggggguuccguuucgagaguccuugauuuauuauuguuuacaaauggugguuggaaauuguucauugauuugacauaaagcugcccaggcuuauuguaaaaacaccucugcauccaauuagaaugacagacacuuagugugaugacucaggacaguugauggccuuaaaaaaaaagcgaacagauuaaaucacucucuguuuuuucauagccauugauggaaacagauucugugggguaaauaacagagucuugggugguggaaagguugaagauguccaguaguuguggcagggcaaggauggaggacuuuuucuuugcaggggcaguggagaggcggggccaugggugaagacuggagaauacucagaagguagcauggacgagaguguuguuugaugacucugcaugugaccaguagugacauuuuacucacugaggcucauauugagguuaagcccgagguccauuggccuugcugagaucguguuuagaacacagcacugugcaguaagagacuccuauaacucuaucaaauuugcauuuggaggaauuguaaagagccucuguuaccuccuaggugaggcaguccaggaaaacaguugcuagaaggagcuaucugcagaaauagacaguugugguccuuucauguuuuaauaauuguucccuggauuucaaggagucaguccaaaauccccguaauagauuuuaguaacguucauggaaucucaguuugcacaucaugagaccuuuagugugguguuuacugucuucaccuuaauauacuuuguauccaugagcaaccuugcuacagucaugcaaagaugauuauuuuuuauucagcaauaauuagccacaguguugagcacccagaugccuuccugcagcagccccccuuuucuccccagccaacaucugcaacugugaacagauuuccaucuucagccuuggugguuggaaagaaauguaagucaccuuuuuuucugguugguucuggggcagaugccaccaggcugcagaggcagucugugucuguggggcucaccagggcaugaguucugcucccaggaaagagauucuugcaggauuuugucugugguucuaaggagacaaguagguggcacacaaaaacagaaaaugaaagaacccaucccuccaaaaccacacacacaaagccaaaaggaaaaaaaaaaagcacauaauuaucauguaggcacuguugcagcuaacccugauuuuggccucaauucugaaacaaguuagcugguuuagacaaaccccuuauuagguaauggauuguuauucauuccuccccuucuccuagucauuuacuccgugagagcugcuccuaccugaccuuccacugauuuugguagcagcaucucccagagcgacuguuuccuucuucagcaguguuccuuacucaggguguaagaucuuaaccccacagagccccguaucagguuuaauuaacuaauugauucagcuugugcuuacugagugcgaggcagucaugugcuucuguuugguaaauggcuucauuuucccucuaacuccugagcguccugaagcuucucuuaugguucucuccaaaggagucagcaggcuggcucugcaagggucaguagguucuggggugguggggggccgagggaggcagggagguuggcucugucuuuauuuggcauagagcuccccgaacagggucucuccuccuuucuccaaagguuaauggaaccacuaucuuaaaaagcugaaaucuuaucuucugggguauuuggguagagaaggcuagggaaucccuuuuccaugguggugcaguagguucucagaaccagcuggugggccucaaagagaggcggcuguauuuuagccugauaaucuugauuccugguuuccuggcucuguagcaucagaaaugggaagcuuuaaaagccgugccuuguuggaugcaccgagucauaaaauaaaugugaugugcugggugggggaaaugcgggaggagggaaacaggugguuggagcugcuucgugauggccgcccacccuggcucuccuuucuuaauaggcuucagaaauccuggaaugcguaauucaccagcucacagaguuccacccauguccccaguggcuucaaaauguaaaugacauuugcagugcugggagguaggagggcgaucccguuccuucccuggaucucagucgcagaggugcuggcucaugugccugagugcagcggcuggcccgucauuacuggucuuugcaggaagccacucugaaggcaccugggcccuugccaggcugagucacagcugacuuagggaaaugccacacaggacgcuugcaguccccccguucuaagcguagguuuugcaacugcauacucggaaaaugaaucagagugggggaaagugucagagaaacagcagaaauggaauguaggcaggagggccacaguggcgcuguggauucagaccacaccuucggcucuguuuggggcccuuccuguaaggagcguacugaugccagaggcuggggguguggaagggaagcugcugugcuguuagauccauucugcuauuuagccagccuuccuuuucccagcuggcacagacaggauguguuagagaggugcucagaccuccuuucagagcaacugaaucauucuccaggagggacagggagucugaaaugcaaacagguucccaggguuauugaagagcagccaaacugaacacccacugcucuguggacucaagcugguuuuagacauuguuuggucaggaccagagccgagcucuggggcccacugggggcucuugucgcaccauaucauugauucuacaaugcacauuucccccgccucucauguuuuaacaugucugaaaucaggaugcaucuuccauggaugguguuucaggguuucauugaucguguuuuucuuccugaguggcacacaaaauuaauggugcucccuagaguugauggucccugcgguucagugaaccguguugcucuuguguaagcuccugugggaacauagagucucugugucccaccuucuuccucgcaguggucagcacggaugaggugggaguugcauaaaugucagcauucgaaagugagggcgucugucggugcugucucacuguggggcuucagagaacgugagcaccuguguuugcauucuccaucaagguucauguccuguuggcucauaagcaugauuauauccauuauacaaacuggggcacaggcacccagagagaagucaaaagacuuguucaagauggacaacuaggaagugguggggacagaccaguccugucugaugccagauccagcgcuguaucugccagucagcaugcacacuuucaucucuccagccucuucccacucaccuuuacucaacauuucugggccuccauagugauuguaguaauucgguaaagaugauucauuucuuuaguccggucuucggacuugacuucuuagaagcaggucuugugcaauaguugcauauuaaccacuuggugacacagugcaugaggguaugccaacucuuuuugcucauggccgugcagugcagaauuuccaggcauuguccgcucuguuuccuggacuucggagugauagcaaaguuuuguauucccugaucagcuguguaucucugagcagcaaguugaucucucuguauaagggugacugugcccauggaggauggcaugcaauugccuaaagauuucagucugagaaucugagaaacgauacugaauggagaugacaggcuuagugccugcuuccaggagccaugccuccuccuggccuggaaugaauaccuaaacaccugaggcucugaguuccggcagugugcugaaacugcuguuggucuggcccacugacccggaaacccagccaccugagguugugacuuuagggcuucuaguuuuguauuuagcuuuaauuccaucugugaggcaguggagacuguucauuuuauuuuacaucaaaggcuuuuggagguugagaugggaacaggaugauagaacaguaaugcauaauuauggagcauuugcuguauggcaggcauucguaagagugcauuuguugauauuauuguuuggccucuccugucauuagcccuaagcagcuacacuugcuaagcucugugcuaaggcugcaguaagcaggcaggcagugcgugcuggugagcuugggcagugcuggagugugucuugcccaguguggggaugaacauacacccuuucaugcucacaggugccuuagccuggaugauaauguuuaaguucauucuguuuauaugcaccgugucauuaaacaaugcugugaaaagggcacuauuauuucccccauauuuucagugauaaggcagaggcccaugggcuccuuguagcaauggaggcauuccuugaggauccaggcaaucugacucccgagucccggggcuggacagaaggaagcuggcuccgagagcuagacugcagugcagaggaauuccacgcuccgcaggugcugucuucagaaguugcaucucgucagcaggaugagugcuuuuggaauagacaaucuuaaaugucauagugaggugacuugcagagauaaggaaggacgccagccucaggcacugacugaugaauccagauggugacuuccuccuugcaggagaaucagccacuuacacagacugggagggauucuacugagggaaaaaaugaauucgcagccagggacaguggcucaugccuguaauuccagcacuuuaggaggcugaggaggcaggaggaucacuugagcccaggaguucgagaccagccugggcaacagagcaagauccugucucuacaaaaacagaacaaaccaacaauuagccaagugugguggcacacaccuguagucccaccuacucgggaggcugagacgggagcauugcuuaagccuaggaguuugaggcugcagugagcuaugauugugccacuguacuccaaccugggugacagagcaagaauguuaaaaaaaaaaaauucucauuucuucucauggacuuugugugugugugugugugugugugugugugugugguugguugguugguuuaagccauggauuaaagaaaggagaacuauuuccugugacuaaaagugguuuacauauuggugcuuuagcaggaauuuuggaggguggcuuaagugaauaauuaaaacagaaaucuuccuagacgauguuuaucacacucaagacauuaaaaauuagagucaagggacugcuaagacuuggggugcuggugggugaggcugccuuucagggaggccaugcugugaguugagaauccuaggccaccuugccugcacugccagcuuugcagcugugggcacaucuggauccccauuucugugcgggugcagacaggugaauguuaccugcgugcaucauaaaaugcugugaaaggggucacagguauugcccaggcuugggcagacucauucauagggcucacuggcuugcaugagaagggaugcugggcacgguaaacacagaaggagaaggcaggcucugcugccaggagcuugcacccugagccacguggaacugguuugccugugaagcaauaggcacaguccugaaagagcacaguccugaaagagcacuucuaauugggcauacaagcaagcucauaauaaaguucuccuaggaaguuuuccucauguuuugaagaugauacacuuagucccugacuggggaugguuucgcuuacacuuuuucaacuuuacgauggugugaaagugauacacguucaguacguuccucaauuaacaaugaagcuaugucccgauaaacccaucauaaguugaaaauauccuaaguccauaaugcacuucugauauaaugguauuuucaacuuacaguggcuuuaccaagauguggcgcauuguaagucgaggagcauccaucccugaugggauauauaaggaugagauuuaugcacagauguuccucagcuuaugaugggaucaugucccaguaaagacacuguaaguuggaaacaucugaagucgaaaaugcauuugauauaccuaagcuaucaagcaucauagcuuagccucaccugccuucauugugcucagagcacuuaaacguuagccugcaauugggcaagucauauccaaacaaugcugacagcaccgcacacuguaggguaucaguuguuuaacuucgugaccguguggcugacugagagcugugaaucacugacauugcccggcauugucagagacuauccgaccgcauaucgcuagcccaggauaagagcagaauuccagauuugaaguacaguuucuacugaaggcauauugcuuucgcaccaucgugaagucagaauuguuaagucgagccaugguaaguuggagaccaucugaauaacaggaugagauguagagcaggauauauauguuagaaacaaaguuucgcgaacagugcaaacguuuucuagauggacuauccuacucuucucuaucucauuaaacacuuugcuggcagcaacucacugaguugaauucccgcuccaccaguagccuccccugggcguuggaaggcucugcccucugaugggggucucccugggagcugcggcugcggacccccguagaugggaugcagcugcccagugugguccuugccuuugcaggugagcgggugcagggaggugcggggugggguggcggcugcagcaguggugguugggggcccugcaggcucccucgggguguagcagggacaugguguggugguuaacaggaguaggccacucaugugggacgucaggacuagugccacaaaggcagcccugucacacgaacagguucuugggggacagaggucugucugggacuggcuaaugaccuggaaagacuggagaggcaccauuguccaccaccagauguauggcugcaggguaggaguagacuuaagaaggaacacuguuggcugggcgcaguggcucacgcauguaaucccagcacuucgggaggccgaggcagguggaucaccugaggucagaaguucaagaacagccuggucaacauggugaaaccccaucucuacuaaauauacaaaaauuagcugggcgugguggcaggugccuguaaucccagcuacucuggaggcugaggcagaagaaucacuugaaccugggaggcggaggucgcagugaguugagagaucacgccauugcccuccagccugggcaacaagagcgaaacuucgucuccaaaaaaaaaaaaaagaaggaacacuguuagggaggcagucagugagccucaagucagaaagacaaacaagcucauuuuaugcauuugcuaacauuugaccucuucugggacgcguaggucucucaaguucuguuucuguuuccugucacgcagaucagagaugugaaacagaccugguguacacccgucugggguagcacugggagccacggcguccuggcagagcaggugugccucccacaggcugaugcagccguucucugugcagaggcugagccauccuaggagcagcuguggggugaaaguguccuuccuuaaacuuagugcuccugcucauucucucaguauggcuaauagcucauuuaaauauacuauggugguuuuuaauuuuugugacucauucccuccccuccucaccuguguuuuuccugugugucagggacauuuuagggggaccaaaaggaucucugucucugcucugugcuugcucugagguugaauagagaauguucagggcuguucuuauuugagucacuggagcuguugugagcucugacggccugggagccccacuacugucacaugaggacagggcgugggguggcucaagcauggccgcuugggguuggguccuagugcugucauguuggaggugucugaccuuugcacuaaguuuccccacuuacacuaaauggggauaaucaaagcuuuguguggggauuaagugaguuaauguaaccagaacacuuagaauggugugcugcauacagugauaaugcagaacuacucacugcugcuggagugcgcuguuauauucuuuauuagguccucagacuuuuucuaugccuaagccuugagggucucucucagcugugcuuuucuguuuuuuuuuuuuuugucuucaauagauuuuucuagggucuuuucugguaaaaagagacugggaaugcaaauacauugagcaugaguugagaggaguuuggacaucagccugaccguggaaaacuggggaggcguggaguauauaguuuccucuggguggguuacugacagaccaugggaguucuggggaaaauguaugcucuucucuuuaaguacaagccaccauugccaggcagaagcugauaaaguaauuagaauuguuguucauaccugacuugcaggaaugugugugcgugugucugcaugcguguguacguauauauacugugcaugcauauuuguguguguguacauacauauguacacacugcaugugucugcauuuauguacauaugggcauguggcaugggcauauggcacaugcguaucugugcaugcacacauguacacagcacacaugcacacaugcagugcauaguaugccugcauguacaugugcguaccaugcaugcauguaccuacacgugugcauacuaauuugugcacacgugcacacugcaauguguacuuacaugcaagccuacgauauguguuugcaggcacauacauguucacacacugcccaugcacauuugcauacacaugugugcauggaacauaugcaguacaacacaaguguguuugcauacauguacaaacacacauguguauuuaccuacauuucaaggugaacccuccccagaaggcucugcucaaugagacucugaaaguguucaaaagcauggucugagaaagcaucccuccuucagggcauguacccaaguagucuuucucuugcuggcugaaaucaucagggauuguuuccaaguuuuaacuucugauuuucacucuuuuaaaucccagagccgauacuugaacagaaguaaguuugcuguuacaccucucacuuugauuagcuuguugcguuaaauuaauugucagauugccugaaaccaaagcuucuuaaaaugaacacugguucacucgggaaauuuuugcaagaucaaaaauggaagacugugucacugaugaaagggagagauagccagaauacaaaaucuagagcuuuggaccugaaaucuggcugcaagaugguuuuuuccugucuuaccuaagaaguggcccccaggauucacauaccaguagccucuuuuuguuauucuuuuuuuuuuuuuuaaacauauccccuuguuaaagauccucuugauugcaagcaaaagcagccuacugugcaggcuggcuuaagcagaaaagggaauuuauuguggggacaugguggggaggugucucauuacugagaggaagaaggcuggcuggccucagaaggcaugagaacugggaccuggguccagcccaguccaugguggccacagcuggaucucagcucugcuccuccaggccagguggcugcuuucuccucucucugcagugggauuuucucugcccaggacucaugugucuaccugugggucuaaucuccuagcauaggcugagccugcaccuccuugagaaaacagauuagcuuagcuuagucugaguguucacuccaggcgcacccugagagggagugcagccugcacaugggguggguaguucuuaaagggagccugccuccagaggcgccgggggagggggggggccugcauuuagagugugugcguggagcauguagcuuguuccuguuuucauggagucgcagagaucagaaagcauuuaugccuguuucugacagagaugcacacagcuggucugaaugggcaggauuggggugagggcaguggaggagggaucuggccacacaggcagucugcugugagggccacuucaagccacucuucccuugcugagcugugauucguucuuuuccaagugacuuaaacagaggccuuuucucuuguuuguggggaugaggauggcgaagggaggaggagggagaggguggcugaguggaggaagcgcaguugugcugcggagauuccugcucugcagcuugucugcuguggauuggcccaggggguagguggcacaguguguguggcaggggggugggggggaccaggccuggcuccgcugguccacucuugggcugugagccaggacaaaaucuuauaccaagcaagcaucuuuuccaguaaaauagagugucuccaugcccuuaggaacugccugggacagccucauucuguccuggauuuuguucugggcucugcugccuguugagcguggaccagugaccucguaacuguggcagaggugaaggucucagcaccuucugugugcccucuugcauguguguuugccagcaugcuuggggcuuucuucagguguuucuggccugaggaagugucuuacccccauguuauuuguguggcugcacagcaucuggagggagggauagagccccagcgcugggcacaucggaucugugcucugaacagcucuguugaugccagagcugccugacuugcucuguguggugcugugaaggucaggcuuggagagugaggagcugcugaaaaagggugaguuuuguucucuucuuccagggcucagucuuccuuguaccaguuucuuucucuguucuucucuccuugacucaggaauccaguuugcgcagcacuuacauggcgggcaaacuccaguuuauaccuggagcugcagggcggagcugcugucagcugggagcuguuauugaggaacagcugugguagagguggauaagaagaagaccugaccccaccugcuggggcaagaagccugcauagcacagcuaaacagccaugugggacaacggcugagcaaugacaguggaacccagugucccaugcaaagugcucaagaaguggacgggauggaucgcugcugaguggcucuugaggagcucagaguaucuuggggcugauguugccuguugggacuuuccccagcacagacagcgugcgggauuucagaugcucuucuccuugccuucagaagcccagggaguguuggcagcuuguuugcaccugaucagauaaaagaggucaugaucucugugaaggucuuuucggggaaggggucacuggccuugccaaaugugggaagcgaggccucuucccaguucugccugugacucaauggcuguggcucagggcaagucauuggauuuguuuuuuguuuuuuuuuucagaauaacgucagcaugugcugagcaucugacucacggggugaggcagugaaugaaggacuucaucuccgugaagugcuugacgugauagaaugaaaacccuugcguucccagccuuggcugucagagucucauuuuaaggaaagccguuuuugacguguguuuccuuucaguucggagcuggcuucuguuaggacaggggguuucugcccacuuagcugugucucugguaaucugagauucuuggaaacgggccacagugauuccucuggccacauucagggucagguuuucaguucgucuuccugguguuuccgcgccucauucuagggggagguuuagucguuccuuucucugcugucccccaguagcuuccggccauuccuugugaaggaaucuuccuaagucaauuuucccuggugaagacugagcccuggaagaagagaacaaaucucauccuuugucacuugggaauuucacuggcgaaauucagugaggcacuugagguuuguaaaugggcagacguuucccacacgauuacgucuguauguuggaaagauauuucuaaguuguagugagguaggagggauucucagcgagaggaggggcuugggcugaacccggcacugcugggacaugaacaggggaaacagcguuggcgguggagcagguagacauucccuugaccucguaaguccuggaugccacccggcgaacuggccugcgggcuggaaaugaugcagcugacccaguaaacgcacucagcucaccuuuuagucugguccagaacgcugaauugagcucuuggaucuuggugcuaaauacgugguguggcauuaauggcaguaaagauggaugguuauguaccauguagaacgugcaaaucuguuuucaauaggcuuuauuuuuuagagcaguuuuggguucacagcaaaauugagcagaagguacagagagugccuguauaccugcuaccccaacauccagcuuccccuauuaguuucccuucgcaagaguuauaguccacaaaccuacacugacacauccuuaagucucccaaguccacagcuuacauuaggguucacucuuuuuuuuuuuuuuuuuaagauggagucucacucugucacccaggcuggagugcaguggcaugaucucggcucauugcaaccucugccacccggguucaagcgauucuccugccucagccuccuaaguaggugggauuacaagcuccugccaccacacccagcuaauuuuuguauuuuuaguagagacaggguuuuacuaucuuggccaugccggucuugaacuccugaccuugugauccaccugccucggccucccagagugcugggauuacaggaggguucacucuugcuuuuguacauucuauggguuuggacaaauguacagacacacgucugagaaaauuguggguuugauuucaggccaucacauaaagcaaauacggcaguaaagcaagucacacacaguuuuugguuuccuagugcauacaaaguuauguuuacacuguauugccgucugugaauagggcaguagccuuaugccuaaacaauguacggaucuuaauuuuaaaauauuuuauuacugaaaaaugcuaaggaucaucugaguuuuuagcaagucgagucauagucuuuuugcccagauguugauggcugcugacugaugacggugguggugguugaagguugaggugguggcugcgacaguuucuuaaaagaagacaacaaugaaauuugccacauugauggacucuuccuuucacaaaagauuucuuuguagcaugcguugcuguuuagcauuuugcccacaguaggacuucuuucagaauaggagucaguucccucaaacccugccacgucuuugucaauuaaguuuauucugaauccuuuguuguaauuuugacaugcucacagcauguucccuaggaauagauuccaucucaggaaaccacuuucuuugcucuuccaugucuuuuuccagguucuaucaugaguuugcagcaauucagucacaucugucgucuccacuucuaguucucuugguguuuccaccacaacugcaguuccuucuccacucuagucuugaaccccucaaagucauccaugaagguuggaaucagcuucuuccacgcucugguuaguguugauauuuugaucuuuucugugaaucacgaauguucuuaauggcaacuguaagggugaauucuuuccagaaggauuucacuugacuuugcccagaucuauaagaggagucacuaucuauggcaguuauaguuuuacaaaacaucuuucuuuuuuuuuuugagacagagucucgcuaugucaccaggcuggagugcaguggcacgaucucggcucacugcaaccucugcaucccagguucaaggaauucucccgccucagccuccugaguagcugggauugcaggcacacaccaccacgcccaacuaauuuuuguauuuuuaguagagacgggguuucaccauguugggcaggauggucucgaucuccugaucucgugaucuaccugccucggccucccaaagugcugagauuacaggcgugagccacugugccuggccacaaaauguauuucuuaaacaagacuuaaagguugaaauuacugcuugauccaugggcugcagaauggcuguuguguuaccaggcauggaaacaguauucaccuccuugugcaucuccaucagagcucuugggugaccaggugugucaucagugaucaguaguagucuuuugacaggaguauauauuuuuuuuccgagcagucucaacacggacuuaaaaucuucaguaaaccgugcuguaaacagaugugcugucauccauguucuguuguuccauuuauagagcacaggcagaguagauuuaacaucauucuuaagggugcuaggaguuucggaaugguaaaugagcauuggcaucaauguaaagucaccagcuguauuagccucuuacaggagaaucagacuguccuuugaggcuuugaagccaagcauuggcaucuccucccuagcaaugauaguccuagauggcaucuucuuccaauagaaggcugcuguaggguagccaccuucaucagggaucucaguuagaucuucuggguaacuugcugcagcuucuccaucagcacuugcugcuucaccuugcacguuuaugguauggagguggcuucuucccuuaaaccucaugagucaaccucuccuagcuuucagcuccucuucugcagcuuccucacacacgguuagcuuucauagaauugaggagaguaagggccuugcucuggauuaggcuuuggcuuaagggaaugcugcagcucauuugaucuucuauccagacugcucacaccuucuccguaucagcaauaaggcuguuuggcuuucuuaucguucauguguucacuggaguagcacuuuuaauuuccuucaagaacuuuuccuuugcauucacacucagcuaacuggccuuccucacuaagcuuaaucauuaucagcuuuugauuuaaggugagagaugugccgcuccuccuuucacuugaacacucagaggccauuguaagguuaccaauuggccuaauuucaguaucgugguaucgcagggaauagggaggcuugaggagagggagggagauggcagaacagccagugagugggggagucagaacacacaccauguuuauccauuaaguuugccauuuuguaugguucauggugcuccaaaaugauuaguaucaucaaagaccacugaucacagaucaccauaagauauaauagugacaaaguuugaaauauugugagaauggccaaaaugugacauauagacaugaagugagcacacgcuguuagaaaaaauggcagugauagacuugcucgauguaggguugccacagaccuucaguuuguaaaaaacacaguaucugaagcauaucagugugaagugcagugaagcaagauauacgugucugaugaaagcauccgccucacucuguucugggcagugucauauggaauagcuucgcugcccuuggaauugucugugugcucccuguucaucccucccaaccccgauaaccacugaucuuuuuacugucuccaucacuuugccuaucccagaauguuggaaucauucaguauguagccuuuucaaauuggcuucuuucacuuaguccuauguauuuaagguucuuccaugucuuuucaugacuggagagcucauuucuuuuuagcacugaauacuguuccguugucuggauauaccacaguuaauccauuugccuagauguguccaucaugacaaaggacaucuugguuguuucacauuguagcaauuaugaauaaagguguuaggaacauuuguaugcagguuuuuguguggacauaaguuuucaacuccuuuggauaaauuccaacgagugcgcucacuggacuguauagaaaguguauguuuaguuuuguaagauccugccaaacugucuuccaaagugugcaagccuauuuuuugaccagggcgguuagucacacauagcagccacaucuguuguggugccuuccugggaggccccucucuuuuauagucccaucagugccaccaucugcagggucaccagagucccuguagggccagaagcacaaguauggcugguuccuuaucucccuggagcccuggcuucuucccaccucucuccagccucaacuauuuuuugccuuugcccuacggggacuggcugucgguucuuccccgcguggcuccuccccgcacugucucggugggagcaucguccggccuucaugcccuguaagaugcgguucagauggcaccuccucugugacgcccuuccucucauccuacuagcccaauuaaaaaaaguuauuauaguaaaguucaaauauauguaaguagacucaauaguauaaugaacucugccugccccucacccugccuuuauccgaucagccuauggucagcccuguccuguccaugaccacccuggaaaugggccccagaaaucaucuuauuuuaccuauaaauauuuuagugugugucucuaaaagauaguuugaacucacaguaccauaaaucauacuuaaaaacaauuaacaaguuccuuaagggcauccauauuuaauuaucgcucaaaucuccauuugguuccuaaauguuauaccuguauuuauaauuuuucuuaauucaggauuuauauaaaguuaccgacugugguugauucauacaaccucugguucuuggaaaaucggaguuuucuuuuuucccucugcuuuuggucauuucauugacuugugcguacagguuuuugugaagggagcugggaaucgccuuacuguuuuccagccuggauuuuguggcuugcgucuccgugggguaguuuuccauguuccuccgugcucuguuuccugcaaaugugaagucggguguagagccuugaugagauucccauuugauuuguuucuuccucuuugagggaugggcgaggcugcucgccacguggggucugugcugcacucuuggaccuggaggcacagggcacuggguuucugugguggaggcaaccauugauacucagugucuguaucuccuaguucuuuaggcuuucaacauuguaacauuuuaauucuaucugcgaguguaauuucuuugcuaggcuguuuguauaaagagaacuccccccacccccacuauuuguuuaccuggugguacuguccaugggggaaagauaacacccaugucaguuucuuccuuuuauuuaucaguuucuagucagugguaaccagauagggcuuuuugcuuguuugguuuuauggcauuauguggacuuacacauuugcauuucagcuuauuccaguuauuauuauuaggguucacauuuucccagcuuuggucagugaaagcugcuugaggugggcccuacaucccauuggcgugauugucauggccuuugaggaccguguugcuguauacugugguaagauucccggggucacauugucuguuccugccccagaccuggagucagccuuucccagagagcccugguucucugugcugggaagcguuugcgguucgcuauugggcucagggcggccugcuuuccuguuccuccccugugcccucggcaccuggccggagcaucuccaagcgucugccaccauacacugcaguccucacuagccucuugcaugcguugggggugggggugggggugagugggcgguguuaaaggcuacaccugggauucuccaggccucagcagcugguguuguaagguuacauaguaacaguguuaaccagcuugcccugucuuuucucaaaguuccacccauucaguuccagggguccaggacgugccuaucaggaacagcccuuggaugcccuuggaugccugccuuguggaugucaucugcucccaugucagccaucuccagggcucuucccgagaagagggcaguccccgccaaggguguugccucucaaaccugccaaacuacaaacccucuugguaccuccacacaucccuggagucggcuuuggggaacacuguguuccaugucuaaguggagucccgggccucuccccuccagugucgccugugccagcuggacacgaagcagcagaucagucaugaaaauggcugcucagcuccgaucugcccuuccuuccgcaggacucagggacgcacagcuccccagggcuggucacccaaacaacagcauuccuuucuccucggccucuccccaggcugcuugggagagaaaacuucccucauccuccuccgcacacacuaaaugcccugccgguaucuucuuuccagugacuguggccccaggucgucacacauggccagacacagcugaaucucaggcuagaucauguuggcacugcuuccaccccuuggauaaaauaaaauucccagugacuuccuuaauauuuugauaggcugaguggcuuauaugcaaacuuugauguaaacacuaggccagaaauugguuaacugugguuuaggacuccuaaucuuucuccggauuuauugaaaacaugucuuagaaugguacgcaccaagugguucucccugguacugcauccugcuggccacguacccuuuccugaugcuccucugaagggaggauguuuaacgcaaugaucuccagccaguguccaaauggcauagagccacuuccuuguugacauucccugggaucuggaggucacuuccagcucuuuccucuuuucugcaagagccauggugcugcaccugccugcugugugcuggcacaugccugugggguugugaaggcuuuguaugggucccuggaccacaccugaggaggcgcugucuuagucccguggcgggcgguggggcaggcucccugcacuggaggaagcaccagcaggcuuuugugcgugaacagacaacucuguuggcuuuccugcccuccccuguuugccuucuugauuuuucccuucucuuuuuguuucugucuccauccugguugcauucccucacuccccucuucuuugucccugccagguuucugauggguuacuucuuugaggaggagaacccuaccaccauuccagaauacucaaggcaagguuugaggggagaauuaggcggauguccauuucacaaggcuuuguuuuugccgaggagaacaucagugucugccuuuaguagguugccaucaucauaagcaauaauagcugacuguaacucagggacugugcugggaacuuuccaugcccacggagucagucccuucagcagccccaggaggaugagugcuuuugcauaccccacuuugcauagaucccaaaaaggggacauugggacauugggagcaucaguaacuugcucgaggucacacagcuagaagaggggaggagggauuuagaauguauuuauuuaucuuauaacguuuauuuuuugauauauaaauuuauauuucccuuuguaguuuauuuaaauacuguuaugcuuuuuuuuuuuuuuuuuuucaagggacagggucuuacucuguugcccaggcuagccuugaacucuugggcucaaccauucaagccucagccucccgacuagcugggacuguggguuuagaauuugaauccaguguucacccuuccuccugagcggugcuguacauuaugaacagguuguuugccaggaacugggauaaugccauuuuccucauaaaccuuugccccgcaagcauggguagacagacagcuggugcuuuccuugguuauauuuggcaaacuauauaaccaaaccaaacuugauuauauuuggcuaguggaccaguucuuuuguaguugguuagaaaagaaaagauaucgcuuucccuugaaagaauucauucuccaugagauugagguucagaaaaucuguuaaauaaaucccaagcccugaggccuccaaaucaguggcugcuccgcugcuccucucucucccucgaccuggucucucagugacccccucaucuuuucaaaucauagcauguugggacaaguguuccagggaaggccucugucaguguuuagcuuacauuucuuggguguaucuuuuugacaaaauuuuccccccagggauaaggaaaccagaaaaccacaguggaucagcgugcaggaaugcauaaggguggcucugugugugugugugugugcauguacauacguguguguguguguucauccguguguguguguuuuccuucagagcauuuuaaaggucucagcuauuauuaacaugaauuuauuaucuauauuuaggauaagcccacuaaggaugauuugggaugagcugugaaucugugguguauauauagaucucugcacacgcguauagugcauauuuaugucugcacguacuccugggcguugacaucugccuguggaaugcagacaucucugugcaggguuguggccugucgucucuugauuggcaguugaagugucccgcauccccuuguuauuaauaacuugcuuggggcuacauugaguuggggaugugcaguagugauuuaucaagacauuguuauaaagacacaaggcugguuguaauagucuaaucagaacaaguguauucaaaguggcgaguuucaagcaugcuguuuaggagacuucacacuuauuuucagcguucagaacauuguugaaccucugcuuuuggcaucguggucacagcuagucuaugagccuuaggagaaauuauacuugccauuuggugcccacugugaguuucugaccaagaacaaaauuuccaagcuugaucaccugccuuauucgugacgcuuggcuccaagugguuguuagcuguuuccaaaaaacaaaugugcuuuagaggaugaacauuaugcuguugucucugggggccaacccguuaggggaguuccagaaauauuuugaaugaugacagcaucaugggaauaccaagggucuccccaggggacuacuuugaagaggggcacaugcagguuggucaugucuuugugugaguuccaggguucgaaaauaacugacguauacugguuguguaugucuguguguguguugcccgcacagcuaaguuuagacaccgagcuuuggagaccucugagagccgacuccaccuuugauuuucaguugucuuucauuuuguacccauuugguauugucuugcuugagccuuuguggaaauagaccuugacuucauuucuuaagucuuuuuuacuuucuacgauuauggaaaggaaaaauauauauuuuauuuagaaggcaacagguguacuuauguucuucuccuauaugauggguaguggaaauguuuuaauugccuucuuuugucuacuuuaaccucaugaucauugccuuuguuugcuagucucucagcaugcgugguuuugaaaaugaccugcacacuuagcagaugugauacagaaaccaaacccccgaaccacacugucaggggacucuaaaaaugugaaaacaccugguuuugguuucuuagucauucuguuuauuuggugaacucuguagcuucaaacguacagcuuugaccacuuaaugaaagcauguggauagugacgugaggaugaccugaagauaugacucccuguccuuuggacuaaguggccuuuaaaccagucacgugccuggcucaacuuuaaaaagaaguaaagacauugucauuagaucuauacaaugucaagaauauuacccggccuggauuuagguggaaaugaauuaagugcaaguacugauagguacuuucuggggguuaauuuuauuauuuucuucucuuuaauuuugauguagacauggagacagcagagggagagacaccaauucuuaagcauguugugugcugguguguugcaaaacauugcugcaagagcugucuaucacccgcaagagcccuucugaccugaucuguggucguacuggacuuguggcaagcuggaauguccccuugucaccaguggcguguuaauguuacuaaaaagcaaggaaaauauaauugaguucucccuaaaucuaccuguggcaugaaaaaaucucucagguugcaucauguccagaaauaacuaugguggggccuaaugggaguaauucccuggcuccagguauuuggaggaggcaggcagcacuucucauuggagugauuuggaaccaaggcaguacauuuuccugcuguuccugaacaaucugaaguuuugcagauccuuggagaaauaaaagccacagucuuggaaccucccaccuucuuuuggccugaguccuucucaugaauucagcaaccaaaauggagucauggggacgggugggaccugccgugauggucccaccugcauuacccccauggcagacuagggugguguggccugucugggaauguggucuuucucucugagaacccagcuaugugguuaguaacucaggauuguggcccugugguuacugugcacuaaucagcccuccaaacacuggaggagcacacccuggugucugcaccgcuggcuguuuucaagaguguuguucucuuccaccaaacagccuacacucagcccugcacucagauuuugcuuuauuuguugaugaagcuggaaagaguccauuugacguguaaccuggucuccgcuaagcgguuguucucuauucuugucaaaugugaaggcuucccaagccugguuaugcauuguuggcugccaaagagggccaaguguuugaaagugaauaccagauuagagaauucauaaaugaagaugcaauaacccaucacacaauuagagugcaggaucccuuucccacaaucagaguaacagagaugggacuaaggaaguuguacaggccagagaagggagggggcuguggggagaaagaaggaauagcugguuagaaugucccuguguuucucaaauucugcaguuuccuagcgaccccucccucaggaguguagcgaggccuggcugguguuugacagcgucacauauuuuaaauuaaaggcagagugaauaaggagagaugaaagguuuacugcguuuggaucgugagucuuucagccaagaucgugucuuaaauuuuguaucuuguaauaucguaucugugggauuucgucaauaaugcugacaaaaucugaaguuguacaaagggauagugggaguuucucaucagaggucauagauuuugguggguaagagugcugcuugcuuagagggguuuuggcagcugccuucaggcagugagaaacuguuaagguaggaaggagaacagacaacuucggcuuagaugagaaauugugagcacuuuccaacagugacaucccaguacucuguuuaagugaaaagcugaacucucuuaaaacucucuugccaugccucaugucaucauuucuccaggauuggaaugugugccacuccuagaaaggauuauuggcagaguuucaaugucucucuccugucuuucuuuuccucucuucauuccaugugaauauacgaaggaagguggcuccccacccagugcucagagguuggguggaggcagcacacagacagguagugacccuucaagcauggggaggccagaguucagaggacggugugugggcuacagccaaagaggagcgaggagcagggaggccuuuuggaacagaaacccugagccacacuugaagaaugaugagguucccuagaugagugugugggggcaggggugugggggcaaccccagcagagcuguggagauggugaugggaacuucccagagcaggagugugggguugcugugcuaggagagggcuguaggaacacccagaguggagacacaggcagggccaguucggcgggggcaggcaccccucugcagaauguggaaagggccuggugaugaguauagcugagagagggcagccaugcacuuuuuggggcccgcuggggugcucugagagggagggauggaagguugcaagccuggauucuugagaccuggagaccagggaacagagugaccuuugucuuauaucauaaggggguugcaguugaggacuaacggaugccgaugccucgagaggguuuggggugugggaagagaggcccccgccuccauccugccucgcggguagaaacaugagcgggaaugagagugguucagaaggccauccucccgcaggcagccucacucacguaccucagucucuccucggaaaagugugugcaugggauuguaauaucgcaucuaugggaaaugucaauguugacaaaaucuaaaguuguacaaagggauggugggaguuucucauuggaggucauagauuuugguggguaagaguguuccagcccguauaaccccacgugcacacuuugcugaggagagacugaggcacgccaaggagugacugcacccagcgcagguucagcaguggccaggacgauaguccccuucaggauuuggagugaggagaaaaggauuuauggggcugacauuuguuuucagaccuaaaccauuccuguaaaauugcaaccuaauugcucagucuggcgguuuccucuuccugguagugggugaauggagguggggggagcgucuccccucuuuuuuggauagauguuaauauuuugcacugcuuuuagcaccuggggaaaacccauuaaacaaacgucccccccucccauugcugccugaggcaggggcaugugacccacacacccuacuuuacucggaaacagugacuuugcagcaacccuaaauccugcugugagccccgccugcgcuggugcugugugauaaacugacaccucccccuucuucucuguggaagacucucuuaaugcugugagccccgccugagcuggugcugugugauaaacugacaccucccccuucaucccuguggaagacucucuuaauaguguaguuugauuucaaauucauuaugaauagauuuuuuuuuuugaguuggaguaucgcacucucaccaggcaggagugcaguggcgcaaucuugccucacugcaaccuccgccuccuggguucaagugauucuccugccucagccucccaagcagcugggacuacaggcaugcggcaccaugcgcagcuaauuuuuguauuuuucguagaggcaggguuucaccauguuagccaggaugguuucgaucucuugaccucgugauccacccaccucggccucccaaaauguugggauuacagaugugagccacugugccggccgaggguuuuuuuuuuuaauuuuaaagagcuggaucuaugugagccccucgcgguggugguugcuguaauccuccucagugauacgcucccgugcucaguucaucagaacacuccugggugcgugaacucuuuugaggugugaauuguugcacuguaacucauuccucauuaccacgguauugcugacguggcauguaagaugggaugucuuacaggccaagacggaaccuccccucaguccucccugugaagccagccgcuguggcccuuggugcccucugaggagccaucuaucccagcggcccccaagggcugugugggggaugcaggcacagacugaaugggaugauuugucccaaaugcagcuuuucuuuccuucucuagaguuucucaucaccagcuggguggcugcaggaagggugucugaauccuuaccaauacccaugaggccagggauggucaggcccccagaaggccucuuaguacucuucuggccaucuggggccaucuguccuauagcauagccucucugucacaucgcacucaccaugugcagguacuucuaaaugcaagugcgcuggagaaugugugugugugugugugugguuaugaaggaaaacaggaccuucgcuugucgugguguguacaagggcaggcguguguucuccgauguuauauggauuuuguggcccugaagccgucagccacuuggaguuuuggggggcucugccucuuccccgaagcucuguucuguggaggccacagagcccagcgucugcauggcugcuuauuaaauucagugggccacuugggucuugugcaccagggauggagccacuggcuucuggguugccucuggaguugcuggcuuuuggauagggagguaagggagaaaguaaaacaggaaugaucuuagagaagggacuuucauaaggguguguguguggcgggggcgggggugguuggggggagguaggcuuuccuuuuuucccccaagcuagucucuccugagugucacaagagccugaguguuggcugggaggcaucugucuucagggccuuccuugcuccagucuccucuucucuuggaaguuccucuuucugccagagcaucagcucaggacagccuuccuaagcccccaucuuccuauauguggggugccccgagccccauccagggcaccugcgcuuucugguucggggacaucucaugccucagcacuguugagagcagcucagccuggcacuuuguggauguuugagucaguggagaggauuuucuggauuaucagcaauacuuccaccagcuccuucuuccugaagcccccgcgacacuugugaagcacacacccugcuuuuacucaguggccaaaugccgccgcuagcgacgcaucagucauucgguguauuucgggcucucucauaauuuuaugaugaguuugcuguucguuuguagucuguuucuaaucuggcucauuaggaauuagcaaaacuugucucuugcucaaaauagauuguguugccaggauucaaagccaaauucugacugcagauaugcugcgaauuuuucuguuucuuuagacuuuuuucuuuccuguccuauaaccuguuuguuagugggguagaaaauccacaaauuuaacucuuacuauuuuauuuuuuagagaugagaucuugcucugucacccaggcuagaaugcagaggcgugaucguagcacccugaggcuucaaacuccugggcucaagugauccucccuccucagccuccuaaguagcugugacuauagguguuugccaccaugucuggcuaacuuuuuaauuuuuuuuguaaagauggggucuugcuguauugcccaggcuggucuugagcuucugaccucaagugaucuuccccucucggccuaccaaaguccugguguuauagaagugaaccacugcaccuggcucacaaauuuaacucuuucaagaggaaacaauacacccaaggguccuuacuuuuuuuccccccaaaauucugucacuuaaaaauaaaaguucagcuuucguuuuagacucagggugcaugugcagguuuguucauggguauucugcaugcugcuggggguuggccgaguguccuucugcugugacugguugaccugacacugaaaaggcugcugaguucuguuagucacucagcaucagugcauuggaucugaaaggaccacagguuguccccaggccaagcuccuggcuccgcagagcaggcauugcuucugcagcuuccuguggacaggcaucacccgucugcugaaguacgcugaacgggcacaauugcaggauuacugccuugagaucugcaugaccuccauguucuuacuuguagaacguggagcccaagucuaccaucccugcaguccucucuugucucugaagcuuugagugagcugaugcccaucacuguggaacuuuguaguccuaauaccucuugcacaugaaaaucucucugcuauuugaagaccuuucucaucccgccuucuacuaccauccauaucuuucuucuguaagcuaaaccucucuaauugccucacaugauaagauuuugagggauuucuucaccuacccacagcgcugccgcagccaggccucaugauaccuuagcucauaauagccaccgaguggcuugggagaagcacuuagcauggggucuggcacuuagaaagcacucacuagaugcucguuucuggacacugcugggcacuggcugauguuaaggacucccugugcucagccgguugugaaggguuugggagccugguguuuacccccacuguuggaugaggugcuucaaggaacaccaguuugauacagaggcaguuugggguuuacuagggagucagccagcgugagucacgugguaucaggaacaccgggcccuggggaccgaccccugugucuccccuaaguaggaugcucccaugcaggagcagaaggacaagcagcccggagcugcugcccggcugugcccaaagugggauuucugcugaucaagagucuggaauuuacacuccagcagguuuggaagucucggcgacagcuccuguauguucagucaagcuuggcugaccauggcuaaaccacuuuaaugaguuuaugggacaccagcgaagcugcaaacugggucgggaugaaagcugagugggcgggugggggcuuaaaugggaaagcacugggagggcuggcccacacccgugacugcccugcgucucaugggagcagaaagguggaggcugagccugagacaggguaggaaccccucuuaggagccugucaggcacccuccaacauaaaaauuuuaaaaauuuaaguauuaaaaaaacuaggcaucucgcuagccuugagaaagaaaucaacaaccuaauaaacaagauagcuuaaaacaguaucuaaaaagcuaggcacaaaacguuuguuuuuuuuuuauaaaaauuaaauaccuuaacauaugucccugagucguuuuuuagaaaccuggacccccaccaaauaauaaaugcugucugcagcacauagaccucggguaacagaaaacugaggacacaacucugaccgccaguuuuaauuucuuucugagaggccuggaggaagacacuuccacaggccagaugcuaacauucauuucugcugaucccaaauuccuagacaaagcuuugcuuccuuaaccaauagcaaaucaaaaaaccuuugaauccaccuuugaccugugggcccugcuuugagacaucccaccuuucuaggucaaucccaugcagagcuuucauguauugauuuaugacuuugccuguaaccucugccuccccgccuuuaaaaacccuuaccuguaagccaucugggaguuaggucuuaagcacuagccacccaauucuccuugcuuggcacccugcaauuuaaaccucgcacugucucgcugcuauccugaugucagcguuuagcuccgcugcaccagccaaguagaccgaaguucgguuugguaacaagcccuggagagauaaggcaggggcuuggcugguccagguaugggguccuguuggaggccgaagagugagggucgugaucaacucaguauaccacuggaggcuauguaaguaagcagcgaacuguuucucauaaaugcagaauguuggcaaacugacaaacugcgucugccacccagaagugaugcugagggcaguuaugacccagacgcaaguguuucuuaugauuaggcaucauugaagccuguuaguaacaguaugaaccugugaucaauuaagcagcugaccaaucguuaccuccuuccugcucuuguuacccaauaaauaggaagggcuguagaagcuuaggggggcugccuuugcucacuagaagcagggugccuuuuuccucuucuucuucucucuucuuccccaugcuagccuucccuuaaaauaguuacuuuuguuuuuuguuauuucuacauucaucccuucaaucagucucguaaugacggucucaaguagcaguaacaguaguaacuguggcggucagcaacaggguccugggaguaacucucuucugauuugguuuucacugccccgaaauagauagggguaggggagaccaggacguccagccugagaacuguuaaaucacccagauuuccuaagggaagaacacaccagacuccuuuucuguccaggggcuugguggccaucucuccagcugauacugggagcgucacagugggaugaggcugccuuccaucacagcuccuugaacccugugaaagcccgcagaggcugaguccugcacccccucuaguugggucugucucuuccuuugguuuuccugcagggccaggccuugcugagaaugugagauugggagccaugaggaagggacuguacuagagaggugacaugcagacugucuuggaacuugcuugggaagagguggaagauagugguacauaaauggaaaaggugaucugugcauuucuugaagcagguacaaaccagugguugaaagaauuaaaacagccauuuaaaaaaaugugacuauuuuguugcaaaauaaaggacugcuauauuaguuguuucucuucuuucugaauuccuguaagaauauccgagugucuauugugcuguguuccuuuugcccuggaauuguguuucuugagcgugggaugagaggguaacauucuuccucugucauccuccacccuauuauagaacugaugcauauuaauuauaaaaauacagccuagcauaaggaagcaggaagaaggaacacauaauucaugccgcguaagcauccccaccacggugccuucuaggcuuuauucuguuugguuuuuuaauauacucgugguaacaauguguugcaguuugguuuuuuucccugccuugaaaguuuuaacacuauauuguauuuuuacaugaucuaaaaagcuuuuauuaacauuguauggauauguccaaucuaccuagcuaguuugguuuuguaacuuaugaugaaccuuuuuauguaaaccuuugcaauacauucuuuacuauguccuuggaauagauuucuaaaaguggaauuaccgggucagagaguuugaacauuuuuaaggcuuuugauagauguucucagcucuuuuccagaaagguuguacaaguuuacacucagaccagaagacucuuuuguaccuuugccacaucguuaauauuugcaaauaaaaucuuuguuuauugccuaggugguaguugacguuucuguuucgauuucuuuuuucuuuuuuuuuuuuuuugagacagagucucacucugucgaccaggcuggaggcuggagugcaguggcaugaucucagcucacugcaaccuccaccucccggguucaagcaauucuccugccucagccuccagauuagcugggauuauaggcgcccgccaccgcgcccagcuaauuuuuuguguuuuugguagagaugagguuucuccauguuggccaggcuggucucgaacuccugaccucaggugauccgccugucuuggccuccuaaagugcugggauuacaggcauuagcgccacaccuggccuuaauuuugauuucuuuaguucccuugaacugaaaagugucucauguguuaccugaucccguagccugcuuuucucauacuuuguguuagcuguuuaauaaauauuacaaauugcaacccuuugucuauuuuuagguaauauuuuccccacacuuuuccuuuuuuuuaaauagagaggagacuuaacuuuauguaguuaaauucucauccuuuugcuuucugguuuccuccauuucuuuuaagcuuagaaaugcuugucucaaccagagaucagguaaguaauacuuaauuacauauuacucugauacuugguugguuugcuugauuuugauauuuaacucuucauccaccugaaucuguuuuuuuuuuuuuuuuuggcagagucucacucugucaccaggcuggaaugcaguggcgcaaucucagcucacugcaagcucugccucccggguucacgccauucuccugccucagccucccgaauagcugggacuacaggcucaugccaccaugcccagcuaauuuuuguauuuuuaguagagacgggguuucaccacguuagccaggguggucucaaucuccugaccucaugauccgcccgccuuggccucccaaagugcugggauuacaggugugagccacugcaccuggccuauuugguauuuuugagaagugcagcucuaaguugguuuuauccccuucccccaauuccuaaccaguuguucaggugagacaaccauuuguuauuucuuugguuucagagaagcuguaucuaucuaucugugguguaucccucucaaaccuccccucauucuggguugggcccaggaggaggguauccaacccagaccugguggagaggagcagcuuuuuuuaaggccaguagugcucaauauuuauaaacuccuucuguaucagcucaugagacauuucacaguuguacucuucgccugcuuggcugugugacugagaggagcugggcguggggugauacagcagcgagcaggugagguaucggggcaagcccaccagcaucucucccgugucaucugcacuucaguauuggauuccuccccguggacccagugcucagaaaauccaaggccagucuuggugcuaccacuugcuuagacaaaucacugaguugucugugucagccaguuucuccgcuguauuuaaguaugaucagugugaacuaaaaaccuauuuggccugccuguugugaggcuuaaaugagaggaaguaucugagaguguuucaaaucaucuaaagcauugcccucacauaauuucaaagcaauauuaauguauuaauuugagccuuuaggugcuaaggguuguaagaugcaccaucauuuugucaauuuuaagaugcauuccccauuucagagaugucggaacaggaaaagccaugcauccuggaauugguguuugguccugacucucauggggggugagaaaugguagagacaguguccuagacucggggguggggaugcgagggguguagaggaagacagucauggauacccauauuuuauucucuaaugauacagaaucuucauuuugggccgauuccuguggcucuauuuucucuuuguaauucuacuuugcgaugcauguuucagaagagaaaccauuuuccagcuuucuucaucucauuuccguugugcuaacagagaaacucugaauucaucugaggugcuuuuuacuuuucuuucggugaauugucaggcaugagccacagaagccauccgaaucagguuucuguguggaaaucacacggcggggagguggaggcacaaaaugaucuuaaugacaugcacaucuuccugcucccuuguggagcugaguguggggggcccuuugcagucuggcaggcucggcucuggauuugaauucagucucugccauuuaucacuugagggaucucagaugaaugcucuuucccuuucccuuuccuugagacacagucucccugugucacccaggcuggagugcagugguguggcagccucgaccuccuggguucaagcaauccucuugcuucacccuccuaaguagcugggacuacaggugugcaccaccacgccuggcuaacuuuuucauuuuuuuuuuuuuuauagaugggggucucacuguguugcccaggcugguccugaacuccuggucucaggcgagcuccccaccuccgccucccaaaguguuaggauuacaggcgugagcugcuguaccuggccaagugcucucuuucugauccuuaguuuucucuucuguaaagugaggauaaaaggauauauucuggagcguugucaggagaauugaaugagcugcauguguaagcccuagcagaguuuccuggguauagaggaggcacuuagucagcgucaccuccuucccaucuucucaggaguuggagggugacagagcagaggaaauuuagguuuucacucuucugggggugggucagguaacuaugaucgaaccugcacgcauuguuuuagugccacguugauugggucgcgccugaucauuugcuucuggucugacugucccagaucccugucagcacaugucuggcaccagccauccucugauaacccugccauagagcuccaggagagaguggggccuguuccugguggccugaguuguugaauuguacucuuuagacaucgaaccuaauguuucaaaacacacauucauucgugaggccugucugccgcgcuuucucucccggaugugaguuccagcacaugcaugcacccccucacugccccccauccagagccacagccugcccugucggaauauguccagcccuaaugagggaggcguugucuucagaucacacacuccgcagcggcucugcucugccgcgccccuucaggagcgcugggucugagagaggacuucagaaauaacgggggcaacguuccgcuuugaugcuauuauuagaauuuuccaaacaccgcuuguuuguagcuucacagggacuuggagagaggcgagugggaagagguugcugcuagugccauuguacgggaagcucaauggcauuuaucugguccaaggucauucaacaagaacagguugaaaucacccucagaccgaagagccggccgucugugcauuuugcuuuucccgcaguucagccgggacucugcuucacggaugcuuucaccucacggacagcgaagccagacacacaggcccugcgugguugggggcgagagcauuuuuccauagucagugggcuauuccgaagcuaagagaccguuuccuugaaccaaaaggcugauucuuuccugcuggagcuccuguuuucauacucauuucccuggggaguggagcugaggcguguggacuguucccacccccgccugcacccaauaagcuuugggggagccaaauagugcuuuucacuggagccugaguggaugcagggaggcacacaugcuucauagaagggaaucagugaucugucccgcugcucuggggcuccagcauggagcuucacguaggcuggggugggguugguucugugugacagccugcacagaggugguggauauggccgaagccacuucugcuucaugcuguguuugggccagauguccuugguggcugggagggucugcuguggaggugcccauggucagagagccugcaggcugcaguggcugaccucuccccuccccaccuggcuuugcugagagggugcuugcuggguguucucagcugggcagccagccgaggcugucacagugacaagggaggaauuauuuucucuucaagggguggaugugaauuacuuaauuauuugcagaaguuucauugcuuuuuacuuacauucuccugauuccuccccaguggaagcaucaagaccccacugcaacaggcucgucagcaucuugucacagcuguggauguuugccaggcuuucuggacgaguccagcucuagauugcaaccugguuuagcuacacacguugaaaaggagaagaaaaaaguagagauaagauaggauuuggcucaggauugauguuguauaggguuugacuuuuauuaucuuucacucuugaaaagugaaauauauucuccuuugauuucuguugacguuguuggaaauagagauuuccuucaagucuuuaaacagcauuauuaucguuuccuagguucuuaguuuugauuuguuuuacaagcaguagugcuucauucuaauccuccugcauccauuuuaccuuuuucuccuuggaauuuguucagugaugacuuaauagaaaaaacaccuugcaugucguugcgugcgucuuuuccagaccucugucuguggccucuucuccuuucaucugccauugcccaaguguuacuggaaagggguccucauccagaccccaaaggacgguucuuggaucuugcacaagaaagaauucagggugaguccauggaguaaagugaaagcgaguuuauuaagaaaauaaacagggccaggcaugguggcucagagcgccuguauucccagcaccuugggaggccaagaugggcggaucaccugaggucaggaguaagagaccagccuggucaacauggugaaaccccaucucuacuaaaaacacaaaaauuagccaggcaugguggugcgugccuguaaucccagcuacuugggaggcugaggcaggagaaucgcuugaacccaggagguggagguugcagugagcugagaucacgccucugcaccccagccugggcgaugcagcgagacucugucucaaaaaaaaaaaaaaaaaaaaugaaacagaagaaagaauggccacuccauaggcagagcaguggcaugggcagcuugacugaguauacuuaugguuauuucuugaucauaugcuaaauaagaggugggcuuuuuaugaguuucgugggaaaggggcagggauuuuccuggaacugaagguuccucccucuuuuagaccaucuacgguaacuucuugacguugccauggcauuuguaaacugucauggcacugaugggagcgucuuuuagcuauuguguuauaauuagcauauaaugagcagugaggaugaccagguguggcuuuuguagccaucuugguuuugguggguuuuggcagcuucuucacugcauccuguuuuguuuaucaguggguucuuuaugaccuguaucucaugcugaccucuugucuuauccugugacugagaacgccuaaccuccugggaaugcagccaguaggucucagccucauuuuacccuauucaagauggagucacucugguucaaacacaucugacaugagcacucagugucuacccucacggggguuauggugugaggagaccaacaagagcuucuggcuuuuucuagcugcuacuuccuguugaccauugacagccacuuuacccggcuuugguccccucaccuuacuguuugaaagguaucuaauaauccccauuucagagauuuauauuuaaaugaagacauuuagaugagaacaaucaggguccucuugcuaaaucugaagaaucccgauguuaucguugaagccaagugcuccuuccuggccacaugugucccuucugaugagaaguuuaucccucucgguucccugccacaacuuccaagcugcaugggacacaccaagaccccucuucuaggcuaagacagcacagugcagccuggaguucagggucucagccucugccuucagcaacgccucacuccuccugccccaugaagggaggacgguuauucugcagcagggcugcuggcacugggccuggaggggagccacuguaagccuaucaggcaguccagaaccagcaccuguuccacugacaacagcuagaauuguaagaaaauggccaccaauggaaagagcaguagaauaguaagggauuuuuuguuuuuugguaaaauuccaaggaaaauacaagcaaagcacugcgagcguaauaauuugccguugcauggacuaagggguaaggaaggaugaacugguguauuaaaggaaauccaguuucguucccaccuaugaagauuacucagguuuauggagaguuguuuugcuuugggcuguugcggaaauaaucuacuuggaaugaaguucuuucagcuccugggaaccuuuaauuguccugugggcuggucauucagguuguacauccacagacucacagaauugcguagcccugggaggaagggaccauaaagaugaaucagcccagccuuccucagacauccugcgaccaccccaggcccagagaggcugugccugguccaggcugccgggucccugcgucagcuguacuggaacugucugcugagugcgcccucccccacggggcuucugucugcuucuuggacaccccuuucuuccccuugggggucggcuuuuuaauggccagcucaccucugccugagaggaggaaugaaucccaaggcuuggguuuaggggauggcucaccucugccagccugugcuucauguuuggagacaggugaugguuaaccaggcaacagucccugccaguaguguguacacagacaguaguguggcugguagguuuggccaaggccuggaguuggauuccuaccccugccacugccuggcuccacugcccugggccaagucccugcccuucccagugccccagccccuggacagcagugccuaggugacagagaguggucccuguccuacugaggggaugggagcacaguggagcgugacuucccgugaagcugcuguccguugcuauagaaauccagccucggaaccgggaguacugucaguggugcucgggaaacuucccccuuccuccagccugugcuuccuggagugacgcgcugccacagcuggaggcuucucugcaaacguguauuaugguuuuaucuucuccccucccacaaugaguucugucugugucaaguguuuagagaucauucgaaccuuucuccucaccccucccuuccccuuuuccucagggaaaagcuugugcauaacucaguaguaaaugaauugucuaaaucauguagcaaaacacaaaauaaugugacucccaguaguauaugccauuauacaacccagcuguacaguauuucaguguauucagaggaccucuuuuccauuaccaagugauaguguggaagggaagauacguauccuuucuaguucugaaauagcuauauucuuauuuucucugcuuuugugucaucauugaaaaauuccagcauucguugcaaaugugugucuauuuugaaacaaaugacaaacgaaacaagaaugcauagaucuguagguaaccaugcuuaaagacauucuguuucuucaaggggaaugugagugaaugugaauuggaucaccccacaggagauuaguaggaacugauuuauuuuguuggcaacauuuguugacaguguguccuggagucuuaauauuacagcugaaaggagagauccugcccaucuuaacacugcgcagaagggacucguacaggcucuggcuccagacccgggcuggguuccuuacuuuguuuuuaauccuuaaaaguugguaaaauacauacaucauaaaauuugcugucuuaaccauccuuaaauuuacagcucaguauccucacgcauccacagaacucuuucaucuugcaaaacugaaacucugucucauuaaacacugacucccuucuccccuccccucccccuggcaaccaccauucuacuuucugucuucaugaauuugacuccucuaggucccucauguuaguggaaucauccaguauuuauccuuuugugacuggcuuauuucacuuagcauaauguccucaggguucauccauguuguagcgcgcgucagaguuuucucccuauuuagggcugaauauuccauuuuaugguuaggccacauuuuguugaucuagucacccauugauggacacguggguccuuauggcuauugugaauagugcugcugugaaauauggguauacagauaucucuucaagaccccgcuuucuuuuguuuuccuuuuuuuuuuuuuuuuuuuuuugagacagggucucgcucuauuguccaggcugaagugcgugccacaaucauaucucacugcagcaucaaacgccugggcuuauuuucccgccucugccucccaaguagcuaggaugacaagugcuuaccaccaugccaggcaaauuuuuuguuuguuuuuuuguuagagacgagagccucacuguguugcccaggcuggucuugaacuccuggccucaagugaucuuccugccuuggccucccaaagugcugggauuacagguuugagcuaccaccccuggccgagaccuugccaccacacugcuuaauaaaaggcugggcugcauuuugggauuaggaccuccuguggagguggggggaggguggggaaggagaacgguggcaucccagccaggaagcaugagggauggcauccguccaccaggccacaggaagcauaagggauggccuccauccacccggccacuucuuuccacaucagcauucuuccgcacuugggccacacagggucugcgagaacuccagguggcucuuagaguggcacugaccaaguagucuguguagggggacucacugugccccccaugcucagaggcuguauggugaagucguuaagggcccgggcuuauauccagccccgccagcugaucacucuugaucuggggcaaguaacuuaaccucugugugccucuguuuccuccuuuguaaaauggggaaaaaaguaguaccuaccuccuagggcucuucugagggugaccuggguuaauauaauuaaauauaccuaguacgugcauaguaagcaccauuuaagugucuagaacauuauggguaaaaauacgccugugcuuuggugagucuggaagucuaaaguguaacuuuccuaagcuggucguugccugcucuguucaccuaaguucgcaugcucauuugcugaaugcugucugcauacuugcuggucagcuacuucuuguccucugucuuacuguggggccugcgugggaaggcuggguuuuucugaacacuugcuuauaaauuauccuccuucuguucauuuaaagccagaugcucucuaugugagaauuggcccguacccugggagaagguuugagcucuccuggguccugggggccagcaauuccaggagagccauuuccuuccuguggcugcucuucagagcagcagccugcaggcugggcccaucccugguucaaacuguuuuuaggggagugggcuggagagcugcccaaguccaugucugagcagcuggugaagagaauggugcuggcuccucuaggcuucugguacuccuggagccugaguccagagacugaaccuccuaguccuucccuugcaguggauucugggaauugggguacugggcacugucagccccauucccugugagcaucugggcuuugggcaggguccucacucucucuggcuuucaguuucugcgugugaaaaaucaggggaauccgcagccugagagcuucucuggaagguguaguuaguuuuugguaagagauguccaguuguuugcagcagcugcuaggaaugaaaugcagaacuggagacauucgagagcagaagagcagaagcagcaacaagguguggugugugcagguuccacagucacacagcaccgcugcccauccuucaugggguccugaagucccaugcagaacugcggggugguccugcugaaguucuuguggaugcugcugcugaccuguaaagaggcauggcaggugcaguaggggccaaggagaaagaggucgucugucggccugaacacuuccuugguuuuuucuuggcuuuacgcagcauguugcuuuucacaugggaaagugucagccccacgcucuuauuaaagcauugaguucuuccaggccucuguugcugcucugauaacugaaaggguauugugcuugucuuuaucugccacacgcacgugggugacauugaugcgccaaccagaugcccccagcugugacaggcagaauuuaacugucgcccugcucagcgaucaccagcucaucuuguuuguccugaugauggucccuccuguuauuuggcuguuugucagauaucaagaauuuucuuuguaauuaggcuuuaauugcuaacuuuuaaauucuaaucacuuucaaaauagcacucuuuuaaauggaggugacacaucuuaggacauucagaacgauaccuccuauauuugccagaacauauuccacuuacaaaagcagcaccugcgagugcuugacagcugugucgugggagguggcuugaugcagauccuccuggccacaccuggaucgggaggcagagcagguugggguaggagacgucuccgugcugccuucugggccacaugucaaagaguugacacuguuauuucacaacccucucccuguaucuagagugaccaugcuauuuaguguccagaccugagugcuuuugagaaugaaaggggaaauguuaauaauuacauggagacaguaguuaguauccagaacauuuguccuguuuugugccugaaaccaagaaagacuacuacacucggcuucucuauaaccagaggaucacagagccagcgucacccgcagcaccaaaugauaaaagcucagaguagccggugccugcaugugaagggcgguuuguguuccucgcuacuggaaguaggauuaugguuguaauaauuaugucgacuucaguauuuuuuccuuaagaaaguuuuauugugccaacaucugcaacaauagacgcuguauacucuuagguaccaagcacccaccaggauuucgccaugcuuauuuugucuuuuccuguuuaugccugugugugugugguggggaguuaggggugguagugguguguuuuaaagcaaaucucggauguuauuuuucuucuugugaugcuuacuucaaaguaaguaccacuaaccuugugccaguguucuuauguggggugaggauuaauuaaagacuaagggauuugaagagcaacuauaaaguauuaaaaagccugggaguaggugguugauuuggggcagagguuaugguguugcugauacaguggcuucuaagcuucuugugggaaggaugaguuuaucuuuggcagccuucagugaucuccccgcaggccuugaggugagauguguagugaugucaggcuccucucuugcuugguaaccuacaaaccaagcaaggugagaggcccggcggagcaucccaagggucucccgauggccacuccagagcugcgucaucuguuuucugcugcagcaucugcaggcucucacucaucccguuacacuuagagcgacccaugugccugugggccccuccugccucaguaccaagacuguccuuggcacccccuccccaaccccauucucagaucgcccccuguguugcuuguuagcaggcagguuccagugcagacuggccgaaucugaauuucucagugagcgucucagaaaucugcacugucagcuccccugaccccuaaguuugugggguuuccuggccaggccucagacucuggcagucgggccugggccuucugaggggguuuguccuggaaauccugucuucccccaagggaagcucccccaaaggaacccuuuuaggugucugguguuugaagccagucccccauuucccucuguuuuuguuguuaucacauacuguagggaugguuguaauaaauacagacuuuuagagaaugcagccaacuuggugguucucuggggauuccuccgcugaggucggggcuuagacauuuacacgguuuucuuuugccuuuugagauucuuauccacagcuaguugguugaaagccacccaccuuggcauagugccaaugggggccuugccccguguggugccugaugcagcacagcaggacgucaggcaagcccagacgucaggcaggcccagaacgucaccugucuucuugguggcagugguuccaucuggacuuggaaauaccauguuugaaacaaggucccuguaauuacuuaauuguaaagaaaugagagguagcauuucggcuugcuugccugccugcccagccccucugggaagugugccuuucaaagaugcucgccgcuugcauuuuuauuauccugugauuaagagagaagacguugguccacuccuuguccaggcugcuuugggcuguaguggaccugcuucugguguuccuugagguucugcuuucuugugaggguucuuuuuucucucugcuucuuauuaaucuguagcugcuuauguuuuuuggcuuggcuaaaaauaagcacuuuuccuucuuccuccuggguuaggagugaaaaagacagucuuuguauuucugcuguuuggaguuggaugugagaaauugauaagcuaaaagacuguaguuauuuuuccccucccuuuucauguaucucguuagggagcccuggaggaggaagcuuugggaggagucccgcgccuucucucccgcaccaggucugagaacuuguucgcagcuauucaugucuuaugugugccuggucaccccucuuccucuuucaguuuuguuuuuuuguuaauagcuaaaucacauuucugguuauuuccuuaauauggacaguauuuucauuuccucuggagguguugaucggaggccacugccugccucccuuccugacccgguuggagugaagcaggugugggcucagaaaagccugcuugggaagcacuccuguguucauuuacaacucagccaccuuauaccaaccauacacugcacacucaguauuagaugagaaaggagcaaacucggcucucagggagcuggggcauuuaggaaaaggaaacaaauuaguauaguaagaugcauuaaugaaacggcauugggacuaaccuggagggauggcccagguugcagggggaggggugggaaggagagagggcauagggugggugucgugcauguaagugaaauggcaugccaggggcugcacgcaccucagagcggccccacguguuggcggggaggcguuaugcuggaaacgugaccugugaggagguuagguaagaaccacgcaggguccuguaugcugcaguccagagcuggcuaccgccugcacugucagaucucggugucugucccgcuggccgcacugugugggagucguggcaggggacagacaggaggcaggugggccacuagagcccaggugagaagggaagcaggccuucagcuguggcagggugaauugggaaggaggggccagaguuagagaaacaggaggcagugucugcauaucuggccagcuggugagauguuggggaugaggggugggcagugccaagcugggggagauuucagaccaugauucucaaaagaaugcucucugauuugacagcauccucaauuuggaggaauuaccuuuguguuccuuccaagauguugucccuggacugaugaacugaaacccuuuccucuggcauuuucuaguuuccaagaucgaccgugaauuauaaagacuucauuuuauucaacauucauuguguucaaaccuucuagcugaaagccgccuacuuugggguuaagguguggguuugccuauauucacuuugcuguccuugacucuuggccaacauuccuagagccccugccacgggacugcugugggcugagacuggugucgccucucccuugaaagcauggccugcucugccgugugccuggcuuggccacugguucuccuuuccuggucccgcgggggcuuuucuuuucuucucuguuguaaaauaaucucaggccagggccacuccuggccuacucuucgauucugcgaacaguggcuggcuagugguguggccacauuccccugcagugguugaggcuaaacagucacuguugagagaagcugccuuccuccuccaagagucccuccuuccugcccuguugcccucuucccguugaaggagagcuucugucuccugagugagggccucagcucugccugugggucaccucuggcucccagccuggaaggcauugcaggcuucaugaagagagcucgucuuuagcugcuauuucuaagcaugauugcuuguuggagguuggcagugguagaugcuccuagcacacguccacaccuucagggcaaacgcucuguccccagacacugucccuguuuaguuaguuuccuaaacuaugaucacucagcaaccucgaggauagucacuguauuauuacauacaggugcagcccucuuacauaccuguguguguguccagccccacuggacacaugccucccacuugcccacacucuuccccaucccgcuuuaaagcuucaaaucugaaaagacaguggcgcugcguggcugagagccacgagguggacuuuaggugaagggcugcccaccggcacaaccagaucaguggccagcucggggcgugcacagugcacucagagggagagcccuguggcacugcguuauuuuccuccuagagcugaagccagaaaccugauagggaaagggggcguuuucagggcuggaguaguucagcacagucccuuccucacuguggacuccuuuucuaaaucugcaagucacagguaaccugggugcauccaacaggucccacagcccuggaaagcccucguuuaacacaagugcucucuguccuugcugcagaggcggcuccacgccuugcuucuagcggucccucacucgccuuccggaguuaacuccagggugugggucagccuuuucaagggguuuuguuuucuuuuuuuuucuuucuuucuauuuuuguuuuugagacaagguuuguugcccaggcuggagugcaguggugugaucacagcucacugcagccuugaugucccugggcucaggugauccucccaccucagccuuccgaguagcugggacuacaggugugcaccacuaugcccagcuaauuuuuguauuuuuaguagagacaggguuucgcucuauugcccaggcuggucucaaacuccugggcccaagagauccacccaccucacccucccaaaguguugggauuacaggcauaagccaccauacccagccccacuccuccccaccuuuuuuuuaaacagggccucgcccugucacccaggcuggagugaucacagcucauugcagccuugaccuccugggcucaaaugauucuccugccucagccaucugacuagcugggaccacaggcacguaccaccacgcccagcuaauuuuugcauuuuuuguagagacggcguuucuccauauugcccaggcuggucucgaacuccugggcucaggcaguccaccugccucagccucccaaagugcugagauuacaggcgugagccacugagccuagccuacuuguuuaauucuugauugcuugauuucagaaggugcugcuucugcuuuuauggcuccugaagucauuuuauggucuugaccuugucucuccuggagcgggugggaggacauugcgaggccaccuagauuggacuugugugguugagcacuggguucaggaacaucccuggagggugggugaugguugcugccugcuugcuguuuuauaggguguuucucuuacaggcugccaauagcuuggugguuugagcauccuauuauugcagugauucuuaggucuggcguugagggcagcaagauuucugccuaaacauaguccuucucuguaguagugauucuaggaugagccacuguagacaggggcauguauugagugcaacaagcgguugagggaccuuagauuuugaggguuuuuaaaaaccgccugauugguuugugugcguccugccacaguguuaccuaggugggcuuaaugaggugggagugggcuuuuuguuuuguuguuuuaugccucagccauguaaauauaaacagauacauugaaucauucaauguccagagugggaaauuacagccaagcccuccucacuuuuagaauagcauggcgugaauaacugcaaaaccucccucuggucuuuccugccucuuuaagaguucugucuccagagacuggcagagccgucucugggcagauuugccgaauuguuucagcagggcuucuccgguggccaucagaucaauugaucuugacacauggggugccucugagggcuucucacucuugauuuaauucucagaaacgcuucucaacaccguuggugucuuucuuaauuauaccauaauagagguugacagccacacaguaugauggaccccagggugaggauggcugggugggcuuguggggcugcugaggcagagaccuaggagggugcucuccauuccuggaugcggagcccaugaguggcuuaaaagacaugcacuggcuccgcccuggggccaggagagccaucgccugcuuggugacugcaaagcugccuaccuccgugugcugccguuuuucuguaccgaagcuucccucuuuaccucaccauaggaagccugagauguaacacucagaagaggcuugacaggcuuggaaucaaaggcaugacuucauacaucacccaaggugucauauuucuucucagaaacuuauauuuggauaaaacaaaaauccuuuuucaaccuuugaaacgguuuccaacagcugcuuuaaaaagacauaguacaacaacuccuuccacuuccucuuucugcccgcuuuguuuuuguccgcaaccuuugcagagaagugaaugucucuguuagaguuggaguuggaaauuggggagggaugugugacuugauucugaaaggaaagucucaucucuuugguagagcauuuuuguuuuguuuguuuguuuuuagaccuuaagcucuacuuauaauucugucuaagacaccuuuguggagcaguuggagugccuggcuccucauuagagaaugcgcugcgacauucagccucuccuuggccuucuaggauggcgggaggcacagacacacacuccuuuucccacccagggauuuggcguucagaaugggggcuuugacugcuuggcccugacugugcaguuuucuggauggaagccugcugucuucugagcacaaaggaauccaucguuuucuuugcuucccuaaggaaucuauuuucccaguggcagagcaacuuagagaauucccagccagggccaccauucucaacuccucaggacgaggcuggugcacccggcaugcaggugucuguaacuuugugugacuuguugaacucuuuccuauuuaaggugcacuaccuggguugccuggagcacaauauucuuccucuuguggaaauauguucaggaucuugugugguguccuggguuugauuuuauagcuuugccaacauaaugauuacaguugacgaucaccguggccaccguugucuuuucccuccauuccccugcagcuuucuggaccuccgggauguccuccuggagggaaggccccuggagaagugucccaguagaacgcacuguugugucacuugcucugaccaccguugacaucgcagcacagcgcugcacacccgugacagggugaugguagaagaugagggucggauuguccacguagugccuccaggaagcucaggaugauggccaagccagauauguaagguggcuuuggggcacaggaugaugcccucgaaguaaugcauggucuaguuguuuuguaaacagugcuguuuccugaagaagcaaugauuuucugacuacccggccuccccaagauagcccugggaggagaauuucugauucucucuacagcagugccuucuucuguaggaucuccccacaugucccugugcccaccacguaagcuaaggaaggaaagcagagcuccucaguucauugauggcuucaacuacagaugaaccaguguuacaggaaaggggucccgauccagaccccaagagaggguucuuggaucucgcucaagaaagaauucagagcaaguccguagugcaaagugaaaaguuuauuacaaaaguaaaggaauaaaagaauggcuguuccauagacagagcagccucgagagcugcuggucgcccauuucuauggcuauuucuugaugauaugcuaaacaagggguggauuauucaugccucuccuuuuuagaccauauaggguaacuuccugacauugccauggcauuugugaauuaucauggugcugguggaaguguagcagugaggacgaccagaggucauuccuguggccaucuugguuuugguggguuuuggccggcuccuuuacuguagccugucuuaucagcaaggucuuuaugaccuuauuuugugccgaucuccuaucucauccugugacuuagaaugccuuaacugucugggaaugcagcccaguagguuuuagccucauuuuacccaacuccuauucaagauggaguugcuuuggcucacaugccucugacaaaaguaaagcucucagggggcucaggcugauggguucccuuuuacuucuuugaauccccagucgggcuuggaaccauggccuguaagcgcauccgacacuuggcuagaaucucgaaccugacucuuucaaagaugagggcaagguuuuucaaauuguaaguugugacucaguagaucaugaaacuaauagaggagaauaacaucaguauucaugaugaauaauuaaauagaaaauacuggagcacaucauacauguaagaguagguacccuuuuaugacaccguauguggauggaugggcgugcauguauuuauauaacguauauauuuaaauacaugguuugggggauggaugucuacaucaaauuuauuuguuacuauggguuuuggcaaaaaaguuugaaagcugcuaggauagugcauagccaggagggaaauaagaagaagcuaugagagaacuagauaauccuucuccuacacagacucguguuuugugugagugggacacuccucagccugcguccacucucagguagcuuccucuuugaaccgcuugucauugugaggcagugaccaucugcgccagcccuguccuuggcucuaacgugauguucauuugcucaccuuucuuggacuuccuuugcuuccucaggcuuuagcuucuugcccugcugccuguaucuauggccuucucucuggcugugguuuagggaaaaucacuccaucuuucugugccuucaguguguuuguccacugugagugaagcauaaucaauacuuggugacuuggcuaaacugcguucaguccuucugaauacuuauuuacauuuuauuuauuauuuuuauuuuuagagaugaggucuuaccguguuguccaggcuggagugcaguggcgugaucauggcucacuguaaucucaaacucuugugcucaagcgaucuucuuaucucagucuguggaguagcugagacuauaggccugagccacugccccuggccugaauacauuuaaaugagauaaaauuaaaugagagaaugaaaaugaauaggcccauugccaugccugagacaaacucagaugucugcuaaugaucgguucuuuucuccuuacaugcgggaguguuucuguagucagacuggacaccuacacacuuaaacagucauugauggggggucagccuucaacauuuuaagggucucuuugcguuuuuaguuuuauuuuuaaucacaguaagcacauuuucauguauuagagaaaaagaaaaaacacccauaaugcuuucuguguagaagcaagcauuacaguggccuuggugguguuuuuugaaagggcuggggaauuaauucaucgagaacaucugaggacgccuuccagauucaccaaucaucaggccccuaaguacccuuccagccccacgccccugaguucuuuucaugauuccaacccagaggucucaguugugaaaaguuucuuuugucagacacagugagcucagucugucuggccgaggccacuccgcucuuggagauggauuacagccuuuguucccacuccugggccuccuggcguggccucgggggccccugguugguggcacucaccauucacucuguggaggggucugguggaacugauauguucauaaaagcuacugguaaaaacaaaacaacaacaaaaaagcuacuggugcccagugccucuuacaaacucucaugcagauuuaucgugugggucugucugcgugggugucuaccuuauaaagacucagaaaugguuucucuuuucacccauuguuuggagaauaauaagucucugucagauuagcuucuuggggccucagugcuuuuugaaaagagcuugcauaaucagugucuggugagcugugaggccaagagcauauugccauugugcaacggggauguggauuuuguacauuuucaauauuucaccauucagucuugucagaagucaagcugccguccacccugcacuugcaguggagacauaggcccuucguccacaguggauaaguuuuucuccacgugggccacauucuuacuagaaaagaaaccccggcccuuuagcucaucacccucugcucuggcuuuccccgaguugguacagagcugaugccguugguauuuuuaagaaauaaucuugagucagaaggaaugugccaaaccggcacaggugagagaucucuggacccccuuauauuugccuauucugccccuucugagaaauuucugggagagaagguaguauuaugggacaaugaagcccuaacccccaggaccucagaaugucacuuuauuuggagauaagaucuuuauagauauaaucaaauuaaaauguggucgucagcaugggcucuaguaugacugguguccuuaugaaaugggggauucagacagagccagacacacguggagggaagacagugacaagagaauagacaacaggcaccaccucuaagccaaggagagaggccuggaacagcaucuucccccauggcccucggaaggaacaaacccugucgccccuugagcgcagacuuccagaacugugagaaaguguguuucuguuccugaagccucccaguuuguaguacuuuauuauggcagcccuggcauacuuacucagguagucucugucagguuauuuauaacucaccuuaucacauugguaacuugugguuuuaucauuuggcaugacauccaaggccccuugcaguucuaauauuuacguacuagcacuuaaaaagacuuucucugaccacagggucuuugcuggauggggucuuggucuggggcuggggcuuugguuuccaaacaucaggguccucccagaugaggcugccccgcgccgcaugcaccccccaccccguuuccgcgugcaguuuucugcggaaguauuucccagguccucgguuucccuucugugugagagcgucacuuucucucacaucuguggagcggaaguccugaggcagucaccguuuggggccugcaugggguugugagagcccuugugcuggcuccugcccgcccuguucuucguuggcugccuagggcucccugcagguuuucgcucggaggugggcccugccugcagccgcugaccuccgggagagaccggccucucccuaauuauagcucaucucuuaaucccggucaucauuucagcuggcuguccuugaacugaaaauuggaauacaauucaaccuguagcuguuuuaaaaacugccuuauucagagagggucaagauaaagaaauuuuagcuucuuucaggaucuuccaaaacagaucaggaaugacugaaucaggacagggucuccuccuuuggggcugggagggacagggcaggacucucccaggacagucccaugggcagagcuagguuuugugaggacuggagcuuuugucauuugaagaccauuucuaagagaaagagugauuauaaccccaaaacugggcucccaagugcauagcacaaaggaccccacagaagaucacaaauggcccauccugacuggaagagagagauuagauugagggccaggucgugagggcacucugagggucgcuaagacauucggcgucaaccuccaguucacucaggaguucugaguggaggacaaaagccuugcuuuaaaaggacuaauucuguagugauuuugccacauggagaggggagggaacuauugugucagaucaggaaaaccaugggaucagugcuaagggccuguguggugggcucugucugggugggagagacuguguccuggucauggggcucagucugugggugggugauagaagaguaaagcuuuuguguuuuuaggguggggaagagaagagagagucauugauuuuagauacaaguggaauaccacguagaccuggccucuggguggugaugaccuucugggguugaugucuggagacggugcgguuuugggaugggggagcagacgagggagagagagagagagagagagaaagagagagagaguguguguguguguguguguguguuuuacagcaaagaccuggauccugaaucuuggggagaaaacuccuugcauuguacauauugggcugguuacauggcugaaguucaccgugucauuuuaggccuguuucuggcuuccacacugguuugcaaugucauccuagggaagucagcuuguccuugguaggauauauucauuggugaguucacucaagagacuccuuuuugcguuucuuuaccuucaacguucguuuccuaaaauugauuauuccuucauaaaguugccagcauuuucaacaugcuuccuagaugcuggauauuuuauuaucguuugucacggaucaauuuauuuuuuuggcccuuaaacuaucacauuuucugcaguuaaauuugcuuaacuuucuaaugcaggggcagaauguaaccugcagguuguggcuuuagaaagcaauguggaacucggggccaugguaagcaaguugguggugguuuuuuuuaauagcacaucucauccuuugaugucagaacacugucuacacacucugauucauuucagucagucccuaaaaugugaagaugaaauguuggggagacagauccucuggccugaggaagcuagccgucuuguuugggagauaagaaacaucaacuguuuugaaaauacuuugguucuaucauuagagagcugaucaagugcaguaagaggcaaggucagacugggcuguauuauguuuugauuuggagaaacuaucacgaaagagguaacauugagucagagccugagagaauuguggagaaucccugcaggaguaaauaagaccaucccaggagggcucucauuuaaggccucguguacuguggucauuugaccuugguucagaugccacuucaguuuagaugcauuuaaaagcagagaaaacauuggaacuuacuguguaguauugagugagcauuaauugagaugugugugaaccauugagcaugauaccuggcgugucguaagcaccauuauagcaaacuuauagaaagcugcauuaugucacuauacaccuaggggaguggcuuuggggggaaaaaaagcaaaaaugccaccaaguacuggcaaggacauagagcagcuggaacucuuaucccuugccagugggaaugcaaaaugguacaaccacuuuggaaaauaguugagcaguuucuuauaaagcuaaacacauguucucauacaacgcaguaaucccacccuuagauauuauccaagggaaauggaaauuuaugugcucuugggauucauaauggcauuauucauauuugccaaaacuggaaacuacguaacugucccacgacuggggaauggaugaacaagcugugguuugcguacaugguggaaugcagcauguggcgggauaccuccugcaguggaaaggagacaagcacgguucacacaauguggauggaucucuguacauuaugugcauuaagaagccagguccaaaggcuacauacuguauacuucuauucauaugacauucuggaaaaggcaaaacuacagagaaagcagaucaaggauugccaggggcuggagaagagaguuaacuacaaauguacucaggggaguuuuggaggaugguggcacuguucuauaucuugauugugguggugguugcaugacuauaugcagaugucaaagcucccagaucuggauacuaagaagagugaauuuuacuguauguaaauuauacuuuuaauuuaaaagcagagaaaaaaaaucauaagccaagucagggaagugagaaggaucuuguuguauguggagaaccgucauggaacaggccagaacugagcacagaucagguugaauggguaggaugaacugugacuccagaggcauugaaagggaaauguuugcauggggcgugguggaacacagagagcccucgggaggcccggguagcaggggggcaggaugaagggggcauuucguguugugugagggaugaguagcguggggagaugaggccagagguuccagccaggaacuagugcaguucucuagucuguagauaaggccugaacacagcaguugguuguaggauucuggagagacuggagcuuagaccugauuacauuauauaugcacugucuuuucucagagauggggaaacuaaggcaugaaaacauuaacuuuuauuuuggaaaaaagcuaaacauagaaguaagagggaggccuccugaggcacuuugccaaacuuuaugcacagcaacuaugaccugcaaaaucuuuuuagccugggcucccucucuugaccugagacucuuccagggagccugguauccacaagaguggaagcagcuggucagggccacggaacuggagaugccccaugggacagaaggccuggggcucuggcaaagugucuuguaaguguuccugucauuucccuccacguaaaccaagucaggcuugcaaaucagcagccuuucagguccuuucucuccuucuggaagcucuugcauguugcaacccccuacccaccccgccaccucccaucacagauaaagauuuuguaccaucagccugcaagugaguuggaugaaugccaucugaaaggcuuuguucguuugcacacgaggucgugaauagcuggcaacaaagaggauugaaccuuggaccuagugugucugagcagugccccagcccccaugccgcuuuggauuucaguggccucugcagcaauuuauuauucuuacaucagauguuugaaguaggugaaggggcagguggcaugugucuggugagguugcugacacugcuuuuggaugagagagagaguagugguugaaacagagcauucaaaaaagcguacacuuuaaccuguaauccgcaaacauuccuuugaguuuacccagccgugggaaaggacgcuguaccccugcccuauuggcugcacccuuugcuguugaugugaggcuuuauuuaccugggaauugacaggguuuugguccaugauugcuccuuucuccgcaaucacauuuaaugcccaugauaucucaucuuugcacacgaaggcaaagccuucuacugcuuuuucucuuaaaguguucagcacuccccugaguuuauuagaaggaucagaagaaagagacccugagugugaggcuaggucaaccggagaaauucacccaauuauuucguuucuuuguuuggaucccugcuuuucauuucuaccuauucugaaagagaggcuuaaaacuaaaguccgguuaguugaggaucagaugugucauacuuuucucagaggggaggggacggucacuuugcucuaaguuugggccaugagguccacacugagccuacaugggguagggggaaaccgugaagugugcagugaccugagggugccagaucaccccgagccguugugguucccacugggcaggcuguacguggugaaggugauagacugcaugucucaugcaggccaagugccugucggucagcuugagggagaagauaccuugucuaccuccccccaccugcaggcuggcuggcuuugggugcaaugacccuccucuuccuugaaucgcuguuucauuguggaccuguuggaagugccagcuuggcuggccuuuggcuggaucccuguuugcuagagcuuuguuccuacucuggaggagucagcugcugugccuucugggacugccaagaguugccaaggggaguggggaguccucucuguggggugucgucugaauccagcagccgcaccacccaggugcuucccuccuccccacuccuaggccaauguccuuaguuucugcucacugaucagacgauuauccuucuccaggaugaccaccaucaucucauaguccuuccucacucccuuccaugaagugcuucuccaacccauugucucugucauagugaaaugauucuacuguuaguaucaagauuuuccacuagugcuaauaacaaucccugauguuaucaaacauguaggaugggccaggcauuguaccaggugucuacagaaauccuuugugcugacuguugaccacuauccccauucuguaggcgagagugagccuuaggaagggcguuggacguggccaggaucacacaccaugccuugcacucaccucugaucucugagggccagggccucccuguauacaaugaucucugcaucucuucuuccagcagaagacucaaaagaacuuucagaugugggaggccaaggcagguggaucaccugaggucaggaguuugagaccacccuggccaacauggugaaaccccgucucuacuaaaaauauaaaaaaauuagccggucgugguagugggcgccuguaaucccagcuacucaggaagcugaggcaggagaauugcuuaaacccaggagauggagguugcggugagccaacauggucccacugcacuccagccugggugacugagugagacuccaucuaaaaaaaaaaacacgaaacuuucagaugaauaaguugguucuaucagagauggcucuuaaagcucaaaagcuguuuuaaaaagcccuguggaugcgcaggcucucuuagacccuuuuucuguguuacagaaggggauauaauaccccaaauaggguuuuuuuugguacaaacuguggauaguacuagauuuugcuccauacagaguccuguugacugaacugcccuuucauguugugucuccaguguuuuuaugggcaacagccauauacagucuacuuccuaucuauugugaaguuguuguugaggauuuccuguauuauuucacucugcauucaugucucaguuaccuuugaucccuagcaaacugucccaaguggaauggccuaacccaggaaugauguauuauuucuuacaguccugugacugucugggcgguccuuuugcuaacuuccccagggcucacgugugccuuguggucaagugauagcagcguuggcuggcugguccaagguggccucacguguccuauaguauuugcuagcuauugucuggggcuccucaacucuccacaugccccaguagcauagaccagcuuccuuacaccaugguggucucagggcagcauucuaagagggcauguccaaugugcagguguguauuaagccccuccuugccucgugguugcuggcauccaauuggccaaagcaaaucacauggccuaguccagaggccgacuccagcugucugugcagacguggcaaagaaauauggccacuuccaauccacugcaguccaguccccaaaauccauucuuuucauggcacauuuuggaaucuagcagcugaauuucagucucucuuaagauacucaugacuuuauuuggauggugagcauaugguugguuggagcacaggcuucaaaguccagccugaauugagauucugacuugcucucugaccauugugccuuuggcgggugacucacauccauuucuucaucugugaaauggauaugaugauacuugccuuccugagauuguugugaaguuaauugagacuauacaugaagucucugggccauaacugaucucauuacaccuuaauucuuguuucuauuacuuauuuuacuucugucucugggaaguucagaguuuaaaaauucaacuugaccacagcaucuuuacuuggucauuucugcaaccaccauguuccauuucuuuuguguuucuauuuagaucuuuuguuuuaagcuacccaauccuuuuuggaauaauaugggguauuauuaaaguaagacuaaccagcaaaauucuguaaaaauuaaaaaaaaaaucuuggcgcuuccaguucauugguuuugcugguaagauucaggauuauaguacuguugaacaagcuuguauagacgugaaugaguuuccacauucuuauagauuugacucaagugaucuuugcagauuuucacaagcacugaagacuaaccagccuuccuuuaagucucccagcacuuaauucaucugguccaacacaugccggguucuucaggguguuaggaugaagcuccuguaucugaucaccuaccauauuccacacauuuuccauacacucuuucucauccucugagaauuuagcauuccgggugaugcuacuaagauggaugaauaauuuauaaaguuuuagaauucuaaauauaguucuuucuaguuucccuuaggguucagaaaacaauaucccaaaaugaaggccucagaagcaaaaguuuuucacuuucuccugcccuccagcugccagucuccuucuccccaaggcugcccuuagaagcuagauucccuccauagaagcuagaaucccucuucccuaaaacagguccuaggaaccagaacuugcuuuccccaaagccagccaucaacccugaaaaugcagcucuaacuuucccucugccuugcuauguaaauacuguuuauaaaaacaguaugugacuuaacuguuugacuguaggucauaagacccaccccuccacuccauuccagagagggucuugccccaacccagaaugaaggaaugcugcucagagaggcugagaagaaucuagauggacaggccuugcugggcuuccccacucggucuguuggcauuggaaccuaccauuuuuguccagucacauuuccacaugacuguccauacuguguugaacuuaagcaugagaauggacaauuuccccuguaacuuugggucuucauucugauggcuccuguguguacacauuaaaucaauguguaugccuuuucucuaauuaaucugacuuuuucgaguugaguuuucagugaaccuucagagggugauggggaaaguucuccuugaccccugcauuucuaagucaguggacacgugaaucuuuggcuuacagaaagauaagaaucagcuaaacauguucuuugaaacuccgcauuaaaacaacaacaacaacaacaacaacaaacuuuugucaaaggaauuguuaaaucccccaaccuucaugugcagugaggugagauccaggccccacuuggaacaaguuccauggagugcgcacaucuugugggccacuggccacuccugaauuccauggacuccguggggcugaggugcaguggaaagaugagcagugacuguucccagugcuguugcucaucagagagcaugggaugaggucacuccggcgaucucucaugcuuuagcguuuccagcuguaugagggaggugugguguaacuucucaggcgguuguguggcucugggcucaguuuuuguugagagccuucugugugucagacacugcuagcaucaucauguauguccuuuuauuuaauuccuccacaucacaguggauagaaaacaugguuccuauugcuacgagcuccagagcaggaauuugaauuugccuucgaagcccgagcugcucacagcagcucacugucuuuucagcuuucccaucaggaucaaaugagacgaaguguguggaaaggagaagcaaccuuuaaaaguagaucuugguaaaauuacuguuuucugaaguuggaccagggaagcuaagaggaaagagggacaguccccacugacugucuuggcugcugugggccaggccugugccagucacuuggugucagugagcuuauuggauuuagcuuucccaaccacauggacacggggucagucugucugucccagaacuggccgggggugguggauggagccuggacucugggccagucacagccugaugugacacuggauacacugccuguuagcugugugcucuugacuuuguuuuuuuugggagggucucaguuuugucaucuuuuuuuuaauaaaagggguauuaaauaccauaccucaaagauacugugaagaacacauacguaacugcaaucgcacacguguagcuccucuacaaugccuggcacuuggaaaaucccugguaaaugccaguucugugaggguggcaucacuguugcuguuauuuccauguucuggguugggggcagaagggccgucgggcccauggggaaguacccaguagaggccggugcuuugcuuucucuccuugugugugugauugcccguacaugcacugucagcacccgaguucccuguacacauuuacugcuaacagcggugauaagcgcacaagaucacuuugguguuugacccguuucuuggagaaagcaaagauucaguagggaaagugauguacauagaggagaugagccucucagcaggcuuggcggacugcauccgaucaugugaucucuuucuugcccaggacagcacggucucugggcccuuuuucuuuuuuuuuuuuuuagacggagucacucugucgcccaggcuggaguccaguggugcgaucucggcucacuguaaccucugccucccagguucaagcgauucuucucccucagccuccugaguagcugggacuacaggcgcccgccaccacgccuggcuaauuuuuuguaguuuuaguagagagguuucaccaugcuagccaggauggucucgaucuccugaccuugugauccaccugccuaggccuaccaaagugcugggauuacaggugugagccagcacgccuggccucucagcccucuuucuaauuccaagggagaagggaggcuaccugagauucuacaguagugccuggaccccaaaccuuaaaagcagaggucagcucacaccuguuucuagaaacagcuuuuguguccccugccccauagguuccuguaguggcuuugggcagcauuuggaaccacuggccagauaagaucccuuaaugaugugaaauacugcauaaggucgaaguuccaacuuuaacauaucugggcuaaauuuuuaaaacuauucaacaauucaugaagauaauuaaagaacaugugaaagucugagaaggagagccaacacucaucauucuccacucuuaacacaaucauuuuuauuccagugccuuucauuccaggcuaauccauauggauacagauuuuuauauaguuguuucauuguguacauaaaacuuugucuccugcuuuuucauuuaacguaagcauuuugcauguggcucugugaucuuuauaauuuuaaugggcgcauaguauucuuugaaggggcuguuaacagaaauuaacguuguauuggugaauguucuaaguuucuucuguuuuuucucuuauaaauaaugcugcaguauuugugcauaagauuuauuccuuauuuuagguuaguucacugggauaaauuuacagaagugagauuucuuggcuuaaagauuuucagucgcuuucuaguucuugauguuggaugccaagccaaguugcuuuccgauaagguuuaauuuacacuguguccuuuugcuuuuaaaauaagguagugagacaucugcagccugguugugaugccaaguauugagauaguauggagaaugucccagcuguugaaggcagagaauggacuuacaaauaaguggcgccagagguaggggaucucacagcuugucccuggguggcacuggucaaccugucccagggcagcacucgagagggagggaggcccucggaguagccagagccccuggagagggcugauagaugccccacagggcuggagguuucuguauggaguccugcuguaggucacucauauuaggcaugaugugaaugugcuccacucagcuacugugaucugauugaaauaaccuuuuaagaaaagagcuugcaacuguggaaagaccacuguuuuggaucagguugacauggagucugggcuuugaugggacuguaugaaccgccuuaaccccuguguuuaccugucuuuaaaguggucuaauaagccaugacaguguccucugcacaaauccuuugugaaagaacaauuuguaauuaauaaaaaaaaaagaccuuuugaaaaaaauagauuaagacaauccuuauaggguuuugggguaauagucacacagcuaauagcugcugaaccuugagcaaagaaaauguuaaugagaaaauguacauuuuaaaugaauaaaaagaaacauacagucccuauguauuucuuguuuguuaggaacuuuuucaggcacuccuccccgcagcgucacucaugaguuucuuuuucuugggugcagauagcacacauuuugcauggugugccucacacgguguuucucaucucuagcuacuuucaccaucuuucuaaauaucccacgugggucauaucauuuuaccaacuuugaaaggauuugucaggccuuuuucaaaugccugcuuuaucaguccugaggcugcacagccuuggccuugccauggagagauggcagcaggacaguggacuccggggauucagugagcacgcggacaugucuugucucugccuucuugcugugaccagugggugugaugugcuggucucugccaucugcugucucccagggcagcuugggaaagccucuccuuucccccaacuuccuugcuuucuucccuuuucccaaaauccagaucuaauucuaaugguacccaaagagaagucaacugaaguuugagguuucucccuuugaagauaagggguaauugcuguacagagaaccucagaaugggggagaauugcuguagugggggagucaugaggaguaaaagagagaacaugcuagugcuaggccugggguggauguugaauaaacauuagucccucucacucacacuuggguuggcuguaccugggcuguacugccaagaauuuccaacucuguaaugauuugugaugagauaagucaggggagaagcuuaauuacaaauuuuccauuucguuuguaacccucagcccucuuggggcucuuugcauaucauucugagacucuuuuuuuuuuuucuuggagaugcucuucaaaacagagucaaguguuuuauuuuuuuggugguggggggugacagagggucucuuacucuguugcccaggcuggagugcgaugaugcgauccuggcucacugcagccucaaacuccugggcucaggugauucuccugccucagccucccaaguagcugggacuacagcugugcauccccacaccuggcuaauuuuuaaaauuuuuuguagaagcagggucucaccacguugcccaggcuggucuugagcuccugggcucaaguuguccucccaccuuggccucccaaagugcuaggauuacagucgugagccaccacucccagcauggagccaguucugacucagugguuacagagcaggccuaggaaggaaccaguuguauggaaguuaggcccucaugggaaggauuuaaccagguggucaugggagaugguggcaccuacuggugacaaggagcauugcacuuuaguucugugagaccugcuugugggcugaggugaaguggggaggaaagcagccuugcggggauauugacauggaggucagggaacugccgagcguggaggagcgccguggugaugggaggaaggggcgguggagcagcacgggugugaaaugugcagggcugcagccuggccggcugacgaggcugccuccugcuggccucccugcggcugcuccacuguggcccuugggccccgcucaucaccaagugcugccugagggcuucaccucucuccucccaccuuuuuuucuuaccuauuggcaaugauuauuuuuaaauuuuuaaaaugcaauugauuuuuacauaaaucacaugggaaauaauuuucuaaaauaccccccccuuuuuuuuguaaagagacauuuucuaguccagugugcagaaauucuucauuuuucuaaaguaaaagaaccugcuucagcugugguugggaaacccagaacaagaagugagcugcaguugagagagggcuuugugugccacccccugacuggggaggcgguggacucggagcaaguguuagaaaauggagccauaaaagacuccuuaaagugucgggcgcucagcuaacuuagggcuagaauuauauaucaucucuuaaaggaccugcuguucuugccuucaggaaugggaaguuaucaccaggagcuaagagcugaccugcuucauaaacucuuacuuagaccuaggaaugaggaaaagcugcaugcgaguggcaucccuugugcucgcuuucucugggcuaaaacguuuaggauggucuggcagcucuugaagagaggaugguggcguggaauagauuccucugaggccuugccccuccuguccccggagcugagcugauuauucucauuggaagauuggcuuucgagcauuuaucaagagauuuguaccugaguuuucuugaacgaagagggaggcaagagggcuuaaaauuuccauuaaaaaugaacaggcacccaggaaauacaugauugacggauguuggcccaggaguuuucaguguaguugcuuucccuuuagguaaauaggauuaugcgcacauuuuuguaauuuuuuacaauuuuauuuuuuucuagaacaguuuuagacuuacagaaacauggggaacauugugcagaaaguuccuauauauaucauaccaaguuucccuguuauuaaaaucuuacaucaguaugauucauuuauuguaaagaaccaguauugauauguuauuaacuaaaguucucucuuuauucagauuuuuuacaacauccccuuguguucuuuuucuguuuuaauauguuauccagaauaccacauuccaguuagugauuaugucuucuuacugugacauuuuuuuagacuuuccuuuuuuguuaugaccuugacgguuuugaggaggcuuggucagggauuuuuuagaauauuccucgucugggguuuguuugauguuuuuucucaugauuagaugagaguuauggguuugggagaggaagaccacagaaguaaaauaugcauaaauuuguaaacaaguuguugaaugaguuaauuauggagagaaagggaaguuuaguaccccugaauaguaacuggaagaggaguaaaggcuggacccccagauuggaagaaggcaaguuuaauguucuuaaugaugggacuuaaugucuaacuugugucaugccuuauaguucaaaggggaugggauagagugguucuuacauuuucauguuauaucuugggaaacugaggcucagagaagcagccugaguugccuaaggucauagagauagaccaggauuuacuggauaugccagugcauuugcaaacuauuccuaguugcauuuucuaugcccagagguucuagacucaacuggcugggucaccgauggccauuucaucugugcguagcuauagggauuuaaauaggaggauuuuuguuaaaugaagacaauugaccgacugugcguggaaucaaugugcaggaugauucaccaggcuuucugccuguuagagaaguuaaaugguugagaauuaauaauuaugcgauuguaguucacgacuucagcacaagucauuguuacaguucucaaauguugagcagccccacguuauuccccaccaguguguuuuucucugagguuacacaguaaaauaagugaagugcugaccuuuaucauaacauauuuuuuauuugugagcaaguggaguauguauaaagcaguuugugacuuugaauccaaaauagaaauuugcccuccucucauuuucgcagcauugaguuucauaaacuaaguuggagcagugaaagugaaacuggaaaugcauggaugaagccagugguucugaacacugagaacugccugggagcuucuagaaaaacccccaaggcugggucccauucccuaaaguuguaauuauauuggccagggcaggaacaggccuugggaaauccaaaacuuggccuuucugucuuguuccucacucuguacucuacccaggucuucauucuuaaaccuuucauaucuuuugauucuugccuaaguagagguuuugggagcuguugggcuggagcuuucaaagcuugcaguaggcugaucuuacuucucuaccuauauuuuaccuguucucccuaggugaugaaacuaggagggcccauggcuacuucugcuacauggggcacaaaacaugcuucagaaauauuugagagacugaaugaagccugucucuggucucuaggguauauuacguucccuuucuauucuaaugaugaguaggaggaaagauaccacucuuucuuguaaaccaaacuguucuugcuuucaauggggauuuuuauuaagaagcaaaaacugaucucuuuuauaaaugcauagauaccaguguuuuacacaguacaggcuucugguuuuaagagaacuuuugccaugguucagagugaucuuacuagccuaguauauugguuuguuuuacauugcuauaaaggaauaccugagacuggguaauuuagaaagaaaaaagguuuauuuggcucacgguucuguaggcuguacaagaaacauggcaacagaaucugcuucuggugaggacuucaggaaacuuuucaucaugguagaaggugaaggggagcaggugugucacauggcaagagagugagcaagagagagaggggaggaggugccagguucuuuuaaacaaucaaaucugugugaacucuuuccuuuaccauggggagagcacaaagccaugcaugagggauccacccccaugacgcaaacacccccaccaggccucaccuccaacauuggggaucacauuucaacaucagauuuggaggagacagcuauccagaugaaaucaccuaguuaacucugguguucuuuuuucaggacccuuucccagugaguuaaaauuaaauuugugaguuuauuaauaggucacacagccuauuuggaaaguaaguuuuuuugccuucuugugagaagaccugaagauuauuccucuacacuacccugguggaacgccaaccuugaagaauuagaaauaaguccuucugcuucucccaugggucacuuuauagggaaaaugcuugaucaggggaggucuuggucuuuagcgggaaacuaagucuacucuguaaaaauuugcuuucgagugaacaguauuuuaguuaguuuguaaugucuuagcuuugcagcuuagcuuagucuuaccuuuugagaaaugggcugugaaauauaaauuauuacaucauuuaaaaauuucuggcaaccuguuuuuuuccccaaaacuugaggguugcuguguggauuggcuguagugguaauuacugaaaagucaucaaauaacagugaaaacuagacaacugauuagaagggaaucaaguagucauucagaugguauuuucgguaauuuaaucugccucugaccauauguucuagucagcugaaauaauuuaacagugacaacauauauuucagcaagcagagauuaaaaacagcccauuuauuuucuguuuucucccgcaguaauauuuuuaugucuccguuaacaaauaugauguucgccauuuaaauuauauggaagcagcuuuggaugauuuagcaauauacauaacauuuauucuuuguuauuaucuaguuuuauguauguaagcauguuuauuuuagugguguuucauaauucaaaaauguuaccagaggugguaauuguauuuauauuggacauggguaagacaucagcgugagaugaagccacauuuuugcugcuuuugugacucaauucuugggcuuccaacaccucacagccccugccccccaccccugucccacacaaaugacuggcugggugcagcagucucugccacuagcaagccuuauggcauugauaaauguagugguuuuagaauauucuaaauauuaaccaauuuuuuuuauuauccuccucucaaaacuggaggcuagucucagcuccaccaaacccgauuucacgugagcuggacauggugacaugguucauuauuucuuaugaacagacugugacagggcaacagugagugauuuccaagacuaggccauaaaaggcaucaccguguuucccuugcucuuguaugugcccucuuccucauauucacuggggaagccagccgccucuugggaggacacuuaagcagcccuacuggaugggccccagugaggaacuggggccuccuggccacgugaguuacccaucuuggaagcagaccccagcccuaggcaaaccuucagagaacagcagcccuggccgaaaucuuugcagccccauuagaaaucgugggccagaaccauucagauuccugacccucagacacugugugagguaauaaacauuuauuguuuuaagcuacugaguuuugcagcaguugauaagucagguagcccuucuggauccuuuuugccaauccucugggaaacgaaugguuggacugcacagugcccugcacgcauagauucgaucaauagugccuaaggggcuugcucaucuuccagccacuguaccuccucauccccacggcgccuuuccuccuccacuccccugaccacuugccuuuggcaacugagccaagaacacuucuuauuuuuuucuuauuuggaucagagacagauuauacugggaauauucuauuaacaacgaaaccuauauuuacacuuaauuaguuuccauaacuauuuaauaaacucaccuauuggguuuacugcuucugaaaauagugucauaguauuuagaugucauugcuauuuuauguacuuagagauaggaugaauuugagcugcugugcucucugauuauggcagguaaguagacgucgcucagccauggauucccgucugauuacacucauggcccugguuuaauuccauuugugccucuguugugugcauuuguaagaacaauuugggagauacauauuuugagguuuuaggauacauaauuuugaaccagauuaaaaugucuaauaacaauaaucacuaccaucugggguaaguuaguaaguaggagaagacuuagaguucucuuucucuggcccagaugccauuuacaaagggagcgaagaccacagcgcuguacuuuagggcaucuaggucuuuccagaggcugcguguggaugcauccaauacucuagaccaaggggugaugccaggcagggcagcagcguucuccugucccauguuucucauuugguuggcagggcauccuagaccucugguuaaacuucccugauggaaugcaguauuuggucagagcugcugagcccucccuugucuacacuuuccugaagcaccaucugucugugggguaaucauucugcauucacugucaacaucccuccuuugagggugguggaaacaaagcagagaugggucugcauccugggaaaucaaagcgggcuuacaagaucacaggcuuugaauucucugcaacuuuugacccagcauaaaccacaucaugacuugucuaaucucaguaguuuauacuugucacuaaaaagaggaccugucugucacugcaucaguuuccccuuaaaagggagaaaacacacagaucuguugguagcacagccaggauaccaguggcuacugggcgcaagagccuucuucauacauuugcauucaguacauuuccauuuuugagcggcacugaugcuaguguaaauaagucuuauaauguauguaaauguaugggagggggauuguaacgaaaaacuuccacugcagaguaggcgaagccaguacaaucaaucugaguaaguagggcgaggauuuuuuuuuuucagcugcauuuauuauugagcaacuauuguaaggccaccagcgcacuugguaccauaaggauacagaaggaauaugacagcuuuccuuacccucaaagaaccugaaaucuuuuuggauaucaaacaugggcgaagcagguagcaaauguaaaagacccccaagugcuaacugaauguaucaccuacacaagaacacugggcaggcagggacccgcugugcaagaggcauugagcccagccuccuaaucuuagagaaguuagacuccaacacccacugccauuggcagaggcguggcuggaacccaaggcucuggcuccgaggccagugcugcuccccacgugucaugcggggucuccuccuuuccuacuugucccugcagcauuggccucuccucuccccugcacugacaccucaccuucccugaguggucucccuccugcucaccaguagcuuuaauuacccggggccuuuucacaaccccagauuugugccuccaucuguuugcagaugccuccucuugguaucucacaguagcuucaucauuuccaaaccaaacuccucuauauuuccuagcacugcuucuuacccuccccagcaacugucuugcauuucuucucgguggacaucacaccuguguaggaagugcugcagucagaaaccuggggccgucuuugauucuucuuccccuucgcacuccuccugcugcauugccagccccuccuagcugcaccugucuccgcucugucccuccgggaccuggacuggguccagcaugccaucuucccauugcugcauuacugaaauggccuccugggcucucuugugcccucuagucugcccccaccuuauagccauagugauauuucuagaauacaggucucagacuauccugccgcuuccgugcccuccuguuuuugaucuuucccuuguuccaucugucugguacacccaccaccgcuaguccccauuguuccuucuugccucccuuaggucuccaccgagguaccacuuccguguacagccuuccugggggcccuguucuacgcggggccugugccucugggccguuguuccccacgcuugucugugggugucuuugcacagcacaggccaagaugccuggccccugcugugucucuaggagcugacuuucuuaauaccaggccaaggccuucgguagggguggagagaagagagugggacaagacaagcaucuacagaccagugguggguugagugugggugcuccaucagccagugaaccuagucagccaucuuuguaggaauuuauuucuagugaccagacauauucugagaugaaugguuaguacaaugucuuaauugaacuuuggcuauuuaguugagggagggaggaagcuaucuuaucuagaggcaguacagcuaaaugacugagaccauaaacuccagcccugagcuccccaggguguggauccagccucauacgaacacuaaauguucagugccuuggcuuccucaccuguaaaauuggaauaguaauagcauugcaggaagaugagcauaugugcaguguccagaguggggcuuggcaccucguaaauacuguguuaggcagcagucaccauggugguuccuccuuuucauuguccuccccucccccuccuuccccuccuccucugccuccuccccuccucguccccuccucguccuccuccucccccucccucuccccuccuccuccuuucccucucccccuccuccuccucacuguccucccccuccuucuccuugggggcuccucuuccccuuccccauuuuuacuguaggagcagguauuuaagaugauaaucugcagguuuuggccugggaguccagaacaaaacaguccuaugugagugaccuccuagaaauguauucuuggguuuuuaugacauuuugagaaucaggcucuuauaauuuaguuuaaaucgagcccuagccugucauucccacucugacuuacauaaagggccagauuuagcuuuuuaccagcugcguaaccuggacaaauugcuuagccuaucuuauguguccucauuguaagacaggaauuauaaaaugcaggaaugagagagggucaaugcacaaugcuuggcgcauaguagguauucguaaauggcagggcuuguuccaucugcuugguaccuugucaugcccuaauuauaugggcaugaacucacccugcacuaguuuuauaguaggcaucguugauuggaaggaagaagggagguugaggagugcucacccugcacuaguuuuauaguaggcaucauugauuggaaggaagaagggagggugaggaguguuaccugugggcaaaucaaucuuauuugugggcacaaaaaaaaaguuuauuuucugggaaaacacugaugguugaccugcaaaugucagauaaugacuacagaugaugacuuuauuuuuacauguagaaaauaugcuagagucaccagccccacuggcaguguucacuuuugauuuuauucagcuacaaguuuaaaugauuugauccauuagcugguguacauagaaggccagaugcugggguggggguugagaggugggaauuaucagccacaaugcuacaaucaagccucaaaauaaaaauuaaugcguaauuaaaagucugcagagugugacugugguaauuucauuacuugcugauuucguauucacauguaucuccuuacuuuguaaagccaguugguggguuaaauucucucaccguugccuaucugccaggguucccgcaaaaucagugccaguaguaaauugaaaguuucuuuauagccaaguaaucucaaaagccaaguuauaaauauaucuuuucaaaacuuuuuugcaguaaaaauuauuuaaauugggauacagcugcauucuaauacauuuguugcagcgugggguaagacuugcaaaaguacauggggcacuuaaaggccaggaagguguucugcuggguggguggggcuuggacccccggcugcagaaugguuucucucaccagcccgccaaggcuacaguuccucccuuccugccauuuucacggcagcccugaugugauaaacccagcuguaucgccucauuagagaagcaacggaagcaaaagcuagccaagagaugggggagucuuaggcacaguuucugucuaauuaccgcaccucuugaguaaaaaugcagauuauuggcaaagcaaguugcauuuggaaaaaaugugucauuuggcccaggcccugagguuuacccuucugcagaucucacuuuacguuuuaaguaaagaaccaaaacgucuccaguggugaacgugcgugcagcacacaguccgcacugguccagaggagugcugguggaauaaacccggggagagcuggguuccccgccccgcagggagggauuacuguugcguauccgccuaaucgcaucugcucaggaaaauggccagcugacaaugcuuggcucacaggagucuggugggaaaauuacuagccauggcuuauuucugauuuggguuauauacagaaaccuuucuuauuuuagucacagaaaucagauucccagugguggaaaauauauauuuagcucuguggucgugcaguuguuauuuagucugauuuaauguugauaaauuagaguaaauuguuugcccagaugaguugaauaaauucugccagagcuuauaucuuauucuguuuucacauugaguccuuaauauguaucucuguuucauuggcaguccuauuagaguaaguccuagaaaaagcuugguggcccuacccccugcuccuguguuagucaguggaauuaaaucauuuaacacucucugaggggagcucaaaggagcccuuagggagaaucugguccuaagauguccauaaaccaccuaagaugucuggagagcuaccuucauuuuaauggcuuuaauuuaaccacucuagaauuauuucauuuaauccacuuucccuaucucgcuuccccacccucacaaauccccaaagcccugggaguuuuuggaguauuuccuucccacagauaagcaauacaaauauaaaaugaagagagaaaugcaaacccuugggaaaggucaugcccauacuuuucuccccuugcaucuugacucccuaacaauuucugguguguggggucuuuaagaugugcccucccuccugcucaucagugcauccccagggccaaguguuaacucuccuaagacucgguauguauugaacugaugaaugaaggugugcuugaagaacaagucaacucauucagugucuuuguuccccuaggaggacuggaaugaaauugaccccauuaaaaagaaagaccuucaucacagcaauggagaagagaaagcacaaagcauggagacccucccuccagguacugccaggggccaggaagccaucuugcuuugagcacgugauugggaguggacugagcauggcucuuggagcagguggucuguggggagaggcuggauuccauaggucagcaggagacaccgcccuaaagcacugcuuugccaacuuccaucggacccauuaguggguggucaaguuaaaacuuuuauaggaggugaccaaaauguguugaaaagaaaauaaaaauagacuaaaguagaaaguauauauuaguauauauuaguucaugaaauauuuuuaauagacuuuauuuuuuagggcaguuuuagcuucagaacaaaacugaggggaagguacagagaauuccuguauaccuccugcacccccacccccaacacacauacaaccuccuccauugucaguaucccccaacagagugguacauuuguuacaauccaugaaccugcauugacacgucaucaucacccgaagucuguaguugacauuaggguucacucucgauguuacacauucuguggguuuggacaaaugcauaauggcguuuagccgccauuguaguaucauacagagucguuucacugccuuaagaguccuccgugcucugcccauucauccuuugcuccccccagccccuggcaaccagcgauccuuuuguugccucugaaguuuugcuuuucuagaaugucaggcaguuggaaucauaggguaugucagcuuuucagauuagcuucuuucacugaguaauauauauuuaauauauauuuauuuuaauauauuaauauuuaauauauauuuaagguuccuccaugucuuuucauggcuggauagcucauuucuuaaugaauuaacauuccauugucuggguguauuaguuuguuuauucaccuagugaaggacaucuugguugcuuccaaguuuuggcaauuaugauuaaagcuacuauaaauaucuauguaccaguuuucguguagacauaaguuuucagcucauuuggguaaauaccaaaggguaugauugcuggaucauaugguaagaguaugcugaguuuuguaagaaacugcuaaguuguuuuccaaaguggcuguuccauuuuccauucccaccacagugagugaggguuccuguuucucuacauccucaccagcauuugguguugccaguguucuggauuuaggccacucuaauagguguggaguaguauuucacuuuuguuuuuauuuccaauucucuaaugacauaugauguugagcaucuuuucauaggcuuauuugccaucuguauauuuucuuuucugagguguucacuccuuuugcgcauuuuuaauccagugguucauuuucuuauuguugaguuuuaagagucuguauacauuuaggauaaucguccuuuaucagauauggguuuuguaaauguuucuccuagucuguggccugucuucucauugucuugauaguguccuagaagauuuuaauugauuaaaaucuggcuuaucaauuauuuccuucauugucacgccuuugguguuuucucuaaaaagucuucaccaugacaaaaaggucaccuagauuuucuucuauguuaucuucuaugaguuuuauacuuugguguauuuacuuauuuauuugagacagagucucacucuguugcccaagcuggagugcaguggugaaaucucagcucauugcaaccuccaccucccagguucaagcgauucuccuguuuaagccucccaguagcugggauuacaggcaucugccaccaagcccagcuaauuuuuguauuuuuaguagagacagcguuuugccauguuggccaggcuggucucaaacuccugaccucaggugauccgcccgccucggccucccaaagugcuggaauuacagcgggagccaccacgccuggccuacuuugguguuuuacauuuaggucugugauucauuuggaguuaauuuugugaaaaguguaagagcugugucuagguucuuuuuuuuuuuuuuuuuuuuuuuuuuggcaugugaguguccaggucuuccagaaacauuugcugaagagacucucuucucuccgcuuuauugccuuugcuccuuugucagagaucaguuggcaauauucguaugguucuauauuggagcucuuuauuugcuuccauuggucuauuuuucuguuauuuugccacuaccacacugccuugauuaccaugacuucauguaaagucuugaagccgaguaguguuagucaccuuuguuuucuuucaagguaguuuuagcuauuccagaucuuuugcuguuccauauaaauuuguaaauuuuagaaucaguuuguuaauauccacaaaacaacuugcugggauuuuggcucuaauugcauugaaucuauagaucaaguugagauuaacugacauuuugaccauauugucuuacuccccaugaaugucaaauauuuuuucauuuaauucuuuugauaccuuuuaucagaauuuuguaguuuuccucauacagaauuuauacauauuuugucagauuuguaccuaaguuuuucauuuugggaguuucuaauguaaauggucuugugauuuucacuucacauuccacuccuuuguuacugguauauaggaaagcaguugacuuuuguauauugaccucacaucuuguaaccuugcuguaauuguuuauuaguccuaggaaauuuuuguucauuguuucagguuuucugcacagacaaucaugugaucuaugaacaaauaggauuuuauuuauuuucuuccaaucuuuauacuuuuuuuuuugucuuauuucauuagcuaggacuuccagcacaguguugaagaagaguggugaggggucaucuuugccuuguuccugaucuuagugggaaaguuuccaguuuuucaccauuaaguaugauguuagcugcaggauuuuuguagguauucuauaucaaguugaggaaguucucauacauuccuaguuugagaauuuguaacaugaauggguguuggauuuugucaagugguuuuuuugcaucuauugauaugaucaugugauuuuucuugcuuagcuaguggacaugauggauuacguuaauggguuuucauuuguugagccacuguugcauaacuggcauaaauccuacuugaucaugguguauaauucucuuuauacauuguugaauuugauuugcuuuauuuuguugagaauuccugcauauggucauaugagagcuauuaaucaguaccuuucguuuccuuuuuuuuuuuuuagagacaggguuucaccauguuggccaggcugaucuugaacuccugaccccaggugaucugccugccucagcccucccaaagcgcugggauuacaggcgugagccagcacacccagccauaccuuucuuuucuuaaaugucuuugucugguuuuugguauuaggguaaugcuggccucauagaaugaguuaggaaguauuucuucugcuucugucuucuggaagagauuguagagaauugguauaauuucuuucuuuaaaugugggucagaauucaucagugaacacaccuaggccaggugcuuucuguuugggaagauuauuaauuauugauucaauuucuuuaauagauaugaccaguucaaauugucuauuucuucuuaugugaauuuuggcagaguaugucuuuggaggaauugguccauuuaauccagcuuauugaauuuaugggaauagaguuguucauacuauuccguauuguccuuuucauauccaugggaucuguaguuauauccccacuuucauuucugauauugguaaaaugugccuuuuuuccuuuucacuuagucugguuagagauucauugauuuuauugauauuuugagagaaccaguuuuuguuuuuguuuuuuucuguauugauuuucuguuuucaauuuuauugauuucuguaauaauuuuuaguaugucuucuacuuacuuuggauuuaacuuucuccuuuuucuaguuuuuucaaguagaaucuuagaugauugcuuuuagaucuuucuuauuuucuaauguaugcacucaguacuauaaauuucuuuggaagcacugcuuuugcugcaucucacaaauuuucauaaguuuuguuuucauuuuuauuuacuuuggaaauuuaaaaucauuuuuucuugagauuucuucuuugaccccugugucauuuagaagugcguuguuuagucuccauguacuuugggauuucccagcuagcuaucuuucuguuauugaaucuaguuuaauuguauuguguucugagagcacacagucugauuucuguucuuuucaauuuguuaagguaugcuuuguggcccagaauguggccucuuuuggugaauguuccaugugaguuugagaagaauguguacucugcuguuuuugacugaauuagucuauagauaucaauuauaucuaguugauugaugguguuguugaguucaacucuguccuuauugagcuuccucuugcaggaucugcccauuuuugacagaggacuauugaggucucaaacuauaacagugaguucauuuauuucuccuugcaguucuaucuaucaugaacugcauggacauuuuuaugccucaugcauuuuuaugcuccuuuuaggcacauacacauuaaggauuguuguaucuuuuuggaaaacagacuuuuaaaaaaucauuguguaguucugucuugaucccuuaaaaauuccuaugaucuaaagucuacauugucagaaauuaauauagcuauucuuacuuucuuuugauuaguguuagcaugauagaucuaacuuuucuugguaaaggccauucuuuaucauuuuacuuuuaaucuauguguguuguuuuauuuauaguggauuuguuguagacaacauauaauugggacuuauuuuucgauucucacaaucuugguauuuucuuugguguauuuagaccaucgauguacacagugauuguugauauauuuaaauucauauuuacuauauuuguuauuguuuuuuauuuauugcccuuauucuguguuuguacuuuuaccuuucacacuuuuucugccuuuugucguuuuaauugagcuuucuguaugaucccauuuucucucucuucucagcauaucuauuaugugucuuaaaaaaaaauuaguuggucuucuuucagauaacacuauacuuuuucacagguagugcacguaucuuauaacaacaaaguauucuugauuccucccucccaucacuuauaucauugcugucauucauuuuacauccacauaagcauauguauauaauauauaaaagaauacaugauggaauauauuguugcuauuauuauuucaaacaacccauuauaugauaguucaauuaagaauaagaaaaauaggcgaggagcaguggcucaugccuguaaucccagcacuuugggaggccgaggcaggcagaucaccugaagucaggaguucaagaccagccuggccaacauggugaaacccugucucuacaaaaaauacaaaaauuagccaggugugguggugcgugccuguaauuccagccaccugggaggcugaggcaggagaaucgcuggaaccugggaggcggaggcugcagugagccgagaucguaccacuauucugagccugggugacagagcaagacuacaacucaaaaaaaaaaaaggaaaaguuuuuauuuuaccuucacuuauuccuucuuugaugcauccuuucuucauguagauccagguuucugaucgauguuauuuucuuauguuaaaagagcugcuuuuaacauuuuuugcaaggcaggucuacuggcaacaaauucccucaacuuguguuugaggaagucucuaucccuucuucaucuuugaagaucaaucuuuuuuuuuuuuuuugcgacagagucucgcucuauuacccaggcuagagugcaguggugcuaucucagcucacugcaagcucugccuucuagguucaugccauucuccugccucagccucccgaguagcugggacuacaggcgcccaaccacacccagcuaauuuuuuuguauuuuuuuaguagagaugggguuucaccacauuaggcaggauggucucgaucuccugaccucgugauccacccaccuuggccucucagagugcugggauuacaggcgugagccaccgcgccuggccugaagaucaaucuuaaaugguacagaauucuagguggucauuuuuuuuuucucugagcccuuuaaauauuucccucuccucucuucuuuccugcaugguuucugagaagacauuaguuauaauccuucucuuugcuccucuauugauagguaagguguuucuuucaauuuuuuuucuuuaucuuugauuuucugcaauuugaauaugauaugccucaguguaguuuuuggagccuuuauacuauucuguguguucucuaaguuuccuuaauuugcguuuugguguucaacauuaauuuggggaaauucuuagucauuauugcuuccaguauuucuccuguuccuuucucucuuucuucuccuuccgauauucccaucaugcauauuuacaccacuguaauuguuccacaguucuuggauauuauuucaauuuuuuucaucuuuuuugucuuugcauuugaguuuuagaaguuucuaaugucauguccuaaaguuuagagauuuuuuuccucagcaugucaugucugcuaaugagcccauuaaagacauuccucauucucuacaguguuuuugaucucuagcauuuccuuuugauucuuucucauaauuuccauuucgcugcuuacauuaucugucuguucuuguguguuaccuacuuuuuccauuagagucccuagcauauuaauuauaguuguuuuaaauuccugaucugaucauuccaacauuguucuauaucugagucugguucugauacuugcugugucucuuuaaacugugcgugcgugcgugugugugugugugugugugugugugugcgcgcguguguguguguguuuaaccucuuagugugccuuguaauuuuauguugaaagcuggaugugauggacuuggugcacggaacccugguaaacaggccuuuaguugugugguguuaagguguagugggaggggaagcuugcuauaguccuaugauuuggucucauucuuuuagggaaccuuugugucugggcugugagccucacauuugcuucucagcuucccccucuccacauccuuaggugauacuaaagucuagcagaggcugguuauuuccuguuccucagauuggacaggcucugauaaaugcuagcaguuuagucccuguuuaaauaguuucucccgauggcaggccuuauuaauaagaacacagugcccuggcuucuuucaaaaugguuauuuuccccucucacuguuguaagcaugaggggauauuucuucaauauucacugugaggaucugguagagcuccaggagguaaaacucacacaaauauagcugccacacccccaugacugggucccccuggaguuuuuaaucucuuaggcuuguccacagugagccuccaggaauuuuccacuacaguuuagguuuuccuacccccguaguggaucuucagggguuucuacuuacaggcuucugcuccagugaauugugauuccuuguauucaccuguccaauuuggggggcuguggcuugugacauuucuccaacagauccaaggcagaucucuaagaagugcugauuuuucauuuuauucagcuuuuuacuguuaggacggaauaacgacuuucaagcuccuuacaugccuauugggaacuggacguccguuuaugaaguguuugcuuugcuggcaagaguguuugcuggugagaguguuugcuggugagaguguuugcacguuguguucuugacugugguuggacaagcgucaccccagggaguccaagccccuccuuugugcccuccccaugcguugucccaccuacaccagaugcagguaugucacugucuccuccaggaacucugacuggacgcaugcaugcagucaauuuguguguuaagucggccucccugucaucuuuccagcuccuggaugagucaugaagcccugagccacaguucuuucauauguaaaguaaacauuacccacacaauggggagcaucugaauagaauaguuaauauuccuuuauuauaauaauaggaagcuaggauacacacuucuguuguguggauuaaugagagacuuccuauggauuaucuucuauuaaaaacauacaaguguucugaugguuuucaggcaaauagagagagggagggaaaagccaucuucaggucauaggcuggauuugaccauugagagucauaccuuacuuaaaaucauuugagugcucacauugacucugccuuucauauccuuaacuauugcauacaguugguuuucuuaucuucaaagagaucagaauguacugauuugccucucuuuugaguuauuaguaguaauuuuugauaaaugcacaaugucuuuuuauuuugccaaagggcuuucuuuccuuuuuauguugaaaccauuuuucuuacuaaaccaacauacacauaauuuuuuuguuguuagaaauuauuuucuugugauugaaaaauacauuuucccuaagcaugaggaacacagcuaaaguuuuaugguuugcaagaaaccgcuggccauggcacuucccagugugucagugguguguucaggaagcucaguggcuuccuguguucuguguguugggcauguagcaguuguagacagaugggcgggaagacaugacaccaagcuggaugcuuuuauggccacagaacccacugacagaugaaggagccagaucuaacagggcagagcagugauguuccaggccaacagucuccaauuuucugaucgcacacucuaugaacagacguauauuuagaccaccucccacacacauauguauuaaaaugcuuacuuaggaauuacaugcauauugccguacagauuuauugauacauucuaaaugaaaugggauaguucccuugaccccuucacaggacucagcccacagcucucagccccucaugggaggagcagcaugcaggugagugggugcaggggcuggggugagugcuuuugggcaucggcaggaguagaacucugugcagccccccggcagcaucuggguggggcuaccugugaccccuggagcccuagagggcauauguuacagugugcucuuagauuugcuguccacagaugacuuaaguguuagcucagugcaaggucagugugacagccuuuugcauccacccucuugguaccugaauucucguccgguguccaggaagaaucaaguugugcaaacaaauugaaggauggugaauguggaggacuuuauugagcacuggaaguggcucucagugggaugggaagcuagaaaggggguuaagugggaagauggucuuccccuggaguccugcuguccccagccaaacucuucuccaaaguccugcugucaagcugucccucugaaaucaagcugauucucuccaacauccggcuguuucuucucuccuucucuauugcuuugcugguagggccugggguuuuuauggguacaagauggaggguggggcgggccggggugguuuuggaaaaggcaacauucgggcaggaaaacagaaaugcauguucucacuuugggcccuacgguuccaggcuugaggguguggcguuugcuagggaccacucucuccuacccaguauuucccugccuccuguuuguaucauaaaguguauuuaaaauaagcuauuauaaaggaugaggaaaauacuugacaaugucugucauuuucuuucuuugccccagaagauugucuuauguggccccacuuuggagacuaccacucuuggggcugccguggucacaaaaacccagauuauuguuuuaacucuauuucuugccuugguucaucguacuuuggggaagaaucuggaauuuguauaaaguauaccacccaaguggcagucccagcuggaagucauggaaugggggcaagaacaauaaccugggagcacgggaucuggguucggaacaaggaugauggccgggagcucuaggcucagcugugccaccaguccuguggccuuagacaaguuaaggaguauuuggguuuuguuuuccuugucuguaaaauuuagauacauucuugcucuaaaacucuuugauucuguuaacugugucuuaccauuucccuuuaaucucuauucucagauuggaaucaccaauuuuauuuucuuuuacaugcuguaaaaauauaucucuguaguuccccccacccucauaccacauuucaggucuacuguggaugaguuuuugcccauaaacucugugacccuugcuucuauuucagcaucaugcuuucuacuuggaaccacugaauuuuuuuuuucaguguugguuuuuaaaauauugucuucaaauagaguauguauauuagucaauauuuuguauuuuggaaaucuaucugauagagaagaaugucauuuuuuccccuugguguggaaaaacuucuggauugaaaaauaaguuucucccuguaauugucucugaaucugaccagccagccagcuggcagaaggacuggcaaaggagcgggggccggaagaggagcaggggccaguagaggaguggggccggaagaggagcaggggcagcuguaggggcuagaaggccgaggucugccucugaggacagcuguugaugagguucuuguuggagaucucucacccuuuggucaacguggccuuuuggagcagauuuucucuuugccuuuaugagaccuuagugucauucuuguauuccuuaguaaccuuguguaaagggcugaggcuuaggagagacgaggguagggagagaguucagaaaggagaguccuaaggccgucuggauucuccuugagcccccuccccauccugguccugggcugugucuucaucacagccaccccuccccgaugugcuguugguucaguuaccccagacaguggauuucucagaacagaaauugcuaauguucacguaaagaugaaugaaaugggaaugaugaaauguguuaagagaacuuaaauccagggugugaauugccacugauccuaacagagacguuuuagcuuuucuacuucccaccugccggaagaaagaugagauaaaccacuuguguuauuuguucagcauugcugcagcaucagagaggaguguuccccgacccuuuguuuuucuaggugacuuaauggguucuggcauugugcauuuaucuuuuuaauugugguaaaagaugcguaacacuaaaguugccauuuuaagcguuguuaagcauacagguccguggcauuaagcgcauucacaguguugugcagucaucaccaccaucaauuagagcuguuuucaucuugcaaaauggaaacuguacccauguaguaccaaugucccauuccucccucucccaggcccugguauuccuguuucuaugaauuugguuccucugggucccucauaugagugcagccuuacaguacuuguccuuuauuucuggcuuguucacuuagcauaacuccuccagguucacccauguugugggucagaauucccuuccugugucucugugaaccaugugcccugugauacaugucgugugagguggaaccgugugacacuuguggggagcgaagucuacguaguucuucaugagccaggccugaggccagugaucugcacaguguugucauaaggaaaauaaguggcugucagugucuuuagggaagcaucuuuuaaaaagcaagcaauguguguauuguacguuuuagaaauucagauaagcaaaaauaagaaaauuauauucauacauaauucuaccauccagaaacaaccaccauuccucucccacugcguguuccuccauacuugcccugggcguauacccaggugggugugcugcccccauagcugagacgaaggggucuccucugcaugggaugcgccaagacccacgcacuugaagccucaggccuugcacaguuucuuagaguuggcuccugggaccaaaugcuccugaagcaucuggccucucugacaacagguccugaguuuuaucccacauucaaaguucaaucuuuucgugaauuucuaugaaaauucaggucauccacaaggugacuagcauuucaguagauuugggggauuugcugagacgucucuccacacacgcccaucucucuuucagagcccccucugggcucugacucccugaucgggggccacccuccucucucuucucuccugaaacggggccuuuuucuaugggcaguucccuaccaucugcuuacagcuagauuuuuacaaauacagcacugugguguaccaucucugcuugggcgauauaucgggaacuccuuuucacauccauaaacaucuccuauagcauuuuaauggcagcaacaucucgaccgccaucggcucauugaacuuauuuuuuguugugggacauaaagagggguuccagccaguauccugagagguaaaucuuuguuuaaguccaugauuauuuucuugaaaugaauuccuaaaagugaaauugcagggucaauggcaaugcaugcauuuuuuaauauuaguugccauuuuaucuuccacagggggccuauuuucuuacucuagccaacauuaaaaaaucuucauuguccuucuccuguuccaacaagcaagaaaguggagaccaagggcugagaucaguagccagaaauguaauggagcuguuuaaaaauaguuaucuuaagcuuuauuagucgaaauacagugucuagaagcagucacgugacauccaguguucucugggcucccaccccauagcugaaguguuuaguucucuucagagcacagaguguucagggaugcugauaaacuagaguuaguccggcugacagugacucagauuuugaggaagcggaagcaguguccgaugaggaacaugugcaguaacuguggauguuuuuacagaagggcuuccaaggggaagugggaucaugaugucugaauauuugaaaggcuaccauauaaaagaggcugaagacuuuuuuucucuuuuuauuugagacuucuguuucuuuuauuugagcagaaauuagagggaagcauuuuuuuguuucuguuguuguuuugagacagggucucaccaacccagguuggagugcaguagugcaaucauagcucacugcagccucaaaguccugggcuuaagcaguccuccugcuucagccucccacacagcuaggacuacggguaugugccacuaugccagacacauuuuuaaaauuuuuugcagagacagcaucucgcuauguuccccaggcugaucucaaacuccugagcccaagugaucccuauuccuuggccucccaaagugcugggaucauaggcgugagccaccgugcccauucaggaagcagcguuuguuuuuaucugaggaagcccccaccaacaguucucgcuguccagugaaacagcugccuuuugaaacggggggcuccccaugcucagcaccucuucagcuguggcuggacauuagggacuguaauggaaagauuuucacaccuggagagaugauguccacaguuccuucugaguccaacaacaggugaugccaguguuucagagacaggaacaccugcucucaaagucagagacucagucacuccaggguggagacaggacuggcacugccaccugaaagggggcugggcagcugagaacugcacaggcaugcaggguugcuuuuugguguuucgcuucaauuuuccccacuuaaaagugaguugucgggugcaguggagggaacacagacugggcauaauuaggaccuggguuugaguugugguuccaucgucuuacagcugugauauguuggauaaguuuaacuucugugccuuaguuuccuaacuuguaaagcagaaacccucauauuugacaugguuaugguaugguguggacaaggucuuguaugaaguagcagaccaaguagucacugguuaacagaugcugucuuucucuccuucugucuuuuucaucuguuggcugggauucugggcaguagauucacuuugauauuauuacugauauuuaggaugaaaaagaagauuggucaagaccauguacaauaggcuaaauuuauuaugguuagguaguacaacauauaacgaaaaaugaagaauuuucauuucaaauuugaagaagagauauaggaugauucauacaugaagauuuauugcacuuuaucaauuugauacuguuuugugguauauuuuuaguuguuuugauagcacagauaauuuuaaacaaaugaaaacuauuuccucuauaacaucugauauuuucuuagguuuucuuuuaaauagcuuuuuaucacuucuuuggauuuccugguuuuuuuguccuuaaucauggaugugugggauucccuauuucaagagacgguuucucacaggugaagaaaauuuccugugauaccacauauccagugacaaauaauaaaacauaauuuaugggccuuuguaauugaaauggaucuauuuguuuguaauccuggccuuguccucgucuuuucuuucaugguguagcauuaugaccuucuagaggaagaauauuaggauuuuuuuucuuuuaagcacaguaaaauuacauucaauuugagaucaaccaaauaaaucugagagccuuguccuuugauauuaaauacauucuguuucccuuccuuggcugcuuucccagcgguugcucuguuuuacgugggguagcuuuagauuuguuuaagcugucuuuccuggggaggauuugaaugaagaguugcaguacagcagugaauaccuguauagaauccugaagccuccugcagccugaauccacugagacucucaguuuccugcacaacgggaccugcauccaggaagauaccuccccuccccuuguacaccugcgggugguagaugacagcucuuugcccaagagcauauguccugaucugcugcugaaggacagucgcaacugagaguccucuaaagaccgcauuugugcaugugccugugcgugagccucugugugcugggguuugcaugcgccucucugugcuggggugugcgugcgccucugugugcuggggucuucaugugcuuugugauguuaauucuuugaagggucaguuuuauagguuucugucaucuuuuuuuuuucaaauauaagguuuaguaaaaacaaaaauuuuaagaaagaaguggcauuguuuggaaagguagcauuauuuuaaaccaacauuuauuugaacaagucauccaaaugcaaguaguccccugaugacaaaagcgucuuuuucaaaaaguucacuugaagauugguuauuaggaucccagaaugaacugucccauggaaaugguguccugaguggcacuuaggagcgcugucuggcugugucucuggcugcagccagguccuagagugucagccacagagcugaugcuggcggggccccgagcagccuucccggggccucagugccuaugcucagccuccacucccaggcaccauggaccguuacagucgccagccacucucugcucaagggacacuguccugcucuccagccucgauaagauggggagaaaaguucccaaaacuaaaccaggaaaaaacagauucugaaaagguagcuauaacucagagccugguggauggguuacgggagggagaagaaauucuguacccaaggaaguagcaaagcacaaaaccuugugcccugaaugauagcgggugugaugaagaguaucaguggggaggcaugccgacuaagucaaagauggggaagagaaaaaagaaaaaguugcugggccugaagucuguguaacccagggagcaguggccggguaguggcuagucaggacagugggcagggaugcguccugcagaauggaccggcagacagaaguggugggaaguucaccucccacaccagccuuagggcccccuucuccugcagggguccagagccaggacuugucaggccaccguaggucugcucugucucuccagguccuggcccuucucucccagaggcagaagaauuaaccugggcccauccccucucugacuguacacauuguuuuucauggcuacagggauaagaagggaaggccuuagggccaucaguccaaagguaauggacaaggaaucucccuuccucuugcgguuagcccagcccuucaaauggacuggccuccauuugccaucagacaucagaugcagcugcgagguggccaggaggggagggacacucuccccacagugccacaggccucugggaacagugucagaacaaguugcaggaacgccuguagggcuuagcaggauguucauuuucauuacugaagugcacugcuuagcagcuuccgggcugggcccccauccaccauagaggggagcagagagagcuguggcagccuauuccagugcgugcggaggggucagugcugaagaugacaagcauaggucuguggacacgaggggaggagagagagcaagaagagcaucccagcucugcggggagaagaaguggagccugcccguucccauugggccuccaucuucucuguccagacuugaucuccaaacugaaaaggguacagcaaacaagguuagaaggguauugaagucugagucagguggagagagacaggacucauuuuaaacggcuuucagugaaugugucuccaaguccggaccaaggucaagacagggagggcacagccagaacccgagagguggcuauaauuucuggggagugacuugggagucacugaggugccggcagagcaggaacaaacaccauugucucuguguuuguugcuguguucaguggcaguuagaugugguuaaacuugagcucuagccuugguggaauuucaaguuauuagacagaagaguggaagcacuuauaaggcccccuggcaagaggguuuuagaaaagcugugguugggauagagcucugcgugagggggcaggaagaggcuugcagagagaggagaaagaaaagagagagggugcagagaggcagcagcuagggaccccagggagggcuccuggaggagguagccacauugagaggcagcucagcuggcaggagggguagacacauacaucgcaguggcccugccuuaucuguaaguaugcacagcaucagcggugcgggcauggcuaggaagaccagcuuuaguaagaguucccagguacaccuucugggguugccgaugggacugacaaaacaguaaugaaguauuagccagguuaguggaagcauggcagccuuccugagaggugcugugcccgcaccgccacagauuccaccguggcuccuccuggaggaggagggagcgcuggggaggcaccacuggccacacaagccggaggugagcagagaccuggacgugaguuuggggcuugcaggggcugggcuggcuuggaggugacauggcauuuggcuggggacaauccucagauaggggcagggccuuccugagcagggggcagaugugcacuaggcuguacacacuugcaccagggucgucagccuccucacuuucgucuccugucugagcauccuucguuccacagccagaggcacauuccuggagugcaaaguggaucagcacucauuuacuccaaauauccugugcacucuagaauguggggaguaagguucaaguacuucagcccaggcuagaggauuugcagccacugggcacagggcccccucaccuccugccugccgucccucccuacugggucucuucugucucugggugucuucuguuacaugccuccugcaucuggcaggcuccugcucacgcuucaagacccagcccaagugcccuuucuccggggcuuucuuggaaccuuggcuugguuauggagcuaucccaucuccuccucacuuuuggauggcgggucuuuccagugagguguuuguuaauuuccguacauuugcuugggcuuggcauuuucacuguacugggcuguucugaucaacuuggggaaaauagagggugguggacuguuuuucuccaaaauuaagacccaaaauaaaaugucugucuuaugaggucacccauacauuccucaggacggcaagugcgagacgucccuuuaguauucuuccaacccuaggauugagagagggugggugugggucuugacaggagaugggaagguacagcuccaccuggggacacaggcuucugcauucuugccccguccagcacacaagcugcugucagcaggcaggccccgcuucuccucaucccauccccacugagcaggagaaguuccgcaucugagugggagcccccagaggcuuuguggcccucaauagcccucugggugaugcagagagcaggagaaaaugguaaaggaaggugcccauggcaugcacaggugaggggcagagggcuggugcuucccgucucugcacaguccugagaacuggguuucucagacccaguaccgccaaggaaugugaaaaacagcuuaaguggaaaaccuagggaccuaacugaucaugauauggcugauaguaaaacuaauuuucucuuagaguaggccccuggcacuuccauuuuguagugggcugugucuggacuauuccucuuucaagcacuaacaccccuggcuucagagcaagccucucuuccuccacacuccaccugacaugggaccugucucgcaucucccccugccugaaacaagcagagaaugacauugaguuguuauuuccagguguuucuugggagcagcagauggaaaugaaaggauacaaguguagacguaggugaaaucauccacuggccccgccuucucacuucucacagcgcuauggggagggcgggagguacucguggguaacagcagggcaugaauucagugcauccgcaggucuguaccccugcucgccugggcagugcccacaggacccccauaaagaaagcagggauucccucuaugcuuccugcucgcccccccggggucaguugcagagugggacaccccucaugggugucacagagggccugguggcugggugguucccagcagcccuuucugggugagggcauaggggguuacaucagagaggcagggacauucuguuuguguucggucauuucugccuguaaauaucaguuaauuuuauaguuaguaguguaggacuuuugcugugaucaucucauuuaguuguuauaacaaccccagaaguggaauauuauuuccauuuuauacaaaccagagugucagagggagucagugagccaggcucacccucaugcuuggauuuugugcucugugugugugugugcaugcgugcguacaugcgugcguguguguguucugcugcuccucugcucaaguccuugaauccuuaucagugacacagcauuggccuggaccccuguuggccagcucugcacccucuguucccccgugcuccagccagcgaucugacugauggggcaggcaggcucgggagggcugacaggcuuugcgguggaacacauuuaaaaaaugccugcaaacgagcgaaagaggcguaggaguaagcguccggcgcaagaccacagcacgucucauaugcggcuguaucggcacgcagcgaugagauguguaagaacuaacacgaagcugcguuccucccagucacgcgcaggauuggauuccuuuucacggucagccuccgguaccuucgacccaggacgagacccucaguaguaaagcccuuaacaggugcuuguggacugcgcaugugggaugcugaggugcugcgggcgaggcugagucugugaggugaggagcuccaucuucaccuggguaggaaagggagccuggagcaauacgaggaguggcgcgggcaggacagcagcccaggagaguacgaggaguggcaggggcaggaccagcagcccaggagcguacgaggaguggcaggggcaggacagcagcccaggagaguacgaggaguggcaggggcaggacagcagcccaggagcguacgaggaguggcaggggcaggacagcagcccaggagcguacgaggaguggcaggggcaggacagcagcccaggagagugagacccuugugggcccagugcuucucagaggacauggccaugcauguguggagcagggcagucugugggaccaccugaggguuugacugggacuagcgcagaccucauuccagcccagguaggucggcauggggucgcagacaggugacuuguucugucugcggaauaaucagcuguaagcuucucauuuuuacugaaucagggguuucaaggcugguaaggucaaacaauuccuucuuugguuucaaagaccacaucuaagagaagucuaucuucuggaaagaaauuuccucaaaaauauuuucauaaccuuauuuaauaagcaaacuuuucgcagcccuuuuuaggauaaugcucucuuucuuuucucauguuauuuaaauaccuuucucauguuauuuaaauguauguuuuauuuuccugucaucuuuggugaugaagcuaguuucugccuccucauguaaaauguuauaucuuugaaguauuuuccgucagcugcuucugcuuagccaaguccacuuucccgagauucucauauauuuuuauuuucuaaagcuguuuaauuuccagaacuauuuuuaaagauuuuuaaaaagaugauaaaagcacaagaugauguauggaugacaugucauauuuuuaggaaggcaauauauucagacguuuuguugguuguuuuguggcuguuucucucuaaccucugacucauacccuacucuguguaccucucgccaugucccuguuugcgugggguugggcugggacgcgugugcccucugcaaaccuuguucuccauggauuuuccugccuuugccucuggggguagcuucaaaccuagcaauucuauauaguacagaaauaaccaauuuuaguaaugguucuuuagcuuagcguuuuccaaauuauggguugugacccaucauuagguggugaagccaguuucgagagauaccuaaaacaaaaauagaauagaucuguuccucgcauauagugaggguaaguuugguauugugagacuuuuguaucaguuggguguguauguuugcauugugacaccugggucacaguguuaaaagugugucauugucaagcaaacuugaaagccccuguaguauuccaguacugcuaagcuuuuaugaaagaaauacuguugauagucugucucuaguaaaacagcugugugucucagggagauugccacaagacaaggcagggcccacaccaggguccuguugaagacgcuccugugucaaaggaggcggcagggcaggguaccgcucaguaggcucauguagucuuugggugcugaagaaagaugauauuuuugugaaguuucaagggcuucuccaaguucauuuuuacucaugauucaaaucucaguucagauauucuuucugcagggaagccgccccugguuucccagucuagauaagauugcuccauuagaugcuucauucuucacccucagagcacuuagcucaguuuuuauugauacauuuauuaguauggucauuuaauucuuuuuuuucuuuuuuuuuuuuuuuuuugagauggagucuugcacuguugcccaggcuggagugcaguggugcaaucucggcucacugcaaccuccgccucccagguucaaacgauucuccugccucagccuccugaguagcugggauuacaggcgccugccaccacgucuggcuaauuuuuuguauuuuuaguagagaugggguuucaccauguuggccaggcuggucucgaacgccuggccucgugauccaccugccucggccuccccaaagugcugggauuacaggcgugagccagugcgcccggccuaguacagucauuugauucuugucugucucccucuaccuccuagaacaugaaguccacagcaugggucacgggccugugugugcuuauucucccugcaggaucuagcaugacaccucauguggagucaccuaguaugcaccgcaggccagggucugagcugcccugugaaugacuggcauuagacaucuugcaaacccugugcugugauggucuuauuccagaagggcugugggggugugagagcacaaagagauguauggguggaaaugggauugaagcuucuagagcugugcagaggccuuaucccauggccacugcucuccuugcacacaggcccacaccaaccagaguccucagacuuugcuguccccagcacgccggugagaagcaaguaggcuguaagcagaguuacaugguaggaugaaaccucucucgggugguggucucuucucuggcugcgcaugggacuccgucaugguucuuuauuccauaguucaaaguuccguggugcaggguauucaggacauuaaauacguuuguuagaaccagcucauuggaauucugccguaggugcugcugguuuagauuuuaacaaaagcuucaaagccucuuuuguauuaguccgugaaaggauaaacucacuggugaggaguagaagcugcucgcucuugagcgcagguagguguuauuuuucuucucauccuugaaaauauaugagggugaaggcaggaagaugaggagagaguggaggaucaguaaguauuuuuaggauggucuuugcacggaaaacauguuuccaguaacauguuuuggaaacauuuuauuugcggcauaagaagaugcugacaccuuggccggcucccacaggcagcuguuuauuggggccgugguaucaucgcuguagccaggcucguggguuuuggaacugauuuucgauuugagaggccagacuucugugacaccccccaagcaucauuuccacggcaaccagcugugaugagauggggguucugaccucgcaggaccauugcaacaagaagcagaugagcuuuuagauagaaaauuuacucuucugucuugaacaaauuacauguaacugauucucaguuuccucaucucugaaauagagaaaggaacacaauggcccuucaauuguguaaugagggauuucuguugggaaaguagauauggagguacacaugcuauuaucauaccguguuuucaaggucaacugcacgacccaaggguugacacgcugcaaaagagcugucucccccuugcugcccuguuucguguagcugccggcagcccugccuuccccucuccaaccuuggcucugacggccaggcucuugcuugcuccuuagucacacuggccuccuggcugguuccugaaugggcaugcucaugucgacacuaggaccuuugcacugcggugcccuauucucccggagaguugcaugcccacacccugccuuuguucaguuaucugcucaaaaucaucuugcuaggccuuaccagaccaccccauaaagaacaggaacccuguacucccugcccccauaacagccuuauguuucuucauggcaguuccaaccacuggaaauuguaugaguuucaugugagcaggguuguuggugguguuuauuauuauuuuuuaguuugucauaucuaugaaguggaacauuguaggccauuaaguccucgugaagaaccuuuuguuauucuauuuacuuauuuuguaggaaacuuaauuucaaacaaugaauagcguauccgagaucauauagguggcaaauggcgaauggugcuugauugaaacccagguugacacagaaucauaaauguucuccuugcuucaagucugccucuccuuccaccugucuucugcuguuugagcauccugccuuugugcauuucucuggcucugccuuuauuacaccugggcucauccugacuucacucgccuagcagugcucuccucucaaugcuccuuggucgccaacacugccucugcccuaggguagagcuccucagugcagugguguguucuuggagaaccuugugccuggcauucuaggguucaggccaaugccaggggacaggcaggcugccuuggcuuccuuucuuccaggaagagaacagguaugauguguguguuaggaauggccaggccccugcugugcauaugaggacaccucugagagccacauccuucacuuucuccccguggggucaggcauacuaacagcugcaaaaaggaccccuugacaaggucucaccaaaggguauuuugauauccuguucuuuagggguuauuuuuuguauaaacauuuauuuuuguguuaccugauguuacaugauggaauaccuuaugugcaguuuauacaugaucuucuucacccuaccugagauaaugucaacauuauaaucccuggaaaggugggacaagcugagaacaucuccuuuuauagaaaacaugaaugaugccacaguuacagguacuuugaucuuacuuuguucacuggacagaugccuguacaccaggccuuuaacuuucaugcuguaaauggcaaaccugcaguuuccuauucucuggguuguagacaggaugaugcuugcuugugcuguuuucagcuaguuuguuguuuaaaauggccacuauauaaagaagccauggaugugauuucuggaguuaacacuuacugcagucucugugaugagcacuuggucacauuuucccucaucccuacccucugcucugcucuuuuuagggaaaguacgguggccagacuuuaaccaggaagcuuauguuggagggacgaugguccgcuccgggcaggacccuuacgcccgcaacaaguucaaccagguggagagugauaagcuucgaauggacagagccaucccugacacccggcaugaccaguaaguaccccacuaagcaccugcugcagcuucauuugcuuucacacaaaccaguacgucgcuuucaccugugacacuagaacuucuccauuacucugggaaauugaauguguguuguaaaacuaggaaaaauccugagguauauggcaauggaacuucauccauaggcaguggaaggaugguucuagauucagcucuagucuuuaggugcccuguggcagugugcagaggcuguggguuucuggccagagcguggaagucagaaagagaguugugugacuggcuuuauauuuagugaucacuuguuauuuuuaugauccauucacaaaaaugcaaaauuugucauuguucccaaccuuggaggaagaaaaucuaaauuccugcuuauugugacagcuuauauuggaaauguucuaaagauuagaaaggagaaaugaacuacccagcacaauagauguuaaauugagcagaaacacaggagggacaggugccacaucuccacacccuguacuaaaggaagggcucuuguccacaucuuucuuucuauuuuuagagauagggucucccucuaucacccagguuggaaugcaguggugcgaucauagcucacuguaaccucaaacucuugggcucaagcaauccucccaucucagccuccugaguagcuaggacuacaggcauucaccacuacauccagauaauauuuauuuaaaauuuuuuauuuuuauuuuuugguagaggugaagucucuccauuugcucaggcugguuuugaacuccuggccuuaagugauccucccgccuuagccucccaaagugcuggaaucacaaacaugaaccacugcucuccugaccuccuucuuuuucuuuuucuuuuucuuuuuuuuuuuggagacugagucuugcucuguugccuaggcuggaauauagugaugugaucuuggcucacugcaaccucuacuccucuacuucccagguucaagcaauuuguggcucagccucccgaguaucuggaauuacagcugccugccaccacaccugacuaauuuuuguauuuuuaguagagaugggauuucaccauguuggccaggcuggucucaaacuccagaccucaagugauccgcccgccucggccucccaaagugcugggauuacaggcaugcuccaccuugcccaccccuuuuuauucuucaaagaucuugagaguggaggguacuuuggggucuaugaagcucagcucaggagguugguaggcauuuuaaaaagaguauuugucaccacuuaucaggaaagugauaugcauaacccucauuguuaucccauaccuguaaguuugcugauaagaaccuugauugggaggucuuucacauuggaauucucagugaauuagucuuguuucagauuauuaaaaaauaaggagcugcauuuugaaggcagcuguuuuccugggugcuugguauaucuuccugcuaaguuagagucauucauucaucagugaauggaauauagauuacacaucuaccauaugucagacucugugcucggauccuagcauuucacccagaaaaaucuggucccauuccagcugcuagggguggcaggugcaccaggaagugaggucguguagcuccauggguugggcagucuacuuugcaugaauacuuuugaggcacucaggagggugggagggucaggacaggucccaagagcggugaauuggguggggacacccaggaagaaggaagugcagaagcccugccaggaaagcauggggcucccagagagccagcaagugucuaauuucacgggcuggaguuucagggauugaugggggagggagagcuggagagagacaaauggccagugaaacuacauucacacacacugcauacagugaaagaagauuuuucucucuuacucucaaggacuuuauggacaguguaggugccaguuaacugccaggagcuuccuuucuuaacagcuuucuuuggguucuagucagcucuguucaccuauuccagcucauauuuaagaaauauguagcuuuacaguuuuuuuagggccauggaaaaguguguguguguguuuguguguuaauaucugauacauaugaguauauguaaacauacauaucuuauauaauaguaagaaucucaucauuuuccuaacuccacuccaaaagauugucuuugauuaauguuuccugucauccauuaauuucuuuucuaaagccagcucuacucaguccuuaugcuguccugguuaaagucagcuugacuaacuguuuaguacuguaucuaaaauaaggggugacaaccugggguccaaggaccuccagggagccaugcaugggcuuugggauguugugaaaguguugaggccgaagcugugugcaagaucgcaaguguauauguaggugcguuucuggggacaggguccuucacuuuuuccagagggucccagguguguacuuccccaccaccagcccauccccaggcuaaccaggccaagcagcccaugccaggugcuucuccggcccccacccacguaauccacacaacccuuuaagauaggcuugaagcuuaucuucauacacagagaggaaacggaggugcccggaauguugauaacuugcccagugauuaagagcuacugacugaagaccagaaagcguccguguagcuuuuaagaagggcuuggccuaaacucaggggaauaaagucuagcagaaucuagugcagaaaucuucccugaugacuucagucgacugcuuggcaugacaucuccaugagauggucugaauuucuuuucaccauguggguuaagagcuaguuuucccacaagauuuuaucuuuacauacuuaacuuacccugugagcugagagaagaaugguguucuuucucauggcucaucagcaugugggcuggcuuucucaucugccucccuugcaagucccuacaaaguccccaaaacuauauguacguauauuuuuuuucaaaguuuuugaaauaugaguuuguccaaacagauguuugaauauucaucccacagugugggaugcauuuuagguggguuuaauuuuaguuccagccagugugucauguucauuugcauguguuaaaggggcagcugggaugccuuccacauuuguuggauuugggcuaaauuaaagucuauccauagucaauuggaugccuagagcugagccgauuuaaugucucaaaguguaagcucuagaauuaccauucuuguugaaugucagguuaagaagauuggguuaccucuuugaauuucucucccaauauaucuaauggggagcuauuucagaauuugaccuuucuguauaaaauguuuuuugucucugcaguaucuaccuucguguugaucaauagaaauucuugcacaguagaauucagucuuuaguuuugauaaaucugaaagcaguacagguggaggguaauuaagaaugagguguuuggaguccuacagaccuggguugaaaaucucagacccuccaguucuuaauucugugaccuuuaucaucuauaagaugauagaacauuacuccaucuguaaccuaugaagauuaagcaacauguuuacaugggcugguugccccuccccugagccaccucagugagguaucccuugaccaucuucccuaggaguucaacccccugacccccacuccaaaacuucccgucccccuuuccugcuugauuuuucuccacaguuccucucaccacccacacacuguguauuuuacuuauuuuuuucuuccgaauagugaguuauuguauccaggguuguuauucagacaccuccgggcacucaguaaauucaauaaguauuugcugagugagugaauuguuuagcagagugccuggcauauauugagugcccaauaaaucaugcaagauaugaagaaucauaaaagaauacaggagaaggaaagggggauauuuaaguauaaagguccugugaacucaagaugggccacacacaaauaaccucauuguguuuguguucucccaggacuggaaaacugcgauuauaauccaccccuuauuacccugaaggauagauacaaggaauaaggcuucagagccucccaaacaaacagacaaacaaaaaacucugggcuaugcuuuauuuaccuuucuagauguauauauuguaccaagaagaaauauuuacauggaaucaggaagcacacaaaagccagcugugagugaaauacuaaauacuauguauaagauauauuagguccucuuagauauuagaaagaugauagcccaucuuauuuuuuuuuucuuuucuuucugcaaggucucacucugucacccaggcugcagugguacaauuuuggcucacuguagccuuucccucuugggcucaagugauucuccugccccagccuccugaguagcugggaccgugggugcgcaucaugacgcuaggcuaaguuuuuguagagauggggucuuacuguguugcccaggcuggucucaaacuccuggccucaagcaauucucccgccuuggccucccaaaaugcugagauaguaagugugagccacggcauucagccccauccuaguuuugaaagcaccauuucuuuucuuuuuauuuuuaaauugauauaucauaguuguuaucuaucuuggcgguacaugugagauuuugauaccugucuacaauguguaaugaucaagucaggguaauugggauaucccucaccucuaacagugaucucugcaugguuucucaauuuaaaaaaauaaucuucuugcuuggaaauuucaaauaaauuaucaagacuuaaaagcaaauuaaaccaaugggaauucugaaguuucuuuuuuguaguaaguguuuguuuuuucucucucucucugcguugggaagcuguucuuacuguccaggcagaagguaauggaaaguagcauuggugguggugagaaguggucuggugggcuauauucugaagguggggccaacaggaugugcuaauggacuggagggggguauggcuuggaagagggugccaaggauuguggcuggcacaagggaagaccugcagucuccucagcugagauauagggaggcugugaguggagcagguguagggaaauguggacauguuaaugcugcucaguguagguggaccuguuuuguagguggugggauaugugucugguguucaggaggaaggucuuagcgggaauguaaauuuggaaauguucagcguauggaugguauuuaaaaccgugaggcuggguguuaagcccaagggaauggaugcagacagaagaggcccaaggccugagcccuggacgauuccaacauugagaucuuuagcugugaaucuggagccaacggcugacacuugaggacagucuaacacuguagauugcguacuauuuuaggcuguguucccgugaucaggagauauaauuuuaugaagcuaugcgacugugaagcuaaaaggagccucaggggagugucuaauucagugguucucagccuugagcugugccacccacccagagcgaagauggaaauguggggguggaggaucggggguuguuagaauacccguggggugcuccuggcauuuaccaccagggcccaaugaagccacauauuucguauagcccagguuggucuggcacauugaagagacuguccuacccaaauggccacagggcuuccugucaagcccucauuuacuuauuuccccccauuaguuaaaaaaaaaaaagcauguugaaguuguuuuuuuguuuuuucuguuauugcucugagucauaccugccuucuccaucagccagcccucaaaagcagguugaaagccaucaccuccugagccuuguagcccauacaggccccacaggaagucucugucccucugacuagcagccgcauggaaguaugaguguguuguggacugaauugugcccccucaaguuucuuacguugaagucccaaaccccagagugacuguauuuggagacagguccuuuguggaggugauuaagguuagaggagguccuaaaggguggcgcccugauccaccuguccuacaggacagguguccuuauaggaggaggaagauggaaagagagauuuuuuucccuaccaugugagcacacagcagaacagggccaccugcaagccaggaagaggccucaccaggaaccagaucugcugguaccuugagcugagcuuccagccuccagagcugugagaaauacaaaucuauuguugggccaggugcaguggcucaugccuguaaucccagcacuuugggaggccaaggcgggugaaucgcuugaguccaggaguuugagaccagccugggcaacauagcgaaaccccaucucuacaagaaaauacaaaaauuagcugggcauaguggcucacacuuguggucccagcuacaagggaggcugaagugggaggauggcuugagccuaggaggcugagccugcacugcacuucagccuggguggcagagcaagaccuugucucaaaaaaaaaaaaaaagucuauuguuuaaggucccgucugugguauugucagcccaggcugacuaauacagaguggaaacgauacagcaugaccggcaggccagugggaggaccggccagccagauccugaaaugacuuggguaacacuugccuucauuuucucuuaagcucuucugaagccucuccccaguguugucugguucagagguuccugggguaacauccccuugaugccuucuuuagagugugcugcgcuuaggaagugagugucgucaggcuggagcguuuccgggauccaaacuccuuuccaggaggguuuugauuguuuuugccuggaaaugcaucugauaagaaaauaaaguagaggaacccaggaaguuuaugaaaucucuuucucucuacuagggaaaacuugggacaguuuacauugaaauuauuuacagauguaaaaugaaaucaaccuuuaggggggaaaccauuuucuuuguuuucuucuuuccccugucaacuagacaccguuccuuuugacuuguuucauuaaauccuuuaaaaacaagaacugcuuguuaaagaaacagguuuccuuuggguuucaaacguuuaguuauuagaaagcuuuucucugccuugccaccacuacauuuaaaaugugggguuuugaaacauuuuugugucucacgcugaaauaccacugccugaaccauuucccuacaaaggaaccuucuuugagaggaguguguccaaguuguacaucuaaucgguuuaucuuuaagucaagaauauguuguuuuuacucuaguuacagauuauaguggcucacccuuuguuuagaagaauuacuaaagaacucuauuuugaccacuuuugaaaugucugccuuuaacacagccaaaacauaggucaaagcucuuaaggguguauucuuuuauuuauuuuuuaggggcauuuaaagagggcagacauugaaggccuggguugugcuguuuacucucacuggaaugucaguauugauaucaguuguuuuaagaguggcuaaucaggauuaaggauuguggggaaagauaaaauccaaacuucccauucuuauucuggaagaacaaacauugcugaagccaagugaagguuuucagcauuaagucagccagcuuggagggaggcuuuggcuaaggcaacuauuaggggacucagaguuuucuuuuuaggggggcagaagaucuagggaaauccacacagcuccccagugggagugugauuggagacccaggcagggcuggagcuuuguccuuauguuguacuucucggcagcucgcggcgucucauaaacaugcgccgcuggccuccugagauucuugugacggaaccgcugcuccaugguagagcuggcccgagcacccacuccucccgcaucaauuugcugcccaacuccaacucuguaugccgcaccacaggguccugguggaggagaugggaggccacacggggugucacagguggggacaggcgcuucucuaggcuuagcuguucuggcuuuguuggcauuuguggccguggggcagguggaguuugggugugguguaacagugaauguuuaaaagcuuguucaauaaucacaguaacaaagcaguucauugaacauuuuuugguaucaaggcccaugcucagccuuuugugugcauuaauuuuauuuaaggcugggcacaguggcucacaccuguaauuucagcucuuugagaggcugaagcaggaggauagcuugagaccaaccugggcaauauagugagaccccaucuuaaaaaacaauuacucuagugugguggugugcaccuguacucccagccgcuugggaggcugaaaggggagggucacucgagcccagaaguuugugguugcagugagcuaugaucaugcuauugcacucuagccugggcaacagagugagacucuaucucuaaaaauaaaaaauuuuauuuacucugcaucacacuccuguaaaguggguagggaugcuauacuucugaugaugucguauaccaguucccagaaggcucggaacucagaccccacuuccagaaaguagaagaguugcacacaggagucagguucggcaggaugugagcucaguuugcagagcagagguuguuuuucucauuuuucacauugucgguuggaacauguuuggggagaggcaggcagcuaggauaucccggggccucauaaggcaccaccuuguaucuagagagccuuaguccccagggauuuuacaguuacuaagccaugaaguuuuaucacuugucuaugaggcagacgagaaaggugagccacuugccugaguucuaacagggcucacugguggaggaauuggagcacucuguauccugggcucaggguucugucuaacaguuguggcucccuuacuguccgcucuucagagggucuuucauacucccggcuuuuaggcaugagucuuggcaugaggccugaaugcaccuaaaaaauggaagagauggguguugguaacuugcagccaaacaaccuccuaagggaagcuggccacacguugaugggaugcugagaaauggagaagaaaugggguuguuuuucuuuuuccagcuucagauucucgaagaaaauguauuggaagagugcacucuauuucuguucccuuggaacauugcugaugccguucaggaagugagacugcuuguguguucagucagugugacaucucugccugucagugugacaucucugccugcuguuggaagggugcuggcaggcucagcgagauauacgagauguggggagugggaaguggccagcaauaauggcuccuugcuuaacgggucccccaccaacucaucccagguuguaacuugcaucugauaugcacaguucacaccaaagccaugucauuauucaucagcgugcuuguuuauguuuuguuuuuauuuuuugugucuuuauaaaaccaacuucugguuucaaccacagaccguucuuuuucuucccuugauauguuuccucuuuuuuuuuggucuauuucaggccuucucucugucugaauuaaagaaugcauugagacugguauaaguagacuguauugauuugacuguagagauuucguuugugucgauguuggcaucucugaagggcccguuucaagucuccuuuucaaagaucauuagcaaacguauucucaaagcuuaaccccugaguggcugcccacauguguggcucaguuuccccaucuguaacucuggguuaugguuugggcaaaagcacaaugaugcuaaaugaguugugugauuugcuuucuuuacucuuuagucuuuucuuucugccaucauccugggaaugcagugaugaccaugaggaucgucuuuguugucaagaaacuguagucuucccggagaggcagacaaggaaacaggcaauuacguagccuaguaaggauaaccuaaccaccucuagaccauuuacaacagagcucuguucuuucuauuuuagaccuguuugugaguuucuguuauuuucuuaguagacuggcccuuuuaucauuaugaaaugcacuucuugucagugguaaugcuucuuguuuuacaauaucaguagagcugcaccaucuuucuuugguuucauguuuuugcaugguauacauuuucccaugcuuucacuuucaaacuuuuuauguccuuauauuuaaaguguaucuucuguaaguagccuauaguuggauuuuggacuuucaucugcugugacaaucuuuaucuuuuauaugguguauuuaguucuuuuacauuuaauguaaguacuaguuuauugggguuuaacaccaacaucucacugguuguguucucuuaguuccaccugcuuuguguuucuuuuucccuugcauccuccuacguuuuuucuucucuguugguuugcuaaauucuugacuaguaaguccacauguagagccuaauguaaaugaauaauuuuauuacuucuuagacaaugcacagaccuucuaauaauuuaccuuccacuuaccuucagcccuuugugcucuuguugucauuuagcuuaauucuuucuuuauaaacucuauaggauaucuuuuauuguuuuaugcaguaaauauccuuuugauuuauucacauauuuauauucccauugcuccucauuucuuauauuucuauuuuucuaccuaagaccauauuccuucuguauuucauuaguauuucuauuagucccaguauguuggcaaugaauuguauccuuuuguuugucugaaaacaucuuaacuuuacuuuuuuuuuuuuuugagacggagucucgcucauguugcccaggcuggagugcaguggugugaucuaagcucacugcaaccuccgccuccccaguucaagugauucuccugccucagcuucccaaguaacugggauuacaggcacccaccaccauaccuggccaauuuuguauuuuuaguagagacuaggcuucaccauguuggccaggccggucuugaacuccugaccucaagccaucugcccaccccagccucccaaagugcugggauuacaggugugagccaccacgcccggcuuacuuuuguuuuugaagagucuuuucacugacugugaaauucuggguugacagugacugucagcaccuuuacguugucuuucaguugucuucuguuuuuuguuguuucuggcgaaaugucuaccguuagucuuguucuuuuugaagacauuugacuuuuccuuccagcugccuuuucagauauuucuuuuuuucagcaauuuugccauaauaugccuagcaguuguuuuccuugugcugaaccuguuugggauuuguggaauuuccugacucuugagcuucaugccuugucaguuuugccaugcugcaguucugucuccucuuccucugagacccuaauuucaucuuuguuagauaauucugcguuuccucugucccucauaagcucuuuucuguacuuuuuauucuuuuugauucccugugucucagucuggauauauuucuguuggccugcuuccuguucauugauccuuuccucugcucugucuagucugcuuuuaaauccacugcugaauucuucauuucagugauuguguuuuguuguguaugaauaaauaccgagauauuucagggcucucacugacuuuuuccuccaaagaggauuuaguuuuguucucuggcaggcaguuaaaauagggcaggucaccuuaaucaagucuggaauugagcugguauaaagcuggguuucggucuuuugugagagagcuggugaguuuccaguucucuuuugccacuaggaaguagcccugugggauucgaccuggaagucugggauauguaucagagcccaguuuccucagcaagcccugaaguccauuucuggccuccacagcuccacagcaccuccagaagcuuucacuuggcucugcaccuacaagaccaucgcuucugcucggcucagucggccguuuggcucuaugccguuugaggggaagaggaucagagaauguuggccuuccucucuaggugcuucuccuuucuggaaaccugaccucacaccuggcugcuuugcuagcucucuagugccuucaaauagauucuucaguguauuucaucccgaauuucugguugcuuuuagugaguagguuggucuacagcaaggaacuuuacugucacuggaagcaggaaaaacaccugaguguuuuauuuggaauucaaauccacucugaauuuggcaguuuauaaauuuugcccugagcaauaaugucuaucucgaaggagaguaaauggaaauacaggcuugaaguugggauguguugcuuuuauuaauagcucaaccagcuguuagcucccagacugagguuaaaauaaucucuguaaacccuggguuucuuaucuguaaaacaauaaucaugcuugccuggccugucuuacagcauuuuuauuaggcucagauguacacauaaacuacauacauuaauuacacaaauucaggacauuaauauagugacuaguggcuuguauauauaucagcuuuaaguaaagaaugaacuguuauuuuguuacacuuugcucucaaaaugugugugacauggcuggcagacuuucagcuuccaguaugugaaugccucugucacacugagaugguauuggauuguuuuaucauagaaccaaaaacaguuguggaaauagcugugaagcagugauccuaccuauuucagaaagaaauuagaccaggaaaaauggagucaacagaguuuugcuugauaaaugagaucaaucuucgaguccuaacaaacuguccuacuucaacuauccauuuaaaacccaucacuuugccccccgucguggaaccaugaaacugaaagaacaacuuucuuuuucaguggaaggguuuuguauauuuuaggaaacagucaaaauacuguaaaauuuauuuuaacuuuuuuugucauuuaggcuacguauuucacuugaauaugguuucggagauuacuugugauguuucuaaugaacuuaaaagaagcagcauugucaguuuaugguacauucauuauuaagucaaaacaccgaucuguucacugguguaacugacaauucacauauacuuuggaguugucucaccccguugcccaagcuggaguacagagaugugaucauagcucaccguaacaaacuccugggcucaagccaucccccugaguagcuaagacuacaggugugcgccacuguacucagcugauuuaaaaaauuguuuaguagagaugggguguugcuauguugcccacacuggccucaaaccccugaccucaagugauccucuugccuuuaccucccaaagugcuggguuuacaggcaugagccaccaugccuggccuguacucuggaguuguuaaauguuaaugguagaaccuaugagggcccauaaucuccacugccaucuguaaaauuuaaaguucagacuuuuauaguaacgacuaucuuaacuauauugaauaagccaugauuuucuucaucugacaauaaugugagaaaauccacaccucuuuggaaauucaaguuauuuaaaaaaggaaauaucccaauaggaauauuguacuuggauuuaaaguuuuauauucacugaagauuuauuuuuauucuuggauuuaugcauuuauuuagcaaagauuugagugcuaacuacaugacagguguuuuucuggucacuggggaaacagcugugaacaaaacauuaaaaaaaaacucugccgucauagagcucacauuaagaggaugggggagaaaacaauaaaauaaaucauuaauuaugugguuuuuaaaaagcauguuaaauacagaagagaaaaaaaaagcgguggagguuaggagugugaaagagucaaggguuuuaguacuaaacaggugaucagggaagaucucacugacaggaagguguuuaggcaaagaccugagggaagggacgagggagugugcguuugaauaacugggaagagaguucucaucaggggagguggcaagggcaaaggccccaaagagguagugugccaggccuaucuaaaggacagcaggaagccagagucgcuaggcagguggccaugaggaagaguagaaagaggugaggucugagaggagucaaggcaccaagcccuaggagccuggaggcgcaugguaagggcauuggcuuugucucugucauaguccguuuugugcugcuauaacaaaauaccugagacuggguaacuuacaaagaacagaaguuuacuucuuauaguauggagguugggaaguccaagaucuuuaagcuggcagggcucacauugucuggugagaaucugguuucugcuuucaagauggcgccaagaacaguggaucuuccagaggggacaaaugcuguauccucacauggcagaaggcagaaaggcaaaaaagggacaaacucccuucauuaagcccuuuuaaagggucuucauuccuuucacaaaggaaaagcccucauuaucuaaucaccucuuaaagguucugucaccacuacauuggcuguuaaguugcaacaccugaauuuuggaagagacucauucaaacuguagcagccauugagugagauggaagccauuguagguuugggagcagaggaacagcaugaccugaauuaggccucuaaagggucaguuuuuuaaaagguugcugugauaagaccagguuuacuggggguggggugggaaauacaaggccagaagcagagaaaccuguugccgugauccagccaagaugacaguggcuaagaacaggggacuaacaauggagguggugagaggugguuggauucuggaugccuuuggaagguagagaugacaagauaugcugaaucggauguggaaugugaagaagagagggcugaaggaugccacugaguuucuuaaccaagcaacuugaagaauggacuuguccuuugcugagcagggagcaguacaaccuccugguuaagguguggaugcuggcaccaggucucccauguuggaaucccaguuaucccuuuagcagcugcacgaucuuggcgugucaguuagcuccuucgugauauaaguuaagggugaugauaauacucaucuuaugggcugccgugugaggacuaaauggguuaacaccuguaagugacuuagcacaguggcuggcacauagucaguacuaaacgaauacuagcugcuauucaggaagcauugcuggaaagauuaggagggaaguuuucauccaaguggaacuguccaguagguggaugaagauauacaaaaaucuggaauucaggaggcaagccuggggagaaguuacacaguugagauugucaauguuuauggaugguuuuaaaaucacuuuguuaucuaucccugaauguguauuuuuaaauguggagguauuucugguuaccaaaauaggcuuaaagcaggaguccccaaccccuaagccguggaccaguggugacacauggccuguuaggaaccaggccacgcagcaggacgugagcaguggaugagcaaacauuaccgccugagcuccgccuccugucagaucagcaugggcauuagauucucauaggagcacgaacccuauugugaacugcacaugcaagggaucuggguugugugcuccuuauuagaaucuaaugccugaugaucugagguggaacaguuucaucccaaaccaucuccccucuccaccaucuguagaaaaauugucuuccaugaaacuguuccuuggugccaaaaagguuggggaccgcuggcuuaagggacacuggguuuguuaucuguugccucuucuuuaugaugaugauugaauuuccucuggcaucuuugccauggcccuuuaaaccaaaucuuuuuuauucuugguaauucuuuaagugcaaaggccaagguacuuguucuugauauucacauauaagugucaccuguugaaguuggaaaauuccccguauguugcucugggcuagaauaaagcaaugcccugguugccuaauucugcuuggccaacguguacuggcgcgugggaccaugagcugcccaaguggccuugguggcuuucuguucuggcaucccucucaaauuaaccccuuccucucauugccacucuugguccagucccuuguccucccuucugagucacuggaccugccuacucagaucucucaguaccucucccaggcuuguauucugcaugccccucccacacaagaacuaaccuauggugaggacaccuggaucccccuccugggcccugcauagauggccugcaguagccgguccugccuccgccacccacuuaccuuucuugagacuucugacguggaugcauuccagaugugggggcauucuuugcaaagugcuuguggcugucuucauucaugguauucuccacugcccuucuaaaccuuucuaaaugggugugucccuuaaaacacaauuugccuagauucuuccaaagaacugcuucugacuggcccccugccaugggauugcugcccuugcuugagaccuugccacccccaaccagagccucugugccugggcuuucuuguuuuguagcugugcaugauuucuccagguauuucguaaguugcuuugggacagagacuaucuguaauuagacaguucucuaauuccucacuuaaauucuuagggaauucagauuguuaaaaaaauaucuagagagcuauuaaugacauauacacaauuugugaaauaauguuuuuaaucuugagacaguaccuuguacucaaacacacuaauguuuuugcagcagaacaugaauaugcauaccaagugggauaaaucaggagaacagucaucaggucagguuuuacugccacauaauucagaucauggcaggcuuugccaccaaauaugauacagauuuuuuuccaagguguuuuuguuuuuuuuuuuaauguuggaaucaaagauuaggaauuauggacccucgcuagguaaauaaagaagaauaccauugauucugcugccacaugauaaacagcccacuccggaggcaccagagccuacuuuuggguugcuaugcuguagaugaggggagcagggcauaaagggaguugaaacucccgggauggucuucagcuugauauccugcagggccucuggugcacagguugcccuugagauugguuagcacccagcguagcuccugguaggcuuugccacucccucacugucaccacgugcugggugggcugaacuagaucucucucgguagcugcuuuuauggaaucacucaguuaacccaguugacuguagaauccugucugcaaagaggcauccccuggaggccagcgcaugguggugccaucaaacgaagguacuuuuguuaggguugguccauucuugggcuuaaucagacccgcccuaaggaaaucaugguaugaugugacggugaugcuaaugaucugccuucuauuguuggcaaaccuuaucuuggccaaauauuagcuaaaaucucugaauuggucuguguuucaccuagauacuaauggucuacgcagugggcuguuagcaagcuuguaucaugaacuccccaaguucuccuuucuuuaaauacaccgaauuacucaaaacugguuuuuucuuuaaagaaaaagcuuuuuaaaaguagauacguguuuguugcacacaggaagaaaagucugaaagcuucacauugucucuggugaacauccuuccuaauuugucucauacccucugauguucgauguaugucauuuucuauaaauacaaugacaguaaaaugacacuguauuugcuguuugccugccuacuuuuuuuucauucaguaauacauaggaaauauuuucuaggacuguuaaauauauaacuuucccuuauaaaagcuguauauaucccauuuuauguuuauuuagcuagcucucugguaauggacugcuagauucuuuuccuuuuuaaugcuaacguugggaugaauauuuucgaauaaccuccuugcuuacucauuuaaaaggagaugcuauuugagaugacaguguguuauuugguucugaaaauguaccagaauuuacucaauauauugcugaguuuggcuacugcuuuauuuuagguuuugaaugaagauucauagcugaaagugucuguggccagccagccugccugccuucuuuuccuccucucucccgucuuccuuccuucaucuagcuuuggcuucaagauuauguuaacuuuguaaaaugaauuuagaacaaauuccuaaauuucuuuagaugcuucagaaaaacugauuuguaaaggaguuauuuguuucuuggagcucaccuuucaaagucaucuaaacuuagagcuauuuuuauuuucauuacaguaauccuuugauaaccuuuuaaaauucuuccaugaauauugacauguguucaguuuuucuaugcuuuacuugaauuaauuugauuuauaucuucccagaagaauaaauuucccuuggauuuucaaauuuauuggcauaguguuauauguauaugcacuuaaaucuuuauuaauuauaaacuuuucauuuuuuucuucuuuaaaaaugccagugaugugucucugguuucuccuccuuacuucugucuucuuuucauccuugacaucaagugcugggauuuuauauacauuucacugcuuuucucuuuuuuuuuuuuugagacagagucuugcucugucacccaggcuggagugcaguggugcgaucucagcucacugcaagcucugccugccggguucacgccauucuccugucucagccuccugaguagcugggacuacaggcguccaccaccacgcccggcuaauuuuuuguauuuuuaguagagacgggguuucaccauguuagccagaauggucucgaucuccugaccucgugauccgcccgccucggccucccugcuuuucucuuuaaugcauucaugucugccuguugccucugcuuuccucugcacucccccugccccaugagaguugaauguugaauguuuacuuuaugucuacuuaauugguuucugagugcagcuuuggcugagucucauaauacgaaauauagugugauaauuuugguuauuuuuaaaccuacuuguaaaugaccgcuauuauuauuucucaccacucuggaauucuguuuuugguuucuuuuuugguacguugcuuauuuaggaaagaguuucaaaaucguaagaaacugauuuuuuuuucuuuuuaucuuuuuaaacuuaggucauuggagauuuuuuucuccugacuuuauugcuguggagucagacauuacaacuuuauaauuuuacuauuuugcauauauggaggguuuuacuuugggcaugagauguagcuaccuuuaauugagauuuucguuccaggugcuaugcuaagcaauuuacacacauuacucauuuaauucucacagcaacccuaugaggcauagguacuguuguuauuguuacuaagauuugauaguuagagaaacagaacuugccccauuaaccaggcuguggugaggucuaaacaacagccugcccccagaggcugcaaucuuuacuucucauuucuaugaauauuugauggguauuuuuuaaaagcuaguaacaucuauacucauuuccaaauucaaauauacauguucaaccaaccugaucgauuacauucaaaaccuuuguuauugauaaaagcauuugaaacucaacauuacagugcuaggaguuucugcuuauuucuaagcaugaggggcuuagaagauauauauucauggauuauacccuuauugacauaaaauuaccccacuuuauuuguuuuucuuuucuuuuuuuuuuuuuuuaauagagaugggcucucacuguguugcccaggcuguccuugaacaaguuuuccuuuuuugccauacauuuugcuuugcauaaauguuaaucuccuacuuuauuucacuuacucuugauacauuuuuguaucuuacugauuuuuuuucuuuuuuggaugccauuuugucuuagguuuaucuuuuguaacacauauauuuugauuuuuaagccaaccugauggucuaaaguuuaauagacucuuagccauuuuuuuuuuaauuuuauucauuuacuuuuuuugagauggagucuuacucugucacccaggcuggaguacaguggugugaucucggcuuacugcagccuccgccucccagguucaagcgauucucuccugccucagccucccgaguagcugggacuacaggcacccgccaucacaccggguaaauuuuuguauuuuuaguagagacaggguuucgccauauuggccaggcuggucuugaacuccugaccucaggugauccuccugccucggccucccaaagugcugggauuguaggcgugagccacugugccuagccgaaaaguucgucuuuuuaaccacaggccaaaacagagcaauucaguguaucugaaaagagugguguccuaaaaugucacccuccacagaacuuaagcuuuucuccuguccacuugggacaaucagaacugcucaggggucccacagacuccauuaucuggcccagcuuuuguggggagaacugcaagaguaggguaggaaagaaaaccaacugccugaauaaccucuaagaagggugcucuaaaggauucaccacuuugagacaggcagagcagauaaaaaugaaagcacaucucuucauggaacaauggaaguaaaaacuaaacccucagcuuggaaaccagaacucacguauccaagaggacgauggugggcaccaggaggcagagggaguuacuggaguuacucuagcaggaccaagggugccacuugucccaggggaguagcaagagggaagaaauggaaugugcaguguucacauugucugaugagcagugugagcuuccauccagaaaaggcagcuuguccccuggcaucgggaggaaugaaaguuuaaaggacaauaauaauuuagucucucugaaaugacucuagccuuaaauggugagugggaccuggcagcugaagugcagcccucggagggcaugacgagagaguucagacggcuucauccagggcuguuauuuucucaacuuucaauagcucuugacucuugaaaaguuuucagcuaaaauguagugucuguaaaacuggaggcacuaaagggcaaauggugcucuuugaaugaaaaaacauuuuuauuccaucaaacaguggcuugcugaaagcuucaaggggaaaccuaauguuuuuccccuucuguuggagaauacucacguauucugggcagcauuuucuguggccggugccgaagcguggaguguuuggugagcgaagaguguguuuuuggauucuccgcuuggccugagugugugugcauguuuuuugccucuggaacccuuggcuuuucaaugagauuagaggacuucaaagggaguacaguaaauacgauaggcuugaguuuccugugucacagggaggauaaacauuuuguuuuagaacaugcuuccgacuccuauacguugcagaaugcagaagccugcgguauucaagaaagcuauuuuagacgaauaauuucgaagugagacaaaccuaaaguuauuaauugagcuaauucaaaucuccuguugaccagauuuuuaagaagcuugauuucacagagguccugcagagguuuuuuaaugucuuaggauuugguucuguuuaguuuugaaagaccucuauagaaauaaacucuguagcuauuaggacuaaucagaaauuaguggauuugguggaauauuaugccauuaugacuguuuggaggauuauuaaggguauguuuuaauuaaaugaacauuauacaacagcuaaugaacuuuuuuccauuuuccuuuuuuuggcuuccauuuccaguuuacauucuauccaguagccugccuagacuuucuguagacaccauagcaacacaucuugaaaaugugaagcugaacaucuuguuugggaugggcccuaguggaagugcccugagguugagagaugcauccgcagcccaguuugggguuggacugaggagggccuguuucccguggccccuucugccuugugguggauccagucuccagcuugggcuagaucuuuucagccuggucauguugggccuuauucccaguggcuuaggcuugacucucucuguguuaggcuucauagucaugguagacuuugaggaacacagcgugggcugggccacuucauguauggugaccacagggggucagauugugguagagaggaggaaugggaaaucaaaaucuggaggaggcagaguuuuuuuguuuuuuuuuuuuuaaccucugugcuauaugguccauaccagaguuccaggucuaaauucaaguuauccagaugagucuaauuauggcuccacauuagagaacuguuucacuaauaacaccucucacuuuucuguguguuucuuaaaaugaagucuaagagcaaccuguauaagccuugccuucaggggccuuuucgaauucagauucccagguaucacccagaccuacuuauucagaaugggaugggagaagcagucagggccuaggcauguucauuuucauaagcuccaugaaugagucuuaugcucacuaaacugucagagcuuugugauaaucagaagucuguggccuuaaagcaacugcccuuaccgcagaagcaaaucagaguccugaaugaggagcaugcgcccagccugcgguuggcucuagccuggcuggagccccaccuucacagcagaggcauauauggacauucuguguccauucuguguccaugggcagcugcaucaggcugccaggauggucagugaaacaacagaccuuccugcccuuuucuuucccuugaaaugggaauggcguaagcauuuucuguggaugagggcaaggaaacagaaggcauucaccgccucuauugcaucaccagcuguguccagagccuugauuccagcauccugaggugcuaacacccucccccugccaccgaauaucuguauaugaauggagaaaugggcuagcaagcaacagacuguauuuuaauauguuccuuugauuuuucaaacuucuggcccugcuggcuaauuuaacgcccccacaggcucucucggcucaucucaccuggcugaugggugcacauggagacucgcagacuuucaggugcuguguuggcuggagaaggaaagguccacguggcugcagggcucccugggcugcuccaucuuuccgaacacaugcggaggcaggugccuugaccuggcucagaggcaggggccucgccacucucucccaaaguuaggggagccagucaucgcacccgcggacauuucucccccuccccauuucacucacccaucucaugguugagaaaacugccuguguuucuccagcuguagaauuugcuuggauuuuuaaccauuuuuccuuauguaggguagcugaaaucaaucacucugugacugaagaagguggaaaaaacugcaggguguaaaccuaaagaaagcagaaggaaggaaauaaggaagguaaaagaagaaauuaaugaacuaaaaauccaguggagaguauauauaaagcuucaucuuuaaaaaauauaaaucucuaaaaaugcugauuaacaaaaauagagaagaaacauuaauauuagguguaaaaaagcagauauaacuaagaucauaagaaaauuaaaaguauacuuuuauguaaauaaauuugaaacuuacaugaaauugauaauuuucuagggauauuuaaguuaccaaagucucuuaagaaauaaaaaaaugaauaagugcaaaccaucaaaagaaauuuucagcaauaaaaaauuugccuucccaaaauuucacaaagcucaaauggguuugcguaaaacccagacuguuucagagaauagaaaaggaggaaagcuacccuauuuccuucaguaguaucuagcuaugaaaccagaaaaagaaaguauaagaacagcaaauuguucaauuuaugguuauagacucagaaaauccuaaaccaaauacuagcaaaucuaauacagcuauauauauauaugcuauauaauacagcuauauauauauaugcuauauaauauagcuauauaugcuauauaauacagcuauauaugcuauauaauacagcuauauauauauaugcuauauaauacagccauauauauauauauacaagaagaguuuguuuuaggaauguaaaaaugauugaauaucagaaaauaauguaauauaucuucucagugaauuaaaggagaauagcuguaggucauauuaauggaugcaggagggaaagcagugaaauucagcacuugugagggaguuuccuucaccugaugaaaggcaucuguaaaacaucuauggcaaacacaaagcuuaaugauaaaaaucugcuuguguucaauuuaaagauaggaucaaggcaagguuguuuuuuaccacuuuuaaaaauuguauauuguguugcaggccauaaucacugccaucuuaagaauugcaagauguguaacgaauggaaagacagggacagaauguagauguauugauuuguggaaaaucuaagagaaccugcaaacugacuaucagaacaaauaagagagcacagugagguguugaauacagaguccacauacaaaaaccgguaucaguaacggccaauucaaaaauguaauaggaaaagagacuccuuucacuguagcaagcagaacugucagauauggaggaauaaaugcaaccaaagaugugcaagacuuucauggagaaaauuguaaaacauaacugaaggauauuuuaaaauauccaguauuguagaaauauuaauuuccuucaaauuaacucauaaauucagugcagugucaugcaggguuuuuucauggaacuugaagagcugauucuuaaauucaucaggaaaagcaaauggucacaaauauccacuggcaucuugaagaucuucgccuaguaggggccaugaagaguuacugcugagccacauucauuaaggcagcaugguacaggugcgggguuacacacauagaugaccagaacagaaacggauguagacauaaauaaguguuuggcgugacagcaguggcguuacucaucagugaugaaauaaugaacuauuaaaucaugcuggggacaauggauuaucuacacagaaaaaaaaagagauuauggaucuccuucaucuauauaugaaggauagcauggaacuugucuacauccauuucuguucuggucaucuguguguguaacccugcacccauaccacgcugcuuuaaucacugugacucugcaguaacgcuucauggcuccucgggcauguugcccuacuauguguuguucuucaagacuccaguggauauuugugaccauuugauuuuccugaugaauuuaagaauaagcucuucaaguuccaugaaaaaacccugcgugacacuucacugaauuuauggauuaguuugaagaaaacuaauauuucuauaauacugggcacuuuuuaauguccuucacuuauguuuuguaauuuucuccaugauauacauggauauacauaauccuucaauauuuaugaaggauauauaaccuguuauaaccuguuaaaagcauuuguaaaaguuuaaacauuugaaauaaaauucacaauauauuaaugaccuucgguuaagaaagcuuuuccugaacauuguuaccccagggucacaguuugaaaacucaaaauuaaaacguagguuugacaaaaagcaucauaaacaaaauuaaagcaucugccacagagauuuuugcaaugcuucuggcugacaaaggauaauguccagagcauauaaauuccuacagccaaauaguagguaaaaccuaaucaaaaaauggacaaagaacaugaauaaacaguuaacagcagaaaccauccagucagcuccuaagcauauaagaugauauguggccucucuaguaaucagguacaugaaaguuaaaaugaugacuacuucauaccaaucugguuggcaaaauuuuaaaacauggugauaccuagggauggugagaauacagagcaggaugaucucaugcagguccgggcaggagugacacuagguccagccacuugagauuaaguuggcuaugucaggucaaguugaagagguucauaauguaugaccaguaguccuacuuguggguaaauaaugcagagaaacuuucucugcuguguaaaaagacaguguccacugcagcguuguuucuaauggagagaauugauaaucagcagaaaagggaugacgugugguguguuccucccuacaauggaaagcaguguagcagugagggugaaugaaacagagcugugugugucagaacagaugcaccucccaaaaagugaaaacaccaagucacagcacagugccaucccugcaaacuucgaauaggugcagaaaaaugcuugguauaauuuaugaauacauacauggguaguuuauuuaaaauacacauaguaacaaugaagcaccaaauucaagauagugauugccccuggggaagaugaggauugagguaagggcuguaauuauucccugucauccugucaugugucauuuuauuuaaaauuuuuuuaaucaaaggccaguauugcaagauauuaagacuuggcaagcagagugguacauggaugcuucuauaauaucucuaaacuuuaugcgugaaauauuucacucacauaaacacacagugaugucaguugcugccaagaggccacaggaggcucauugccuugguaaauuuguugcagucuaagacuugccccucagcuuugcaaacccagaaacuuuuuuuuuuucuuaguuuuuugccugcagaugaaaacuagguuuguaucucaggggcagacucaaacucaauuuacaaaucgaauguauccagacugccaguaugauaauuuguaaauacauagcacaguaaucaggaccuuggaaauaccacgaccuugcaugauccucguguuguuuguccuggaguuuuuccacgggaaccugagccacagcccaaaugccugcucauagacacgcaguuagacguagcugcuguggagaccagcauuucggagccccauugccagcagauuugcuccuacacaggacuccaguccuaaucagaacacacaacucccuuagagggacuccacuggaagugccugccuccuucagggaggaacugagcaugccccuuagcacuggauacccagaaagugccuguggaggcuuggcauuguuuauaacuuuccuuuuuuauuuuugacaguaucuauuccccaucucuuccgugauagaauccugucuuuguguaggcauaaacuaaugcuuacuuaauaaucaguuaaguuguguaguauuuuccuuacaaaauccgaauuacaagggcaguucagggagauggugcauauucaucuaggaguuuuuccuucccaugacccucuguuuggucuucguggcuaucucauaagaaguguggucuuacuguuggccacauccccucucugggccuuguagagguucuugaacucuccuucuuaaagagaguuuauuuaaauauguuuccucaucuucucccaccuuugcaucuccugagcccuucuugcaggccugggaacccuugucccuuuaacugacaguguauucucuacuuggagccgcugcugcauguggacuuggaagaugucucagagccugucucaucggcugccucuccaaguugcuagagaaagcuccacucugaccucccagucaccauugacacacagcugccaaaugcaaauuauaagccugcauucauuaaagugaccuugacaguuuucagaguccuuuuucacacguuuuuauuugguguucccaauaaucaggcaagaucgucagggccauuuucacagaugaggagugauguuaguugucacacauuacacaguaaccaagguuaccaagggcccuuugcaaaaacacuaggucaccuggggugaggguggggcauggccugcccaggguagagaaggaaaccuauuucuuuguuccucccaacaccgugaaacagccuucuguguuauuggacagaagcuggagcuucccaguccaaagagcuugcguuugguuauuucaucaaugucuugaucaagcccagguauaacgucugcccuaaagacagagucauucuucuacccugagagacucucuauacaauguggugguuuagauucaccaguuuuuuccauuuccagcuaaccaagaguucagguacugaaagccaucuaaucucagagaaauuuaaagcuaaauaaaggauucuuaaaacagaucuuuacauguccaguuuuuaaagccuccauuuuaccgaacaggaaguuugcagaaugaucacauuagcaccagagccuuggacacucaagugaacuugagcccacaaagucagcccgaaaccccgcccacucuucucagagucacugcuucuagccugcgucgucugguagaacaaaccuuacugcacacuguuccugccgcugacuucaaauaaacugcaguuucuacucgauucccaaagaaagcucaaguaugaaagugccccuggcagccagcuccccuguugaguuacuauauuggguguucuuucacuaguucuggaguagugaagacugguuggcagggauauggcucuuuaaauacaaaauuuauucuuuuucuuuuuaaagacauguuucaagccgaccccaccuucuuggcucaaugugaggacuuauuaucuaaauucauguacauacacacacucacucuaacucugggauguaaaauauuucuuaguuuuuacuuuuuaucucucuuugccuuaaaaaaugggaucccucuuaaguuuccugaaugccaguucucagcaaaaauggaugccuuaugaauauguagaugaauuuuaauaaaaugauacgaaugcagcagcucugcguguucugaaaaacguuuccagagccccgugagacuuucaaaugcuccugggagaugaggcuuccugcagagaaaaggaaaccgagagaauaggacaugauuggaucgguuccguuuacuaugauguagcaugaaaaaaugcugccuuaugucucuuuuuaaauucuccuauagcugcauaagcucauguucaguaagucauucaaccuaggucugcucgucucagcaauucccgcuguguuaagugggaccuaauugcagaggauagcugccuccuaacgcggaguccuuauuucauuagcauuacagauuggguucuugggaaggacauucuuugguaauuuguuuacagaugaagucuugcagauucucacuuccuuaaucuaacaaucugcuaauucuuaaaauuggaaaaaagaaagaaaaaccagccugucagucuacuugucaggaaagacuuagaugucaggagcucuaaugaggugcgauauuaauuccugccugcuuuuuucccccagacaaccgugaacaguuuccccccaaaaacuaguauauuaugcaauuucucaugauuaauuaaaacaauaacuauaauaaaagaagcccauuuugugauucugaccuaauugcuuuuuaauugcacugcuuuucauguuuauuuucaaaauucacuucucugaaguagucacgagggaaaacgagugucuguugagcacuuucucugaaggugcggccauugcugugaaauugcuggucauuguuuggcagcugcuagaccauccacuuuaguucuuaacuccuuaaauguuuuuagcgauggcugaguuccaaauauauauauuuuuaaucuaucuccuucguccacugauuucccaucugagauauuaucucuaauuuugggggcagauaauucauggcucuggcaaacaauauuaagagcuacagugggcuuauauuagggccaggcacaguggcucacgccuguaaucccaacacuuugggaggccaaggcaggcagaucacgaggucaggaguucgagaccagccuggccaacauggugaaaccacgucucuacuaaaaauacaaaaauuagccaggcauggugaugggcaccuguagucccagcuacucgggaggcugaggcaggagaaucgcuugaacccgggaggcggagguugcaaugauccgagauugugccucugcacuccagccugggugacaagagcaagacuccgucucaaaagaaaaaaaaaccuacagaauaauuuuuuuuuaauguauugguccccuggaaggcauaagagugaagggaauguuucccuccccaucugaagguuugaaucuuuaugucagcugaaauaaacugacaauagauuaauaaauuuguuauuaaugugcaaaugugcacaggagccacacaaaauaugagacucaaagaagggccagaugguugaagcuuaaauacucucugcauaggggagaggcaagugagggauguaggcaauuuuagaagaguaaaugauguuuaggggagaugauuaggauggaaaugcagacaauagccgggaacaaauuuccuccacagggucucggggagguggcaacaaguuaugggaaggcgaggggcagaacucuauugugaacagagguuauuuuaucaugcagauaaaucucucaggugacagccuuuagaagaauaauugaaagaauacgugaaaaggcucuccaagaguggggucuuggugugggcuuuuaguuucuucugcuauaugaguuaaucucugguuaauguagauuccagagaggggguccaagacaauugcacaucuucuggaugaacuucccucagucagauaagagaacuugagacaaagucccucccugugcuucugaagggaaguuggaggggguggggaggagaaggucagagagagaccuugguucugaggcuuauuucugaggucugugaaucuccuucuuucaaagcacucagcaugccaaagcaauauaauuugggguaucauuuucggagccccagcaaagauuuucugcugcuucaauuccggugccaguguguuuaacugcuagaguugcaggaacauugugcagauaauaaaugccagcauggaggaaaccuuggcaugggacagacaaacaggccccucuugccgccucacaggcaagacuguucauccucaagaccacggggcaucaacaucaccauuuaagaaccauuuuucugaaaccaaagccucuuuuccaagcugguaucaguaguauuaccaauuuaguaacucugaauggagucaaaccagaaauuaaguguuucuagaaguccucgugggcugucaguccugcccagguguguuguucucucaggauucucugggaacauugcucuguacuaggaugcucuuaggucuguagacccugcuuugaaggguuccuccugauggguucugcugagcccgguaaaccuuuacugcuuauuucuaguauaugauacuuuagcaucuuccaccuauagcuaucagcuauuuuuuaaaacagcuauucugacugagcacaguggcucaugccgguaauccuagcacuucagaaagcugaggugggaggauugcuugaagccaggauuucgagaccagccugagcaacagagugagacccccaucucuacaaaaaauaaaaaaaaauagcuggaugugguggcacaccuguaaucccagcuacuugggaggcugagguaggagcaucacuugagcccaggaguucaaggcugcagggagcuaugaacaugccacugcacucuaggaugggugacagaguuggacccugucucaaaaaaaaaaaaaaaaaaaaaaaagcuacuuacuguucuucuagucuugugucugucuguagagcccaaauuugagaggugccauguugaaaucugcaccugcuuuguaggucuggccucugaaucagcuucugugcagaggugaucccaggguucuucccuacugcuggaagaggagagcucaggcaggcucagggucccauugacuguacccucacuccaucuccccaucuucaucucaccacugcccuuugggguauuuggggauggccuuccagggcaagggacaugcaucccugcugucccaggaagggaaaaccuccagugggucugcuguucguggugagaaccaaguuccaaauaucaccggaguaccacaugcuuguuguaggcaauguagaaaacaagaaaagagcaguggcgcacaguugguucugcccuucggaaauuacgacugcaaauugugaaaagcgcaucucuagagguguaucugcuugagaguagaaaugggauuucacuguuuuaaaacacuuuuuuuuaacguguuagaaagauguucucaauauguuacuuuuugccgaaaucguucaucucucagaacguaacuccgguuguguuuuucuguuuccuuaugucccguuggcaguucaucucagaacaggccaggaacuucugcagauaacaaguuaaucauagcauguccaucccaguuggucagucugccuguucucugaagggcuaaacaagcuguggcugcucugggggucauuguucagaggaccaucuuucucuuccugcaggugucagcggaagcaguggcggguggaucugccggccaccagcguggugaucacguuucacaaugaagccaggucggcccuacucaggaccguggucaggugaggccaggagaugcauuaccugucagggguguuaagacauuagcugugucccaggcacagucagaccagggcugucagugggggcugcagacagggucuccugacugcucagcacagggugcaguguguagcuccuccaaccaaggguuaggaccaacauaugagaauuuucuaccccaggcuaaaaguuuauaccccuaaaagaccuauaaacuuuaucuucuugucuuuucuuagcgugcuuaagaaaagcccgccccaucucauaaaagaaaucaucuugguggaugacuacagcaaugaucgugaguacugacacugauuuuaucccugugucuggcucuucucugggcaccagucuuccuguagugggggugcuaaugaggcgugaacaagccagaaaucagauccacagaaagaagaggugccucugugaugccccaaggagauaaucggcccuuagaugauugagaauacuaugguugaaugcaaagcccuuuaugaacuccagguucaaaaugcucugcuucuuuucuuuuccuagcugaggacggggcucucuuggggaaaauugagaaagugcgaguucuuagaaaugaucgacgagaagguaagauucuucuuaauucagcgccaagacaguugaauucugacuuuuccuguaauaacauaaagaagugcuuuagcucaaagagcaauuaauugucuagcuuuuuucugucucccucuaccagagccgcuugggagacuucucccagcaaacacaggaaagacauuaaaagcuugacuaauugaaauuauuaguauauuagagcaggaucaaauuacauuuucauuuauguauuuagaaaauuggcuucuuucuuucacaaccuaggaagucuuaucagucccuugaauacaaaaguuuagaagaaaaacaaagauuuagcaauaagaaguugaaugacuccaugcuccaggcaucugauaaaauaaccgggauucaaguuugacagccugcugaaggugaaccauccaaaauggggagacaguacugcaauuauaugcucaugcgauuuugcaaaugccaaccucggaaccuucugucagucuuaucugugcuggagcugagcucaugaggacucuuuuauuggcaguuagaagagaggcuguaaaggaggaaaguaguacacuggagugucugggaaggaagcuccaaucacaauguaauuaacauccagugugucagugcuguuagagacccugaagacugaauuguuaggcuccuccaugguugggagaaaucuuucaguauaggaaaaucacagagcuuuggaacccaugccacauuugcuauuuaagucugacuguugauccagggguggugauuguauuccuucaucaguguaaaacucuuucuucucauuacauaugcacuccagcuggagucaaggagugaaguuuuucuuaccaggaaucuuauuggccaacacagugauugagccuguuagaacagcaucauauuuuaaccaacuagggucaucaaccuagacauucaagauacauaaacagugggauaagccuugccuucuaaacaagcuguuugccagacucacaucaguccaccaagccuggaauaaaccaaaaagggggcaauuugcugcccccuaaacaccuucaaaauaacuuuaugaauuuaaacccaaaguaucugccauccuaccccaucaccuggcacaggcuuuaaaaaaaaaaaaaaagagaaguggggaaggaggaaagagagauaguguuggcacuguaaaucacuuaugagccuuaucuaacagugucuuugucuuuaaacugcuuagaaaucagaacaaugcuucucaguauuaacuuuccgcuagaauguucauuucgguugaacccgugcugauacguuguuucggggaaggcaugagaaggguggguugggagaagccagauuauggaaagccuauauggaacagcugaagucuguaacaauugaaugagaaaauaugugcacacuugcacacacacucauguauauauguacccauguguguguauaagaucccaucuauguaagcauacacacaaagugcuuguagugaugcuacuagaugacaaaguaaauuaauugccuaaaauauuaugguagugaaagcagucuuaggaucauucuucuguggauuuuauugugcauugauucuuaaccuagcaauuuauuagaagcaccuagggaauuuaggaccaugucuugcccucauucacaauuaaauagaaauuucuggauuucucuggguggggugugggcagcugcauuuuuaaaagcugcuaaaaugaugccgauguacaguggaaguugagagccuaguacuuucauuuuacagauggaaauacuaaaucuaaagaggcuagguggcuuucucaaggcccuuacagcuauuuaaugacaauaguaggaccaaaaccauguuaauaaugagauaaaucuuuuucucugcauuuguggagauagucaagugguauuucuuuuuuuaaucuguuaauauggugaaauacauugguugauuuucagauguuaaaccagcuuugcauuccuagcauaagccccaguuggucaugauacaguauccuuuuaauauauuuuuguuaaggauuuuuauaccuguguucaugggaaacauuggucuguaauuuucuuaaaauguauuuuuccaguuuuggcauuaugguuuacuagccuuauaaaacaagauggaaagugugcccuucuauuuuauuuucuaaaagaguuuguauaauauuuuaauuauuucuuuuuuaaauguuuaauagaauuagccagucuggaccaagaauuuucuuuauggaaagauuuuugauaacuaauucaaucucuuuaauggauauaggcguauucagaucugcuguuucuuuuugugucuguuucaagaaauuuuguauuuuaucaacguuuuuauauuuauuggcucaaaguugcuuaugauauugucucuuuuuuuacuguuugucggauuaguauuacuauuuuauugauuuugguaauuuauaucuucuuauuuucuuuaucugucugcuguucaucgacgcuguucauuuuuuaaaagaaccaauauuuggcuuuuguauuaggauucuccaaaaggacagaacuaauaggauagauguauauauaaacaggaguuuauuaaggaauauugacucacacaaucacaaggugaagccccacaauaggccaucugcagccgaggagcagggaagccaguccaagucccaaaaccucaaaaguggggaagcugacaguucagccuucagucagugguugaauguccaauagucccaaagcugaagaacuuggaguccaauguucaagggcaggaagcauccagcguggaagaaagauguaggccgggggagaccaagccaguccagucucucuacauccuucugucugcuuuuauucuggccgugcuggcagcugauuagauugugcccacccagauugaggguaguucauuuacauguggcguaaucauuggugugacuagguuugggucugcucuucggcuguuucuucucuauuuguaccaugugcauuuugcuuuuuguaacuguguuccugcuuucuugccuucuuuuggauucagugauuuuuuuaguauuccauuugaauuauucuuguagcuuuucagcaauacuuuucauguaugcacaguugcccugagaauuacaacauacagcucuaacuuacaacagucugcuuaagagucaacaucauaccacuuuaaauuuaagaauuuuacaauaguuaaauugcauuuccauuucccuuccuauguacuaucguuaucaugcuuuucuucuacauacaucuuaaaccccacaauacacuguuacauuuuuacuucaaauagucaguaucuauuaaauaaagagaagaauauguggauauguuaagcuuauccucauauuuuccauuuguaguaucuuuguuucuuuccauagauuggaguuuuuauuuagcccgaauaauuuucuuuagaauuuuuucucauaggcagcacaaucucagguuuuaucugaagaauuuuuuucuccuuuguuauuggaggcuauuuucuuucaguggaaucugaguugacaauuaauuuuucuuucagcacuuuaaagguuucacuccaggcagggcacaguggcucacgccuguaaucccagcacuuugggaggccgaggugggcggaucacgaggucaggaguuugagaccagccuggccaacauggugaaaccccgucuuuacuaaaaauacgaaaauuagccgggcaugguggcaugcgccuguagucccagcuacucgggagacugaggcagaagacucgcuugaacaugggaggcggagguugcagugagccaauauugugccacugcacuccagcuugagugacagggugagacucugucucagaaaauucauacuguuguuccuuuguauguuaugggucauuuccucuggcugcuuuuugucucuauaucuguuuuuuuuuuuuaacaauuugauuaugaugugccuagauuuaguuuucuuuauauuuauccugcuucaaguuugcugauguaaauugaauauguaagaugauguuuuccaccaaguuugggaaaugacuggccuuuuauuucuucauguauuuuuuucugacucauucuugaacuucaguugcacauauguuauaccacuuguuauuguccuauagaugacuagacuuuucccccuuaauuuuuucucuguccaccagauggaucuauuucuguuguuccaucuucaaguucacuagucauucugccaucuccauuuugcuacuaagaccagucaguggauuuuucauuucagauaauuucauuuuuaaguucuggaauacccauuugauucuuuuuuauaguuuuuauuucucugcucagauuccccacccauucacucauuaaaauuguugccuuugaguuauuaaacauauuuauaauagcugcuuuuaaauccuccccugcuaauuccaaccucugggucaucucagggugaacuucugaugacuuuuuuucucuuugauguggucuccauuuuccuguuucuucucauguguagugguuuuuuauuuuauaauugacauuguggaugauauguuguagaaacacuggauuauguuaucuuucucuaaagaguauucaucuuuguuauauugggcaguuaaauuaccagaugaugaugcugaacuucuguaggcucuuuuuguacuuugcuaggaugaguaugguuuuuuuuuuucguuuguuuguuuguuuguuugugacagcguuucucucuuguugcucaggcuggagugcaguggugugaucucagcccacugcaaccucugccuccuggguucaagcaauucuccuaccucagccugccgaguagcugggauuacaggcgcacgccaccacgccuggcuaauuuuuuguauuuuuaauagaaacggguuucaccauguuagcuaggcuggucuugaacuccugaccucaggugaucugcccaccucagccucccaaagugcugggauuacaggcgugagccaccacgcccggccaugaguuuguuuuuaugagucccuuauucuugauacauagucuauauuccuauguguggucuuucugaaguuccuguagaagaacugagaucuuuaccaagcaugucacacuuggcagaacucaaauuccaaacuuuguuuucucugcaguagauagcagcugaaacucaguuuuuucugccuucuuaacuguugcuuuucauguuggacuugguuccugugugguucagaagucagccaaagauuuaacaggagguuauugccagauuuggguccuaccuccuuuccaggaucuccuucaguuuccagauaccagaagcucugaacucucuauccucuaacaacucaagccaaaaaaggcuacauugcaguggauuggagcgcauccucguggaaaacgccguauaaacacggagcuuacucaguguuauuuucuuauuuuaagggguuggauccuaucuaguuucugucugcuucuggcuuucaaauugcugcuuuuuauauuuugcucagaguuuauaauuguuacuggagcaaagguuugccccauacaaguuguuuugcaauuaucacaacuuaaaaucuuuagucuuuuucccuguucuagcauacagccacauaggaaucacugaaaacccauuuugacuguggaaaaaaguacuuagcagacuuguccucaccgguuaugaauaguugcaucaucuucacauagaaagcccagcauauauagcaaaagccauuuaugaccacaacauccagggauaaauauacuauuauuuauuuuauuuuauuuuuuauuuauuuugagacagggacucacucuuaucacccaggcuggagugcaguggcgcaaucauggcucacuucccaggcuccagugauccucccaccucagccucccgagcagcuagaaccacaggcgcacgcacaggccaccacccacggcugauuuuugaaauacacuauuuguauuuugugucauaaugaacgugcacauuauuaacacaucacaaguauauaaauuguagaauuugaccaauaguauaacuaauuuuguguaaaaggcagacagcagggcuuugcaacuuauguuauuuagcuccugauaagucuuagaagacagagauagucacaacacuguugcaaauauuaucaccacuaaaaucaacaccauuagcacuggaagucucugggugacaccuuccuuagcccaguuaguuagaaaacugcugcugugucagaggaauguaguuauaaaaguuccacauuuugguuaguugauaaaggagacuucaguaauguaaagggccuuucucagaagacgguaguucuaagaacguuguccucccagucauccaauauaacuauuaaaauuaaaaguucugacaauagucugucucauggagcaguuuugaucucauccagcaaguuuacaguaauguccgugcccagaaagcaggcugcagagcugcgggcagggaggcgucgccgguuggcaugggguugugcuggcccuguggcuucucucuccugacgugcuuuccaacucgccucugcaggccucaugcgcucacggguucggggggccgaugcugcccaagccaagguccugaccuuccuggacagucacugcgaguguaaugagcacuggcuggagccccuccuggaaaggguggcggaggugagaugacgggggcugggaggggugucaggucgugggugguugguagaggggacagaagggagcaugguccaggggagguguaacgcagggaguagggcgucagggcugguaggggcugagcucgccgucugcaguuuuccuugauagaaggaaaaugccuuuggggcauuguagaaagacuguuuuacuggcuguaggaauccaucaguaggaggaaccauccguugacagguaggaggcgaggaucagcagaggcuggugagagccugauuaguugaaggcagcccuuuucaugggagcaguuuccuuccccgccuacagcuucgcagagugcuuagaacauugcccggcaccuagcaagugccaucucuugcagcucgcagagcggggcgugcuggggaagcugucccuggggccaccucucugcucuuagugaguagggcagguuagcccagcaggcuuccaggcuccugugggagaggguuguggcuaggaagcauacagggaccggugggguugucagagggugauccgcggcuccacuucugcaccuucugcuuucuagaaacaucauugcuaauauuacauuuggccuuuuuucacuucucucgccuucugcuuguuuuauugacuuuucuuuccuuccuacuaagaaagcacuuccuugggggcgauaaagcaaacuuaaugaaaggaaauagaaaaugaacaaguaguucugccuaagcauagcaaggauagcugaugggcugugagucauggaauacuaaguaaccacaagcuacuaggaauuaugaagaucauauucauuacccuuuaucaaguuggggcuaggccuuuuuuauauguuaccuguaaugcacuuguuaucuccguuugacagguaaacaggcugggguucagggaacuuuaauaaugcacgcaaaaucauacagguagcagagccaggcuugcaaagccaguuucauuaaaucccuaucugagccccucucuuaacacaugugcauacagcuauauccaagaagaacccacccuggaauccccacccaccccaaccccacaacuucuugcucucccuggcuacgcuccgccaggcugucucucagggaagcgcagucaaaaccaaaacugccauggcaguguuugggugugcgaaggucaccgagcucaguggucagauugucagaacugcuucgaacgccugcuccuaaauuaaggagagaaagugccaagccuauuaacuuucacuaaauugagccuuaugaaacaaaauguaaaguagauuauauccuuuaacucauacaccuagaaccagacugagccaggcaaggaaaguuguguucuucucugcccucaaugcaccacacagccuacuuuucccuguagauuugcaccuggguguuacagagcuuugcaguguuugcguguuccuaauuagcauguuccuucaccuguuccucugauguaguauguucuuagcucugcugguucuguuacuaaguuguauuucuaaaucuuucuucuggcuaauaaggguucucuaaguggcucagggaaaacacuugcucuuugguuaacugucagcauggggcacaguccagggucucucaccagcauccgucauuugagcuuaaagagguuagagauguuaaaaggccuuauguucacaaacucuuaccagaaugauggcaauguggcauaaagacauggcucaaucuagggggauuuuuuuuuuuuaauagaaucacaggggcuggacgcaguggcucacgccuguaaucccagcacuuugggaggccgaggcaggcagaucaccugaggucagaaguucaagaauagccugaccaacauggagaaaucccaucucuacuaaaaauacaaaaauuagcugggcgugguggugcauaucuguaaucccagcugcuugggaggcugaggcaguagaaucacuugaacccgcgaggcggcgguuguggugagccaagaucacgccauugcacuccagccugggcaacaagagugaaacuccgucucaaaaaaaaaacaaaacaaaaaaacaaaaaagauagaauuacagaugaggcaaacguagaaucuggaaaucucugguugauuugguuaaccuucugcugugauaauauugauacuuaccacaucucucucacacacacacacucccacauagaaauauauuccuaauuuugauguaugagcauuuuagcagugacuccauuccugaaguuuacugcagcucacaaaucacuaaugguauuugggcaaacagaaaaggacccuugggacacagcaacacaguuuuugccuuuagcugggugaacugauggcuaccugucccauaaccaugggugucuccacuccuagagugacuccugcuacgcacccacuccugaccucccucccugccucccagcaggccacagcacaucuguggauggccaagagcaagaccuucugggucuggguggggaggcuggguucuugagggccuaggguaguagguaguaagggccaguuggguuugcccugugccugccuaauacuaaugccuucugugguugggcagguuuuuuguuuugcugggauuuugauaacuacuccucucuuuguauuuuaggacaggacucggguugugucacccaucaucgaugucauuaauauggacaacuuucaguaugugggggcaucugcugacuugaagggcgguaggugucugucauggugccccugccuagcucgucccgucuacaccagcaucugaucaccacucccucucauugucaggagugacagugacaacaguguucacgccguaguguguguucugaguaaaaaccaccugugugcuuaacgaguaggacuucauaaagagaaaaaaaaauaggcuugcucccuuaaagagcuuccuggguuucccuuucuccucuuccuugaccuucugucacuuuugcgagccaugugguuccaugaacagauauggcguccuuuaugaccagagaugaugaagcccuccuugcaggaaucuggggugagaagcuucacggagcugaggcuuugugggauucaaggggcuggagccugucuuugccuucucugcucacccuggcuauuucucugacagccuggucucuuucugguugcucagauggagaccugugucauccucaacccccucgcccucaccaagcccacgugugacccuguucugcugauacagccccuugcauguaucaugguuucuuguaccccucuuucccagcccaacaccugugccuacaucacccugguccccuuccguuggaaugaccacaccaguuuccuguauguccucaccgcacccacccuggagccccaagagcacuuugucuguuuacccucuuaaaaauuaucaaagaccucaaagagcuuucaucugugugaagaugaacuauucuagauagacacugggcagaggguuaacugauggucuaacaucaaaaaagaagacaguaaaacuauaaaauagggccuugaccaggugcaguggcucacgcuuauaaucccagcacuuuggggaggcuaaggugggaggauugcuugagcccaggaguucaagaccagccugggcaacauaacaagacucuugucucuauuaaaaaaaaaaaaaaaaauuagcugcgugugauggcaugccagcuacucggggcuaaggugggaggaucacuugagccugggaggucaaggcugcagugagccacgaucaacccugggagacagagugagacccugcuuauucauacacacacacauaugugugcaagcaagccuuaaccccagaaaacagaauacuuggacuuuuuagggagacucagccacgguccuagacauugugggcuuuggccccaccugccucuugcaggccccgucaucaugggcaggccauuuugccucugcuucucagcuucccccucugggaaaugggaugauaauugugcuggccacacagggcauaauggaauuagacaucagcgggagggcgggcaugcuuggaggacuguaccuagggugggaaacauaacauucaggaacgauucccagcaaauggugagaaguaaaauguuuggggacauuaaagaggagggauccuuagauagcuagaaagccuggcuuucagaauguuguauuuccccaaguauucgaagagcugagaucuaccaggcucuauuucucccaaagcagcugcguaugucagagcaggggcaagaacagccagguguuccgugugggggugcaggucuucugggucagaggaacggggccacguucacccuaagagcauuuuaugaaauuccuuuagaaaaaaaaucaaggaugccauucuuaacagaucuuuaaucugcuauagccucucucuuuggaccaaauuaauaaaauaaauaauaagauaauaguaaacaucaaaaaaacaaaggaaagguuaugucagcuaauccuuaaccuucucuguuagugaaacagccaggacauuguuuuucugguuuuccuucguggccuuugaggcaccaugauaagagccagcucaggggcccgcaggggucuccucucugugcauuucuguccccacugccugggccccuguccauuucccucucucuuugccugaggccacucuauccugcagugagggagcugggaggccucuuuguccagagccauaaauucuuggccagcccaggacacucagaaacccucacccgccauccuucagucacuggggcugucagggcggacagacuaugaauucaaagcaugcagacaaauccaaacuuaggcauugcaaaagcccuguugacaaaaagccugauggcagagagcuuaagaggauugaaagaugcaugcccuagagucauuagguuuugcugucagacccuuggaauuggaaaugcagcaccaugagccauguguuugccaagaaguggccuccugaugcaccaggacagcuuccgcagguggagccugcuggccuccaagaggcacuaugugugugacccugggagcaagagcgagaccugaggcccugcagaugcccacaaccaaguccggguacagggucuaggcucuucuauccucaggggucuguggauuccaaaaaugaaaugcaacaggugccaaauauaucugaaauugaagcuuauuugcccagcuuggcaacuuccgcuggcucauuuucccuuaaaguuuucauauucccagcauguucccacuccauucuugcugcaaauacagucugaaguuugcuggcccagggaacugacaaagccucguucccuccccagcauugccuuccccuggggcaguguuggagguaccacggcuugauuuucauguuggaugcucuuuuuccucacauccuuacagcccuuggacaugcccugguuaucaccacacagaccccaguucucuccccauauuucauuuuuuccuaugcauuucaauauuagaaaagccugacucacauuuucuuuagggaggggcagggagaagauuucaacauucacccucacugccggucucucucuucagcuacacccacgcccccaguccccuucucucuccuccacaccuucuuuuuuggcuuuguuuugguuuucauugaguucuguccaaacaucgaauauuuuuaagcugugaggaaugggggugucgggaggaaguggccagucucuugucaacacccuguuucuuuuccuggcuggcagguuuugauuggaacuugguauucaagugggauuacaugacgccugagcagagaaggucccggcaggggaacccagucgccccuauaaaguaagugccagcauccuucagggugccccucccagaugagaccccagguuccagcuucuuugcugggcccgcaccgccuggagacccagugggggcuguucaccuucugcccuccgguuuccccucgucucagcucaaagaugagcaccuuccaccaggucauagaauaaaauccuuggagauuucuuuuccacaguugaagucucacauagguuuauaaggccuaucugcuaggucugugcauuccuguauguugauaauguagagcguuucuguagcagagcaggaucuccgagcugaccccaggcccaggaaaaggggcuuggugggcagcaggaggcuuacugcugcuacugcccagcaggccuuugcucuccugcagaggaaggagcccaugcucaugaagcccaugcuuuuaagauucccaggccgggcggugggcuuucugguugagagucaggaugccuucucuagcuggggagagaagggggccaccucuuccaaguuggcacacgguuaagugagauagcauucacagaguacuuagcgcugaaauauauuugcugacauuuagccaacaucugcagugugccauagaccuucccagcacuuuacacugaauucgcacagcaucgcuucugggaacaaaguagggagcucaguguacaucuguugucaaccccuuccugggaugaugaagugaggagcaugguggguucccuuguaggagguggagucucaucuaugauagugauaaugagagcuggugcuguggagcauuuccuaagcgugcucagggcuuuaugcccaugauuuuuugcaauccucguagcuacccuauaaggaaacugacacacagaaaggccgaguucuuugccuauggcagcaugucagugaguagugauccagccccagcagucgcucccacauaggggaggcucaguccagccccuggcacugugggaacauccaggcagggacagugggggaggcauuugaaggcagcaguggugaagcagagagaguggcaugcugggcacugagcagaaaacaguggcaguguggcuguucugaagaucagcuuauuguuagggaaucaaggcuuggccuuggcgcaagggugcuggcaaucuaaccuugacuuugcccucuccucccuccccccucuucuuucugccucuuuagaacccccaugauugcuggugggcuguuugugauggauaaguucuauuuugaagaacuggggaaguacgacaugaugauggauguguggggaggagagaaccuagguauguacaagccucaaaucucaggacagagaagugccucagcucugcaaaaggcagggugccaauuggaaaaaaaauuuaaaaggcuucagagugaccauucacugggcuuaaucgauccuugcaaacacauauguaacaccccuuuugcucuugaaagucucaugaguugggcauuaaaaugugccucccuagguuagaguggaggaugccagaauacggauaaagucuuugaagggaaaugcaaacucuuucaaggcgucugaacccaaguguuuggaauguugcaggcuugcaaaaacagagggaaacaguccaggagcucagauucaugcugagugguggagaguggaaaaugaaccccggcgaggcuggugggauugauugaauugaaaucaugaaaauccgauggggcagggaggccuuggcacuuaaucccuucucgacuaccuuugcgaaugguucucauuuguuuuucuguuuguuuguuuuuuuguuuuuaaauaccccaugcaaauuauuuuuacccagguuuaggcacagcaaaauuuugcacauuguggucuauauugguagccuuauauuuacugcauaaaagaugaaaagauguguuuuguuuguuuaggguuuggagugggggagaucuuuuuugcuuguuucaauuaaagccuuuuguuucaaaugcuugacauucugagcgaauucuccugggcugcugaguguuguuaacuuacauucguccuugggugaguguacccuggaggacaggggagaaggaaaggggaaaaugaggccacucauuuuuaauaguuuugagacuuugaaaguuuuuguuacuuuaaaagaaaagacuagccuagccuauuauuuuuccauuguuuuaugauguugaagucagugauaccaucucaucuuugaggauuucucugccuugguuugauguugaaagcuucuuuaggcucgauuacuauacugcacggguggagagaccgugagucaaacuccuuuuggguuguuuuaaaaaaaugauacauuaaccucuagggaaagcuuggauugaagucacuugaguacaaaaggcuucagaauuguuaacccucuaaagagaguucugucacccuguuccauggguauccccuaaugguuuaguggaaauccagcaggccagggucgcccaguagggcagcguaucguguagguggccauuucucaaaaacagugugguuuucagaaguuugcauacuauuagcugaaaugagacaucagccagcauuuugugucaucguguaggaagaguguugauuuacauaucuaaggaggcauucacccagagacugggggguagauuuguuguaaggagcugcuuuauugugguuugguguuuguauuuauuauguagcugugcuagaagguucuagggucugagcgguucagguuggggugaagaugaacccugcaagcaggagcacaucucugcccaggaaggcuggggcaucugucccuccgugaggggcucuccuggguuaugccaaggacuuggacucccagugagguuuggagggcucaagagcuucacgugagaaggccaugccgugagccuuucuccuuagcacugcucuagcuucugcuucugggggccgugcacacuacuagccauugccaaccugaggggccucugugggugugcauugggagagguguauggugcagagaggcccgaguaagauccaaaaccaccuccucaacgugugccccgcuggaaugaccagagcuucccauuuuccuaaucauguaaguccuuaugucauuuaagcaauuaaaauggaggaccaagaaccuaacccuuaacucuaacaauggggguaaggcuccuugggggcaucaucuguguuucucuacaucccugucaugcaaggaugaugcuaaguacuuccagggaaucaucuguuugugcuuucuuaacggaguguggucugcagaggucaugacaccuugcccagggucucagaaccaagauguaaacacuaacugccuaauuaaaaagccauugaguuuuacugaguaauuauccucaaaguuauaggguucaaaugaaaucaacgcugaagauacuguaguuauacuuagccuugaaaaucucccacaaaagcccuggaaggaucccuuguuggcuuaacagauuccccauagagaagccaaggggauuuccuagccccuaauucuaaaucuuguggugaggcaaauggauauuuaaauuuuauuuucugaaauagagacaacuucuuuuuuuuuuuuuuuuuuuuuugagauggagucucgcucugucaccaggcuggaguccaguggcacauucuuggcucaccgcaacguucgccucccggguucaagugauucuccugccucagccucccaaguaacugggauuacaggcaugugccaccgugcccggcuaauuuuuuguauuuuuaguagagacaggguuucuccauguuggucaggcuggucucaaacucccaaccucaggugauccgccugccucggccucccaaaguguugggauuacaggcaugagccacugcgcccagccgacaacuucuuagguuguguugggaacuguaaaaaguaaagucggaaacuuucacugcuuaugcuuaugugauuguaaccauacauuuucuauuaguacaagagaguugcuuauuaaagccccguaacagcugcauggaucacccauuccuagugagugaggcauuaguuugcuggacccaaguagaaacucaugguguucugaccccuguguuguauuuccugccaugugccuggcauucugggcaccuguugccauaacuagguugacugccugcaggauuugccaucaacucacuguauggucugugauggacccacccuauuucugaucaaucugcauuggugacagugacugcacacucuguagauacuauauguguauauuuuuacuucuuuuaauuuguuaauugacagauaauaauugugcauauucaugggauacauagugauguuuuuaauacauauaauguauggugaucagaucaaggaaauuagcauauccaucaucucaaacauguagcauguuuuuguguugggaacauucaguauccuccuccugguuauuugaaacucuguauauauuaugggucccuagagucacccuaccgggcuguagaacacaagcaagaucccucuucucuagcuauaauuuuguauccuugaaaaaaucccuacuccuuccuucccagccuuuacuauccuccguuauacuuuuuacuucuaugagaucaguguuuuuuagcuuccauguaugggugaaaacaugguauucaacuuucuguucuuacuucacuuaauuuccugggaauacuauccagccagaaaaaaaaaaugaaguccugucauucacaguaacuguugauuuuuguccugccucccuaacauguucuuagggaucuuagauaauacagaggaaaauucccuuuuguauuauacaaaccugguaaagaaaaacuguuuuuugccuuucagaaaauucuuaguuuuuuuguugaaucuguuucuugcauucagucggaccccugacucagacuccagucacucaccuagucaguggugauaagggcagguaccugguuggaagguaccugugugucacaaaaggcacaccagucagucuaagcuucgacugaguuccaaugcucagggcagucuguguguuuaaguagguguggguagugccuagaccuacacaucucauuccuccugccggucaguucuguguugaagcaagucaacagcagccuuccccagggagcauuccuaccugggccagcugguuacugacugguccaagccugugagcagcgugcagauaucaaucaguuacuugacuguccuuggucacuaccauaguccauaaggcagucccuaaguccauaguccguaaguccaaacucugccuggagacuugagccugcuaauacacagggacuuguauuuaauaaacuuuuccauuugagggaagggauuauuuuucccuggaugagaaaagccaagaugcauccugggguucagucuguuaaaaauaaguuuuagagaaagauggcauauaugguugucuagaauauguaacaauaaagcuuaauuguacauauuuauauaccuucaguguugccuuuucccacgguguugauacgaagcaagugcaaaugaucgugagccagcuagugaagaauucagcacaaguguuuugucacucaguaguuacgaugauacugggguauacaugaucuuaugccaagaggccuuuauauuuacaguagaccaagaagcauucuugucucaaggugucuacuccacaucugaaaaauauuuccccgugaacauuuuuucuugauuguauugugguccagagauccaagugugucaaaugucucuccuuuagagaguucugcaucagguucuggaaggaggaagguccuuaucagaucuccuucagcagcagagggcaugggagccccaugaugggauggucagggggccucuguaccugcuuggugugucugcuguugcagaggugcgucccaggcucugucagucaccugugucuuguucaucgucucagagaucucguuccgcguguggcagugugguggcagccuggagaucaucccgugcagccgugugggacacguguuccggaagcagcaccccuacacguucccggguggcaguggcacugucuuugcccgguaaguagugaaaggcugagcgggguccaaaacauugaugacuacccugaaagcaggaccugaccuugggcuguuugaggacagauguccuucaguggguguggugcauuuauacaauggaauaccacuuagcaauugaaaggcgcauuccacggaugcaggauacaaccugggcgccuuuccagggcaugaugcugagugagagaagcaguuacauacaugauuccacucaugucacagccucauaaaaacacagcuuuagggauggggccagaccagugguggccaggagcugugauggcaggaaagcggggagugugacugcagaggggcagcaccagggauguuuggaggagggacggagcuguucugucuccugguuguggugguaguuggacaaaucuucaugagugugaaggcucuuagaacuguacaccaccccccaaaauguuaugggaaaauuuuuuaaagaagaaaguucauuuuauaaccauucaaggugcaauuaaaagcaacauugucuuaguccauuuuaugcgucucuaaccaaauaccacagacuggguaauuuaaaaugaacagaaauuuaucuacucauaguucuggaggcugagaaguccaagaucaaggugcuggugucuggcgagggucuucuugaugugucaucacauggugggagggcaaagagagggcaggaaagagcaagagggggccaaauucucccuuuuauaauagcaucaaucccccccaugagaguggagcccucauggcauagucacuucuuaaaggucaccucuuaaaggccucaccucggcugggcaugguggcucaugucuguaaucccagcguugcgggaggccgagaugggcagaucaccugaguuugggcagaucaggaguuugagaccagccuggccaacauggaaaccgcaucucuacuaaaaauacaaaaauuaaccgggcauaguggcaggcgccuauaaucccagcuacucgggaggcugaggcaggaaaaucgcuugaacucgggagguggaguuugcagugggccaagaucgugccucugcacuccaaccugggcaacagagcgagacucugucucaaaaaaaaaaaaaaaagccucaccucuuaauacuguuauaauggcaauuaaaguuuaacaugaguuuuggagggaacaaacauucaaaccauagcaaauauuaaagucaagcuguacuaauuguguauaccacaagacaucgugacacagagucacgauucuugauggagaguagauauauuuuaguaaacaugaagaugccaacggaagggcuuuccgaaaguaaaauagcaaauagccguucuaucaagccaaguguccuucuagggaauucucuuacaugcuaaagauagaacagcguacaagccagaucucagggagauugccuucucuugaguguagacagcaaaacacacagcuaaauaagguauuuucaaauaguaaucaaugcugugaagaagguaagaugcagucauguggucgggcaugauuaggacaagcaguaggagagguuuucauggucaagagaaccuuugaggagguguuaugugaguucagacuugaaaggugggaggaggucccucugggaccccgaggaaucagacuaccugcaggaggagcagauccaggcugcugaggugcguuuggcauaucagccaaauggaagccaaggguagcuggaaccuagagaguaaggggacagugcacaggggcagaagagcuagacaggcccgggccaugcaccuuugcaggucaugggaaacguuggauguuauuugauucugaaggaaaacacuggggcuuuucagcagugccugaugucuguuuuaugcuuuggaaagguccguaugguugcugggcagaggguggccagguggugacccuauggugaaacaaugguacgagugcccccuccacucuuggagccagaagcaaggguccugugagcacuguugcaguagcccaggccagagaugugauacagucaugcaccuguaacagcguuucggucggugacaguagucccauaagauuauaauaccguguguuuacucuaccuuuucuuuguuuagauacacaaauacuuaccauuguguuacaguuuccuccaguguucaggacagucaugugcucuacacguuuguagccuagaagcaauaggcuguaccauguagccuagguguauauuaaggauacaccaucuagguuuguguaaauauacucuaugauguucacacaacgacaacaucgccuaaggaugcauuuuucagguuguaucccucucauuaagcagcaccuggcuguaccuggagcagguguguagcaguggagauggggugagauccagcuccauggugaagcaggcagcuguuugcuaauagggcggcagagagaagggagguagagcgggaaauuaauuuagggugaugcccaggagcuuuguuacacaacugcgcuggcgugcugccccuacagaaauagggaaagccuugggguggguguggguguggggauugcuagcuuaucuuuugucuaguuuuuuucuugagacagagucuugcucuguugcccaggcuggagugcaaaggugcgaucucggcucacugcaaccuccacuucccagauucaagagauucuccugucucagccucccaaguaccugggcuuacaggcaugugccaccaugcccggcuaauuuuuguauuuuuaguagagacaggguuucaccauguuggccaggcuggucucaaacuccugaccucaggugaucugcccaccucggccucccaaagugcugggauuacaggcgugagccaccgugcccagccauuuuuaaacuuuuugguuuuuuuucuuuuuugagacggaguuucgaucucguugcccacacuggagugcaauggcgugaucucagcucaccacaaccuccaccucccggauucaagcgacuccccugccucagccuccugaguagcagggauuacaggcaugcgccaccacacccagcugauuuuguauuuuuaguaguacauuucuccauguuggccaaacuggucuugaacuccugaccucaagugauccacccgccucagccucccaaagugcugggauuauagacgugagccaccgugccuggccauuuuuaaacuucuuaaaaguacagauuauacaauacaccuauuauacagaagucagauuuuucacauagggaaucugauuucugagaaaacuuuaauagaaggcaaaauaacaaguaaugcuucugaccaaauuaucuucucucaaaaacuauguuucuucacaaauguugaaacuucauuuuuguucuuuauuaaaacaaaaaugugaucuuguacaauaagcuuuacaaaaucaaacaaaaauauggauauaugugcuuuuuccuggggcagcaugagauucuuuauauagacauaucagacgccccacaccaaagccauugauaccuaccagcaaacagugagauuucagaaaacaguauguuaaaguacucaagacauugcacucuuuguuagaagagaaacauuuucaaauuguauuucacagcccaggagccuguauucucaagauuuggaaaagaagcugauccaggguuucauuauuuuggggcagcauggaucugauuaaaaagcccugcuguugaccuucagccagguugcucuuuaccucaguugacucaucugaaagauaaagaaguggaauuauaucacuguauuucugaggucucuuuccagcugcaguuucucuuaaucuccuauacagguugaauaucuuuuauccaaaaugcuugagacaagaaauauuuuggauuuuugacuuuuucaggauauggaauauuuauauguacuaccuaaugagauaucuuggggcugggaccuaagucaaaguacaaaauuuguuuguuuuauauagaccuuauacacauagccugaaguuaauuuaauacaauacuuuucauaauuuucugcaugaaacaaaguuuguguacauuaaaccaucagaaagcaaaggcgucacugugaccgcccacuggauucaccuugcccgcugcccagauggagcugacuuaccaagaugggaauugcaauagagaaagaguuuaguucacacagagcuggcuaagugggagacuggaauuuuauuacuuaagucaaucucccccaaaauucagaggcuaggguuuuucaaggauaaucuggagggagcuggggacuagggagugggugcugcugauuggaugaggugcaaucauagggguguggaaaaugguccuugugccugccgagucugcuucugcauggauggguccacaggacaagcuggagaucuggauggagucaucagaagugcagaagccugaaaagacauuacaaaaggccaaucuuacguucugcaauggugauguuaucugcaggaguaauuggggaaguugcaaaucuguggcugauuuguuaguccaacaaaggcagucugguacccagacaaaaagaggguuuguuuggggaaagggcuguuaccaucuuuguuuuaaaguuaaacuauaaacuaaguuucucccaaaguuaguucugccuaugcccaggagugaacaagggcaguuuagacguuagaaguuagauggagucagucaggucagaugccuuaaacugucaauuuugucauuguuaaauuuuuugcaaaggcaguuucgucacuaucucauguuggugcucaaaaaguuuuggauguuaggacauuuuggauuagggaugcccaacuuguaauagaugacauuuaauauuuauuuaauacuuauuuaauacuaccuaaauacuugcaaauaccugcaaaaacaaggagggccuggacaaaagugagucucccucggugccacuguaucugcagcacugagacuguuugguguagauaccaaauaaauaccugagugaaccaauaaauaaaugaauaaaaggagcuagcacugaguagcacauggagaucauuccuuggggcugccuaguuauccuuuucuauuacaaagacagaaaagaguugcuuugcguuuaggaauuuuuaagugauuuagucacuuaaaaacuugagugauuugaaaacaguaugacuggaguugauaaaaccuuuaaaucauuaaggcugaaaggaaccuaggacauucuggaaucaaauccuuucaugucccuguuggggaaauccaggugccagauguuacaaguauuuaaguuaauaacugguuaaaaacugacuaggcauagguuaaggcauaggucacuuagcaaaaccccacuaacaauguuuaguggcucuucugagaaaugauauguaugauccaguaucccccagcacuuuaaguacucauuguuguaucuguauauuuuuuaauagagagaaaguaaaaauucaucagucucaucaccaaaccaguugugccauaacacucucauaauuugaugaauucgucugucaguaucuauuucugucucucucucuuguuugcucacuggcucuccuucugccucuacacacauauccacuauaugcaauucugcaaacuauuuuauuuucccacaaguccaggacaucauuucugucaacauguaagaugcacacucauguuuuuaguggucacagaauauuucauuugauuccuuccucauauuuagucauaaaguuucucuuuuuuuuuuuuuuuuuugcuauuauaaacaaagcagaagugagcauauuuucacauguauauuucauuccuaauugauugcugccuugagauaaauuucuagaaguagagcugcugggucagagaauaggugcauucauauguucuuaucuguguugaauggcauuauggauaauaguccauauucuacuuacuaaaaugaaaaaguauauauaucaccuuauaugaaagauauaggccccauacagaaauuauuuuaauaaugguaucucagaucaguugaaaguuucgccauuuuaaggaauuauuuuaaaaggcgagcauuaccuccuuacuguauuuauuuuggaagaacacagugccuuccuaugggguucuuaaggagggcuagcuauagccugaagugggaguccaccuuauagccgagaccagaauaugggagcaaagagguuagcugugugcuugcuacuucauggaugcuuuaagauaauucuuggcagaauacacugcugauaccuaugcagaugauagcuuuuaaugcaugucagacauucaagaguagcuugucccaggggcuuuauuuauggcaaaucaugguucucucuaugagauuuaaguacaugguuuucuuuccuucuagaaaagccggcugggcgcgguggcucacgccuguaaucccagcacuuugggaagcugaggcgaguggaucacaaggucaagagaucgagaccauccuggcuaauguggugaaaccgucucuacuaaaauuacacaaaaauuuuagcuggguguggugguacaugccuauagucccagcugcucaggaagcucaggcaggagaaucgcuugaacccgggaggcggagguuucagugagccgagaucucgccacugcacuccagcuuggcagcagagcgagacuccaucaaaaaaaaaaaaagcuagugcaaacauggcagucuuucagcuuagccccgcagaaaagaaagugauuuucccaggaacucuuaucuuauguagucugaacuuuaaugcagagcugucugauagugucguagccgugacggagaaggccguggggccuggaaucuccuugcugugcucuguggccccggcccucuguggacgcguaaugugagaguuuuuaaagaguaacuuucuuuuguccuucuuuaagauauagaccccagucccuccuuuaaaauauuggcucgugcuguaauuuccacuuugccuuuugcccuuugaccaucugugugacaagaaagccauuccaaugguucaguaagcacccgcugaggcuggcuccccacagguccagcucgaggugcugguggggacagcccacccucugcugugugccgugaucccagcuggagcugcugcacacccagagggagccgccucagucacacgccagcagacaggugcaaauggagugaugcagacagaaagaaaggaaaucacaccucaagauuuauuuucuuucuagaaacacccgccgggcagcagaggucuggauggaugaauacaaaaauuucuauuaugcagcagugccuucugcuagaaacguuccuuauggaaaguaaguggcaguucugccuucucacaauuacuggggauucuuggggugugggggugggagguaaggggcugcccccagcguugaauucagcuacccaggugccaaggcgggaagggguugugggcacaggagcaugggcaguccacaccacaccaccugccccaacccuguucuccucagcagauuuucaaguuugauguagaaagcccaucuauucuuaaaauuuauaaaggaaucuuauuucccucuucuccaguauucagagcagauuggagcuuaggaagaaacucagcugcaagccuuucaaaugguaccuugaaaaugucuauccagaguuaagguaaguccccagggaucugggguuucacuuuguaagggcuuagaagccaguaaggccauagaagcagcagaggggaaauggagguggggcugcaggcaugagauugggcaccugggccccagugagagccuguggucucacuccaugguguggagcugagaaucugcucccaaguuggccugcugcugucucuguccugcagagcugcccucccaugcuucggagucccagaggcagucccccgggccucaccuuguuuuuggcuuguucuccauuggcaaggugaugggcugggugaccugaaggacuggugucugacaggcucuucgagugaccaggagcaguccccagccuccgcaagcaugcagugucugcagccagcccucgauccccccgccaggcgccuuugcaugccuccgaucugcugcgcucacccuugcugcuccugugggccagcagauaacagcccccacgaggcucccuccucccagcuagguuaaucacaugugaaacggaaguaauaaugcugcugccccacgucccuccggaggauucauggcagaaacaccuuucugagcauuauuuccacacccagccucuuguuuuaagcgaauacgagcuccccaucuggagggaccugcugauaaccucgugagaagaccuauagauccgcugggguggaggagccaucugcacuucaucuucuuaaagggacugucaggcaggucgugccuuaaugcggcacauuccuuauucuaaauauucccagagcauuuuacagcggcucacauaucuccagcacagugccugcgaacgcaagacuugccaccauuaucuuuccgcuaacagcuccuucagagcccuugucacggagauuuguuggacaguuagguaaugcggccucucucuguugcuccuguucgcucacuuggcucuuuggaaccguuuccucugcuuuucaaguaacaugccaggcgccagguggcccaugcccccuaggaggagaacaggagagaacacagcguccuucucccucggaucccugccgugcaggacagcuuuugcuggggauugagagcaccagauggucaccagcgauggucaccugcagcggcaagggugcacuggucacaguugcugguugcagggcccuggucuucuuccugccagcucuguccucucggccaugugcacucaacccaaaagaacccauucugccucugugucuggccccagaauaugaugucuacaccuccugccuggugucccuauacaacagauucuugacugugggcacuaaggcggcugcucaucaacucuccgucagccaaagaggggcuucaauucaguggauuuuaacccaaccaugccacucacuuugcuuuuucagucacaguugacugccauuucucacagaggucacccaugguuuguagugacacugggccccgcacccacugaagaccacaucugaggcacugagcaccauccuggcuggcaaaucugcuuccccugucuguggggggugagggagacaucagccucguguuuugugucuguaauaucaccgccguuuacugagugccuccuacgagccaggcacugggccgugugcuuuacacgaaauguucuauguaacacuugcagcagaucuggguagcccauagccuaccaaagggcaaaucgagcuucagagaaagugagucuugccugaaagccagcaccuggcagaggugggcugagguuuggaucugguucugaagcacguuguucuuccccguggcuguggcuuuguucacauuagaccaccugacaagucugcccaccuuucccgucuuuacuggauaaaggucagauccuaaguguauuggaaaguucaaggcaacaggaucugaccacauugauuuucuaaaugacuuccaauaagacuaacauugaagaguaucaggagcuuuuccuuccuuuccaaaaaaaaaaaaaaaaaaaaaugaccugauauagaauauaaagaauacuucugcaacauacagucuuaaaguguuggaaguccagagccugggagaaaugccgugucccugacacacacuaccugugguaggaagaggcacgaugccuagucacugggucuuucucucguuccugucaccugucaugaggccacugagcaaaggggcugguggacgggagcugguggucaugugcagugaagcaggugauucucacguuguuuuucaggguuccagaccaucaggauauagcuuuuggggccuugcagcagggaacuaacugccucgacacuuugggacacuuugcugauggugugguuggaguuuaugaaugucacaaugcugggggaaaccagguaugugcauggggaagccaggucaccugcaggcccagagagagcaggaguuggggggguccugauguuagaagucccagcugccaccuuucuccugggaugggugaugucuaugaggaagcaccuggcuccugcuggccacagccucuuuggcagccagcaccagggccagauagaaugucacacacuuuggugcaucagcucugucaucagcuucggaccaggcucugcugcagcggcaagggugcacuggucacaguugcugguugcagggcccuggucuuccugccagcucuguccucucggccaugugcacucaaccgcaaagcacccauucugccucugcgucuggccccagaauaugaugucuacaccuccugccugguaugccuauacaacagauucuuaacugugggcacuaaggcggcugcuaguuauagccccugccuguuagauaauagcuuaagauagaagauacucaguauuaauugcuuccauugcacacauacacaccuuuucugagaggcauaaaaaugcacaaccgccaggcgccguggcgcacgccuguaaucccaacacuuugggaggcugugguggguggaucaccuaaggucaggaguucaagaccagccuggccgacauggugaaacccaucucugcuaaaaauaaaaaaaaaauuagccaagcgugguggcgggcaccuguaaucccagcuacccgagaggcugaggcaggagaauugccugaacccgggaggcagagguugcugugagcugagaucacaccauugcauuccagcccaggcuacaagagcaaagcucugucucaaaaaacaaacaaacaaacaaacagaaaaacccacuaccuucucuucucccaucauugcaaaggagagacaaaaugaaggcuugaugggcccagcugagacuucggauucuaaaaacaguuuucccaugagauaauaauaggaauugggugaaaugugagcuucaugcaccaaaggguaauccugugugcucuuacccccuuccugaaaacuugccuggcacugggagagccugcaguuuuaaaaaaggcagguuaacuccguguguguauccugaauguauugauuucuuaacuuucuuuaacuggaaguauuuuugaaagggggcaugugcuuuuguguaaagcuggguccuccucccaagugaguguccaggcagacugcaauccacaaauaccuugacuccuuucuucacuuggugaugugguuuuagcaguuacuugcaauggccuggacauccuaaauuagaagagagagaggaaccugccugccuggggcuugacugggccaguccccauccagcaugggcauggggcagguagccagggccuggcccugguuccccuaaaucuccagcccuuaaauagaagauacuuggcguugaugaguuagaaaaugagagagagccucauuuucucgugugguuuugguagaguugauccuggauucuccguaucagcgucaacagucucgaugguucagaauagcuaaaugugaugcuauguuuggguaagagccaaugggucagguuugccgacagauaugagugugcuuccagugccugugcacgugugugacacacacacacacacacacacacacacaauagcacauaugcucaucacguucucacacaacagcucucuucuccugauucccgggcucagucccccucucuuccuugugcacaugcaccuagacucaugugcugcuucuuucuucuuuuucuguuacucagaugcagagcuuguuuugcucucuguuucguguacaugacuucauaucauugaucucuguccuuuugauaaauauuguuggaggguuuuuuacuuggcaguacuauuuugcuagagaaagggauuagaaggcaaacaaagcaaucccuugccuuccagaacucacaguugagcagaggagccacuguggguuaugaaacagaggaggcaccugcucaccucugugcuguccagguggcugcgccuccuguuauuccggcugcccucaccuccauguuuaaucacugggcuucccucugcuguguggcaggacugcaugccauucccaggcucccagggccuggcgucuguguguagccucugggcugugaggacacuccccagggagcaggcuucaggugugggugcacacacaagccagccuucagcuauagccugagggaccaguuuuagguauuucacacuguagcaggucagccccccuggguacucgucacaggccccacccgugucaggagucaccuggagggaggaacccauacagggggagggaagaacaaacagaguggaagacgaagcgggugaaaggaggaggagccagcugguauugguggggugggcagaggcggaggggaaggugccauccccaccguguccaugcuucuguguccuuguagcuccuccauccaagacccugcuguuaacuguguucucagucacugcugggaagcggggggcccaggggacucacucagaggugauggagggcgccgugcggugcugcugugggucccgcugugguccaggugugacuggaggaggcgucuccgcuggcuguguuccuucuacacugauaacagcguguuuauuuccaugguuugggcuuuguucuugagaucuggaaagcagugagcuuggggagagauguuuuauguguuuccaucuagaaccauagugaaaauccaccgaaaugcccucagaaaaguggagcucugugagggagggggaaaugaugggucucauucucagcaagcuggguuucaucuaaaccggacagacggugcugcaaggcuuggucgaucacacagcauuaaugcagauuucaccaaaugcagacauguggauaauucguguaggguugggugaagcuuaccucuggucuguggaugacaaaacggacgaggugcccacccagguuccguacugucuggguguugggccucuugugaucccuggccagccucaccuccguguuuaaucucuggaguucccacugucacucugcaguguucugaugauuuauggaagguuggagaggucacuccuuucugugucagcgccucugcuggaaagcgacacaccuuacgcuacagcacauuaaacagaagcgugugcucaggccccggccgagagaguucgucaucagagucucgggccccagcuucauccccugugcgucaggcucugugacuggcucaccccccgccagcauugcaccuuaauuaccgcacagcuaguaacacgagacagagucugggcccuguggagguggcaggucuacgggaaccaaagacuuugucuguguagcugcugccugugacccuccucaccugcccucaggaggacagccugugucccgccuucagggcuguggcccucaccccccgguccugcccaguagagagucuccaggauuccucucugcacagugcugagggcagccacagcacagaccuuugacacagagcgcccauuccuugccucugcaccaacuucaggggucagcaaagggcugugccaaggagugaacaagaucgggucugcagggugugucucccacucugcuuuugcuuuuccuucuugcuguugugcagccauuacuguucucacaugugggcuuucccuuccuuuccagcaguaagugcugacucccugcucacucucugucccccuccaauggccacauccugggauugcucagagaaauuuuuuuuuucuuuuuuuuuuuuugagacggaguuuggcuguguugcccaggcuuuuuuuuuuuuuuugagacggaguuuggcuguguugcccaggcuggagugcaguggugcaaucucggcucacugccaccuccgccucccagguucaagccauucuccugccucagccucucaaguagcagggauuacaggcacgugccaccacacccggcuaauuuuuguauguuuaguagagacgggauuccacuauguuggccaggcuggucucgaacucgugaccucaagugauccacaugccucagccucccaaagugcugggguuacaggcgugagccaccacaaccagccugcccagagaacuuuuacaaaaugcugaugccaggugcuaugcccagagagccugaucuaauuugucuagggucagagggcaccaccagaucucuaagagcuaacaagugauucuaaaugaggauuuggccugcuguagugguacacaccuguaauuucagcacuuuaggaagccaaggcaggaggauugcuugaggccaggaguucaagaccaggcuggacaacauagggaagcuccgucuuuacaaaaaaaaaaaaaagauuagccaguugugaugaccugugccuguaguccaagcuacucaggaggcugagaugggaggauugcuaaagcccaagaggucgaggcuguagugagcugugauugcaccacuacacuccagccugaacaacagagugagaccauguuccuaaaauaauguaaaauaaauuagggccgggcacgguggcucacgccuguaaucccagcacuuugggaggcugaggugggugaaucacgaggucuggaguucgagaccagccuggccaacauggugaaaccccgucucuacuaaaaauacaaaagauuagcugggcaugguagugggcaccuguaaucccagcuacucggggagcugaggcagaagaaucacuugaacccgggagguggagguugcagugagccgagaucgcaccacuauacuccagccugggugacagugugagauucugucucaaaaaaauaaauaaaaauuuuuaaaaaauaggaguugaggagcaagcguuuucuaguggaaagaugaacacaucagcacauacaaugugaugugagauggcaggaugacaugauguauguuacacccucagcuugggagcaccuuacugccugggccagucuggggccagugggcuacuaucaguacuuuccaauagaaccaugugcuaugauggggaugcucuacaucugccauucaguauaucagccacauuguggcaacugggcacuugaaauaugacuagugugaauuacaaguuuaauuucauuucauucuggugaauuuaaaugcaaauggcccugggugcccuguagcuagcacauuagacaguacggcucagauauuccagcucacaaacccacugugcgugaguccucucugaaccgauagaaagugaugcuuuuuugcauagcgugugacacggaugagaaacgagaggguaaguaauauuucccaacugaaaauagggccuggugcuuuggaagagugagguuuguuaucugguuuccggcugagccuuggcagacacacaggaaaugagaaaauuaauggccaugccuuuuaagaguggcagcucaaaaaagcauuucuuaaauauuuaugaacuuuauuuuacaaauucagauaauugaaaugcaacagaagaacaaaacggcaacuagcucuguuguuugcccagcugaauuaguuuuucuggaauccuguguaaagucugcuuuacaguaauuaagcacacaauagcaaggagguuguaaaaacauucagacaugaucuuuaacugggugucagcagaccauccagcauccgccaacaccugcugccagggacagucuggaacccuucuccauaccagcguugucccucuuacucaggacucuccucuucacugugagugggcgucucuguguaccacaguuucacacauccuggugguguccccagccccugugagugcagggacggaacaaugugcuucuuccuggcccucuccauccugaacgccaucugccuaugggaaacacacacggcuuccucucuacacuccacaccuuccauacucugugacccagugaauaggaaaaaagcugcuuuuccuccuuuauacucucacaaaacuucucaccucugacaccagcccugugggcuuuuccccccacaccaagcaauucuccaauucuccaauucucugcggacacugagugucaugccugucaacucaguucugacacugccuacccagaguuagcacagaccccacggguuaugggcuuccucccacaagaugcuucuacuccagaugccagucacaaguccaaguugucaccugcugucugacuguaaaucagggcucccgcgaccucgccuugaauucauucauuugcaagaauaguucauagaacucaggaaaacgguuuacuucguggcuuaccuguucauuaggaaagacugaaacccaggagcagcuggacgggagagaugcauagcacgcgguguggaggugggguguuggagcuuccacgcccucuccaggugugccgcucucccagcgccuccgcauguccggcagccacaucccggagugcaaggacuuugacggaggccucaucacaugggcaugaucuccagcuccucuucccuucccagaggaugggguggcgggggacugacgguuucaagcuucucagcauaaccuggucuuucuggugaccagccccguccaggagcccauuagaguugcuucauuagaacaagacacucccaucacccaauaaauuccaagggaguaggagcuguuuguugggaaccggggucaaagaccaaacacuagaaugaaagaugcuccuaaaaccccuguggcucaggaaaugacaaggguuuuaggagccuugugauugugccagagaccaaauaauuauuuuuaugaugucacacuguccuagaguaugggugacgugagugccugugggugcuuggaagagcuggcuggaacucacccauguugaaugacagcaucauagaauguugggauucgacucagggucggguggccuuccccagagaagguggccggcagggcugggugggucagggcugccuccaugccguguuuggaaugcuacagugcacaggccaagcaggugcuucuacucuaggacucuucagagccuuuaauagacugaauuuccgagagauaaacacagcacaaagucuguuucccaaauucauuugaccuagaauccgucuuuccuaggauuccucacagaguagaaugugaggaacacuaauuaaaaggugagaaaauggaagacccgggaagugagcaggcuugcccaagccucccucccuguuaggggaggaggaagucuucagacaggugaaggugucuucacugauuccuagacggguguccgugccucugcauccccucugcugaugcugagagcuggagauggugcaucccgccagugguuguauaaggucugaaugcuagaaucuuuaggguuugguuugguuugguuugguucgguucgguucaguucgguuuggagacagggucucggucugucacccaggcuagaaugcaguggcacaaucacaguucacugcagccucggccucccagguugaagcaauccuuccaccucagccucccaaguagcugggaccacaggcaugcacugccacacccggucaacuuauuuuuuauuuuuaguacaaacaaggucucgcuauguugccuaggcugaucuugaacuccuggcauuaagcaguucucccgccuuggcccccaaagugcugggauuauagauaggccugagccaccacaccgggcugcaucuucaccuuuuaauguuuuucuaaugacggacuauuuguuccaacaugauacagauacuagacagugaggcuucuuuaaacacuauuuguuccuuuccuuaccucuguuuccaagaaccaagaaaaaaacagugucuucauagcacauaauagugccugaaguugcagaauacauuuauuugugugucuuucauguuccccacuagaaagggagccuggcucugugacagcgccggugucauacaggugugcagcagguggucaugggacagaccgauagaaagacagacagacagacggaggggagggccacugcagcgugcuggggcuuagagaggaaggggauggaaguggauagugagucccugugggguuuuaaacuggaaagggccuugcugccccucgauauuaagggguguucaucccuuugagugggacaaauggagagugauggucagaagccucaccuuccagucccugcuguggcccugccuggaacaggcuccggccuccucugccaccugggaccaugucucauuuaguauccaaaaugguuguccucucacccugucacagccuuuaacuuguguguguuuguacauauauguguguguuuguuuguuaacaucaugguguguuauuuaaacacucucuagcucaguuuucucaucuauaaaaugagaauaauaauagcccucauggagcuguuguauaaagggcuuaaaauaaugcuuggcacauagcaccccauuaaauuuagcuguaauguauucaaagaaauucauagaucuauuccuccaguuuucagagggcuucaugagcacccauagaucaauuagcauucacuuaggaggcuauacacgauauauuuugcuuacauaugcaauguguuauuuacuacaguucacauucaucaaugcuguuugcaggccauaccugcaugagggcagagucauuccaaaauagcauggguggaccaguugccaacugucuaccugguguauaaccaagcuugugccacaguuuuuacagcucacauugaauuauagaaaaaugaacaaggcagucuaacuuguauuuggggcuaaaauaguuaauaguuuuauuuuaguuacugagguccucaaagcacuucugcacaucacucagccaacuuacugcucaguugugagguucucccacaucucugauguuauaaauuugcccuuaggcaaaaaguaauuguuucguucucaguuggcucagggguucugaaucuaagcuccaccccgugacccauuuccuuuuugagcccucaucgaugccccuucuuuccuuucacagcccggugcauagcacgccucugacuucugguuuuguguuccaggaaugggccuugacgaaggagaagucggugaagcacauggauuugugccuuacugugguggaccgggcaccgggcucucuuauaaagcugcagggcugccgagaaaaugacagcagacagguacggcuugcaggcacccgugggugcccgugauuaacccagaccaggguagccacggccugcgcccucuugcucugugcugccucucaaagcauccaucucugcguguacuuauguguucuuuugcaucacugugaauaaugucuagcugcccuauuagacuuaagccacaaaccuaauguugcuuauuucugauuauauucucauucucuucccuaugccgcugaaaauuuaaagagaaauuaucuacuuuuguuuauucaucaaauacuuuuuucuauuucaauuuacaaaaauucuaaaugauuaauguucacauggaugguacucgauacauaaugcaagugugugugucuauguguguauauaugugagcauauauauacacacauauauacacaccacauauauauacaugcuacauauauacauauauacaugccacauauauacauauauacacgccacauauauacacauauauacaugccacauauauacguauauauauacacaccacauauauauacauguauacacaccacauauauauacauauauauacacaccacauauacauauauacacaccacauauacauauaccugccacauauauacauauauaaacaccacauauauauacauaugcaugccacauauaugcauauguaaacaccgcauauauacauauauacacaccacauguauacguauauauagaugccacauuuauacauauauaaacgccacauauauauacacaccacauauguauacauauauauacaugccacauauacaucuauaaacaccacauguauacacgccacauauauacauauguaaacaccacauauauacacaccacauauauauacacgccacauauauacauauauacaaacaccacauauauauacauauacacacacacaccacagauacauacauauauauacaugccacauagauauacauauauaaacgccacauauauauacauauaaacacaccauauauauacauauagauacaugcuacauuuauauaaacaccacauauauauacgccacauagauauacaagcacaacauauauacaugccacauguauacauauguaaacaccacauauauauacacaccacauauacacaccacauauauauauacaaacaccacauauauauacauauauacauacaccacagauauauacauauauauacaugccacauauauauacaaauauacaugccacauauauacauguauauacaugccacauagauauacauauauaaaugccacagauauauacauauauaaacaccacauauauacauagacaccacagauacauacauauauacaugccacauauauauacguauauauacaugccacauauauauacguauauauacaugccacauauauauacguauauauacaugccacauauauauacguauauacaugccacauauauauacguauauauacaugccacauauauauacauauauaaacacauauauacauauauagacaccacagauauauacauauauauacacaccacauauauauacauauauacacacacacacauauacacacaguuucuuuaaacauuucagaauagacuuucuaccugccuuguaagccgguuuucucugacguauucccuuguggcagcuuguggacacacccuuucucaaggcaugggguaacaguuagugucaggaauagaaaugcaagcacaaaagguccucccuguaugcccauacuuggagugccugccccuguucuuacagucgguccuuagagauagaugggauguagggaaacugaggcacagaaccuacuggagccaagagccuaagccagcuucuagucuaacccugauuucacaacagaaaagucucagaaagucauugccuccacccuggagucaucugggaagaccaaggccaggaccgaguccccgguucugaccccaguugucagggagacgccugcagagggcccucuuucaccugucugucuccaaaccccugcgccagcucugggugcuccuccuucccugcucugcagagucccagccuguccuggcagugggagccccucucuaggguucugcucacaauccgcaucucuaaauguccaucuguguugaugacuugauaccaaaauguguaagggagugccuguuaaacaagagaaggcuagcaccgcuuggacccaaaccaccuagaaauugccucacucauuggccccucgagaggaagcuccucgagggcaaggcuggcaucugcugagccaaguacugggugagucucaaacacauuccccugggauguaacggagcagagaugucuuuggauguaauggauugauaaagugaugacuuuaguugacaccuuuuuaaaaaacaaauauuacuucaauauugcuuaauuucaagaauugacagguguuucugcuucagucccaguuuuggggaaccauaacugacacggcuuaggaccuuugugaagcaugaaaagaccuauaaauaauaaguuuuucuggauguauggcauguauaaauggggaucuguuagguuuuaaaccccaagacucaggcuauuagagaggaugugggggcuguuucaguagagucugacugccuugaaaaucugcgcuccccacccccaaccacaaucccaucagacagacagaucagagcccacaaggccaccugugcgagacggagcugggguuuuguuguuguuuuucuaagguucuugauuuagcugaugcuuugacacaugacaggcagucccuccaguggccagaaucagauuccguucauuccgaauucuuuguugagaagauuccuggcugcucagaguaacagggcagccucaauacauacacacuuuacaugacaauggggaaaaacagcaugaggggugauugacagcaacgagggagcuggaaaugaaagaggcaaugacaggcacuuagcaaaagccuccccggcuccucugauugcacugucuuucccugcuggcaagaacuccaggugagcagguggacggaaauaaggaaagcaggguacaagugacaacauccuugugguguuucgcgcaggucggguccccagcacugggcuccucugccugcaccggcuccucccugccucacucacuggccccucaagaggaagcuccuuagcaaauuuuaucuuggaacugaacuggcuuugccaguuggaacauuugguuuccaggcacguccauguuuucauauguugugcauauuugcagagucaaaggggaaagggaggcaggagugagaaaauuuaauucugcaaugucaaaaggauuugcaaaaaauacuuaggugaaggagcuuucgugcacacaguauaaaaaauuaauuagaaccacagacuucauuauuugaaacgagcuuuggggaagaaaaaaauguuacuuuuuuuuuuuaagaacaaacauuagagauuuuuaaagggggauuuuucuguuuuucuuucuuuuuuuuuuuuuuuuuaagagacaggaucucacucuguugcuuaagacuggagugcagggguggguaugaccauagcucacugcagccucgaacuccugugcccaagcgauccucccaccucagccugcaaggagcuaggacaacaggcaugcaccaccaugcccugcuaauuuuuuuuaaaaaaaauguuuguagagauggguucuugcuauguugcccaggcuggucuugaacuccuggccucaagcgaucuuccugccucggccucccaaagugcugggauuagugucgugagccgccugcacucaggcugaaagggguauuuauguuacuugcuaaacagggcuccucagauuuccuucaggcuggguugugcacuuugauucuggcuuaguugguggguaacggguauguggguugaguuugguuguucgcuugauuugaguguuaguaaagaggcaucguacccuguacuuuacaagcggcauguucagaacucagcaaacauuggucccugccauacagagcaccagggggcucaaggguagcagagacaaguuucucauauccaccaaggagcuugcacaccaguagagaacagacuacauagaaauaggcuucucaaugcuauguucuguucaaacaaccaucucucuuccugacauuuggccugacaccguuccucuggcucccccgagcagaaagcccuaagugggagcauggaggugcccagaccaaggccuccaggcagggcugcuuuccaacagccaggggaggaucuggcccugcauuguguggaucccuucuuggggugaaccaucacuggaucaagcuuucauacgaaggcaugcaaauuccccuacaucaaauccuguguuaaugacgaaggggugggugcccagagcucuggggcucagaggaggggacacccacagaaaguuuggggcaggagacguucugaguuuugauccaaggcagagaauauguuuccuuccugggucccagcagcaccuguggcugguuuccuguggggcugcugcaagcuccucggccguucagaugagaggcugggaaaaacgugucuaucugugaguuuuuaaugcagccacaagguccugaauucacacgaaucuguuuguacuccuuugcuugugcccacacucuaaggcacucuccugugucuugcagaaaugggaacagaucgagggcaacuccaagcugaggcacgugggcagcaaccugugccuggacagucgcacggccaagagcgggggccuaagcguggagguguguggcccggcccuuucgcagcaguggaaguucacgcucaaccugcagcaguaggaggguccgggaggcccugccguccugucuccugcaccauuggguggagucuggugaucacauuauugauuauguuucuuaaacuuuccgcgaaacuaauauaccucaguauuccaucauggucugaaagucaaacuucggcaaggcacggacgacugugcagacacagcagcggcaagaagcgagaacugcccucccccuccucucggugcagcccagccgggcccccuuccccaggccggagcgccccucuuccuuccagcuuucacuucugccggcuccgcaacugagugacacccagcgacaaccgacuggggagugguagaagcaacugaacggaugcgugcgagcugaggacagggcgggaggagggggcacacaugccccaggggagcgaggagaacucuugaaaucuccauuuucaaucccuucgaaaucacguaugguuuccacaaagccgagucgugucacguggcagguuuacgucaauagucccucucucugcuccuccauucgcaagugucuuccugggccagacuccccuccaccucauguacuugcuauauugaggaugaaguuuucuauggugggacacuaaauauaaagcuauauagagaaagaauguacggucaguucccuaugguuucuguagaucaucgucaucuuguauauuccccacaaagccguucgcagcuuccgggagaaggggccagagcccgguggggccaguuucucacagagggaggagguggccuuuguccccuggagcccgaucagccaguuggugcuacugcuguggccagcuggggggcuuccuccagaccaccggccucggccccggcaucccuguugggcgucagccugagagucccuacugugcgucagaauccaccuugcgugcugugcguaucugugaaccuggagcgguuacuuauuuugacagauaucacuuugggucuuuuuacauuaaauuucuuuucucuaaggaauauaagacauaccccauagcucugugugagccagcaauaccgcugcccccuggcgacagggcagaccaaugaugccaggcagcugucacacgcuaguauuggcuucauugugaucugagcccugcacgcugggccuucagaauuaauggccagcagugucagggaugagcccgucagccagggcacaggccuggcucacaguccugcacaccugcuggccuggggagcuccagccaggcagcgaguccugccccgcccgcagcucccucccacaccccgccuggccaagaugacugcuucagggggcuuuggggaaagaauuaggaagggucagaaccaaacaauaccugcucauuuacacugaggauucagggcgggagacaggagccuugggguccuguuaaaccacagacaguuaugaacugaaagucauaacggggagaggugccuggcuucuaccugggugcucaggaauguuccucgucaccccugccacucuguggucggugcccugcuuccuccuccacuccuggccgccuucuccagcgccgcacacacagaugcucagucucagagaggcuggcacggccuggcagucugagaaaagcgucaguuaggcacaccugcaggccccucggugggacagcggcggccuuggaguuaggagccacccugggagguugugccggugccaugcuccucccugugucuuguaugaaaggggccacugugugucuuccuccccggcgggagccccacaugugugcacuguaggacagcggccccgagguggaagccuggcuggagggcugcccuauaggucuucucuucccgccuccccugccaugcaaccagauguguugugagugggcagcgugcccccacgcuggaguaacuccgcacgcuucugucuuucacggugggcgcucggggggagccugaggaaaacccccuuagguaccugugcgaggcuguggagugcaggccagagcagggugugcguagcccccagcacccagguucuucugucagacccugugaccugcgagcugcuacuacuguaaggagggaaauggaugaaucuggcucguuuuaaaaucacguuuucugacgaauccuuugccccuucaccuuuaccccgcccgcaccccuaggcccucucagccuuccuaucaucccacgugucuacccagacccuugugcggcccaugcccugggggcggcguccugucccugagcugggaggcggcuuuggaugguccgggcgucaagagcaggggugggccggggagggguccuuugcggugagcuauguuuacaugacacagugugccaaagugacuuacugcgguugcguuaguuuuuaaucaucaggacuaucucacccucccacuccuguuuuuaaaacucagaauucuuuccuaagagcccuucgagcaaagcgugccgaaguuaguugucuucucugugcugguccuuucuuauguccucauaaaagcucagaugaugguaucugugaguauguuuugcaaauucaaaauauaguuugguaauuuuuuuuuccaguugauuuuuaaaaagaacugcuguacagagcuuguacuuuguccauuuuauagauggaaaccauccuugaaaauuguuuaacuuaaauaaagagaagauacuuucuagauaccgcu

SEQ ID NO: 192002 - RNA, 214920 nt, Homo sapiens
agcgguaucuagaaaguaucuucucuuuauuuaaguuaaacaauuuucaaggaugguuuccaucuauaaaauggacaaaguacaagcucuguacagcaguucuuuuuaaaaaucaacuggaaaaaaaaauuaccaaacuauauuuugaauuugcaaaacauacucacagauaccaucaucugagcuuuuaugaggacauaagaaaggaccagcacagagaagacaacuaacuucggcacgcuuugcucgaagggcucuuaggaaagaauucugaguuuuaaaaacaggagugggagggugagauaguccugaugauuaaaaacuaacgcaaccgcaguaagucacuuuggcacacugugucauguaaacauagcucaccgcaaaggaccccuccccggcccaccccugcucuugacgcccggaccauccaaagccgccucccagcucagggacaggacgccgcccccagggcaugggccgcacaagggucuggguagacacgugggaugauaggaaggcugagagggccuaggggugcgggcgggguaaaggugaaggggcaaaggauucgucagaaaacgugauuuuaaaacgagccagauucauccauuucccuccuuacaguaguagcagcucgcaggucacagggucugacagaagaaccugggugcugggggcuacgcacacccugcucuggccugcacuccacagccucgcacagguaccuaaggggguuuuccucaggcuccccccgagcgcccaccgugaaagacagaagcgugcggaguuacuccagcgugggggcacgcugcccacucacaacacaucugguugcauggcaggggaggcgggaagagaagaccuauagggcagcccuccagccaggcuuccaccucggggccgcuguccuacagugcacacauguggggcucccgccggggaggaagacacacaguggccccuuucauacaagacacagggaggagcauggcaccggcacaaccucccaggguggcuccuaacuccaaggccgccgcugucccaccgaggggccugcaggugugccuaacugacgcuuuucucagacugccaggccgugccagccucucugagacugagcaucugugugugcggcgcuggagaaggcggccaggaguggaggaggaagcagggcaccgaccacagaguggcaggggugacgaggaacauuccugagcacccagguagaagccaggcaccucuccccguuaugacuuucaguucauaacugucugugguuuaacaggaccccaaggcuccugucucccgcccugaauccucaguguaaaugagcagguauuguuugguucugacccuuccuaauucuuuccccaaagcccccugaagcagucaucuuggccaggcggggugugggagggagcugcgggcggggcaggacucgcugccuggcuggagcuccccaggccagcaggugugcaggacugugagccaggccugugcccuggcugacgggcucaucccugacacugcuggccauuaauucugaaggcccagcgugcagggcucagaucacaaugaagccaauacuagcgugugacagcugccuggcaucauuggucugcccugucgccagggggcagcgguauugcuggcucacacagagcuaugggguaugucuuauauuccuuagagaaaagaaauuuaauguaaaaagacccaaagugauaucugucaaaauaaguaaccgcuccagguucacagauacgcacagcacgcaagguggauucugacgcacaguagggacucucaggcugacgcccaacagggaugccggggccgaggccgguggucuggaggaagccccccagcuggccacagcaguagcaccaacuggcugaucgggcuccaggggacaaaggccaccuccucccucugugagaaacuggccccaccgggcucuggccccuucucccggaagcugcgaacggcuuuguggggaauauacaagaugacgaugaucuacagaaaccauagggaacugaccguacauucuuucucuauauagcuuuauauuuagugucccaccauagaaaacuucauccucaauauagcaaguacaugagguggaggggagucuggcccaggaagacacuugcgaauggaggagcagagagagggacuauugacguaaaccugccacgugacacgacucggcuuuguggaaaccauacgugauuucgaagggauugaaaauggagauuucaagaguucuccucgcuccccuggggcaugugugcccccuccucccgcccuguccucagcucgcacgcauccguucaguugcuucuaccacuccccagucgguugucgcugggugucacucaguugcggagccggcagaagugaaagcuggaaggaagaggggcgcuccggccuggggaagggggcccggcugggcugcaccgagaggagggggagggcaguucucgcuucuugccgcugcugugucugcacagucguccgugccuugccgaaguuugacuuucagaccaugauggaauacugagguauauuaguuucgcggaaaguuuaagaaacauaaucaauaaugugaucaccagacuccacccaauggugcaggagacaggacggcagggccucccggacccuccuacugcugcagguugagcgugaacuuccacugcugcgaaagggccgggccacacaccuccacgcuuaggcccccgcucuuggccgugcgacuguccaggcacagguugcugcccacgugccucagcuuggaguugcccucgaucuguucccauuucugcaagacacaggagagugccuuagagugugggcacaagcaaaggaguacaaacagauucgugugaauucaggaccuuguggcugcauuaaaaacucacagauagacacguuuuucccagccucucaucugaacggccgaggagcuugcagcagccccacaggaaaccagccacaggugcugcugggacccaggaaggaaacauauucucugccuuggaucaaaacucagaacgucuccugccccaaacuuucuguggguguccccuccucugagccccagagcucugggcacccaccccuucgucauuaacacaggauuugauguaggggaauuugcaugccuucguaugaaagcuugauccagugaugguucaccccaagaagggauccacacaaugcagggccagauccuccccuggcuguuggaaagcagcccugccuggaggccuuggucugggcaccuccaugcucccacuuagggcuuucugcucgggggagccagaggaacggugucaggccaaaugucaggaagagagaugguuguuugaacagaacauagcauugagaagccuauuucuauguagucuguucucuacuggugugcaagcuccuugguggauaugagaaacuugucucugcuacccuugagcccccuggugcucuguauggcagggaccaauguuugcugaguucugaacaugccgcuuguaaaguacaggguacgaugccucuuuacuaacacucaaaucaagcgaacaaccaaacucaacccacauacccguuacccaccaacuaagccagaaucaaagugcacaacccagccugaaggaaaucugaggagcccuguuuagcaaguaacauaaauaccccuuucagccugagugcaggcggcucacgacacuaaucccagcacuuugggaggccgaggcaggaagaucgcuugaggccaggaguucaagaccagccugggcaacauagcaagaacccaucucuacaaacauuuuuuuuaaaaaaaauuagcagggcaugguggugcaugccuguuguccuagcuccuugcaggcugaggugggaggaucgcuugggcacaggaguucgaggcugcagugagcuauggucauacccaccccugcacuccagucuuaagcaacagagugagauccugucucuuaaaaaaaaaaaaaaaaagaaagaaaaacagaaaaaucccccuuuaaaaaucucuaauguuuguucuuaaaaaaaaaaaguaacauuuuuuucuuccccaaagcucguuucaaauaaugaagucugugguucuaauuaauuuuuuauacugugugcacgaaagcuccuucaccuaaguauuuuuugcaaauccuuuugacauugcagaauuaaauuuucucacuccugccucccuuuccccuuugacucugcaaauaugcacaacauaugaaaacauggacgugccuggaaaccaaauguuccaacuggcaaagccaguucaguuccaagauaaaauuugcuaaggagcuuccucuugaggggccagugagugaggcagggaggagccggugcaggcagaggagcccagugcuggggacccgaccugcgcgaaacaccacaaggauguugucacuuguacccugcuuuccuuauuuccguccaccugcucaccuggaguucuugccagcagggaaagacagugcaaucagaggagccggggaggcuuuugcuaagugccugucauugccucuuucauuuccagcucccucguugcugucaaucaccccucaugcuguuuuuccccauugucauguaaaguguguauguauugaggcugcccuguuacucugagcagccaggaaucuucucaacaaagaauucggaaugaacggaaucugauucuggccacuggagggacugccugucaugugucaaagcaucagcuaaaucaagaaccuuagaaaaacaacaacaaaaccccagcuccgucucgcacagguggccuugugggcucugaucugucugucugaugggauugugguuggggguggggagcgcagauuuucaaggcagucagacucuacugaaacagcccccacauccucucuaauagccugagucuugggguuuaaaaccuaacagauccccauuuauacaugccauacauccagaaaaacuuauuauuuauaggucuuuucaugcuucacaaagguccuaagccgugucaguuaugguuccccaaaacugggacugaagcagaaacaccugucaauucuugaaauuaagcaauauugaaguaauauuuguuuuuuaaaaaggugucaacuaaagucaucacuuuaucaauccauuacauccaaagacaucucugcuccguuacaucccaggggaauguguuugagacucacccaguacuuggcucagcagaugccagccuugcccucgaggagcuuccucucgaggggccaaugagugaggcaauuucuaggugguuuggguccaagcggugcuagccuucucuuguuuaacaggcacucccuuacacauuuugguaucaagucaucaacacagauggacauuuagagaugcggauugugagcagaacccuagagaggggcucccacugccaggacaggcugggacucugcagagcagggaaggaggagcacccagagcuggcgcagggguuuggagacagacaggugaaagagggcccucugcaggcgucucccugacaacuggggucagaaccggggacucgguccuggccuuggucuucccagaugacuccaggguggaggcaaugacuuucugagacuuuucuguugugaaaucaggguuagacuagaagcuggcuuaggcucuuggcuccaguagguucugugccucaguuucccuacaucccaucuaucucuaaggaccgacuguaagaacaggggcaggcacuccaaguaugggcauacagggaggaccuuuugugcuugcauuucuauuccugacacuaacuguuaccccaugccuugagaaaggguguguccacaagcugccacaagggaauacgucagagaaaaccggcuuacaaggcagguagaaagucuauucugaaauguuuaaagaaacuguguguauauguguguguguguauauauguauauauaugugguguguauauauauguauauaucuguggugucuauauauguauauauguguuuauauauguauauauauguggcauguauauauacguauauauauguggcauguauauacguauauauauguggcauguauauauacguauauauauguggcauguauauauacguauauauauguggcauguauauauacguauauauauguggcauguauauauguauguaucuguggugucuauguauauaugugguguuuauauauguauauaucuguggcauuuauauauguauaucuauguggcauguauauacauguauauauguggcauguauauuuguauauauauguggcauguauauauauguauauaucugugguguauguauauauguauauauaugugguguuuguauauauauaugugguguguauaugugguguguauauauaugugguguuuacauauguauacauguggcauguauauauguugugcuuguauaucuauguggcguauauauaugugguguuuauauaaauguagcauguaucuauauguauauauaugguguguuuauauguauauauauguggcguuuauauauguauaucuauguggcauguauauauauguauguaucugugguguguguguguauauguauauauaugugguguuuguauauauguauauauguggcguguauauauaugugguguguauauaugugguguuuacauauguauauauguggcguguauacaugugguguuuauagauguauauguggcauguauauauauguauacauaugugguguguauauauauguggcguuuauauauguauaaauguggcaucuauauauacguauacaugugguguguauauauguauauaugcgguguuuacauaugcauauauguggcaugcauauguauauauaugugguguuuauauauguauauauguggcagguauauguauaugugguguguauauauguauaugugguguguauauauauguauauauaugugguguguauacauguauauauaugugguguguauauauauacguauauauguggcauguauauauguguauauauguggcguguauauauguauauauguggcauguauauauguauauauguagcauguauauauaugugguguguauauauguguguauauauaugcucacauauauacacacauagacacacacacuugcauuauguaucgaguaccauccaugugaacauuaaucauuuagaauuuuuguaaauugaaauagaaaaaaguauuugaugaauaaacaaaaguagauaauuucucuuuaaauuuucagcggcauagggaagagaaugagaauauaaucagaaauaagcaacauuagguuuguggcuuaagucuaauagggcagcuagacauuauucacagugaugcaaaagaacacauaaguacacgcagagauggaugcuuugagaggcagcacagagcaagagggcgcaggccguggcuacccuggucuggguuaaucacgggcacccacgggugccugcaagccguaccugucugcugucauuuucucggcagcccugcagcuuuauaagagagcccggugcccgguccaccacaguaaggcacaaauccaugugcuucaccgacuucuccuucgucaaggcccauuccuggaacacaaaaccagaagucagaggcgugcuaugcaccgggcugugaaaggaaagaaggggcaucgaugagggcucaaaaaggaaaugggucacgggguggagcuuagauucagaaccccugagccaacugagaacgaaacaauuacuuuuugccuaagggcaaauuuauaacaucagagaugugggagaaccucacaacugagcaguaaguuggcugagugaugugcagaagugcuuugaggaccucaguaacuaaaauaaaacuauuaacuauuuuagccccaaauacaaguuagacugccuuguucauuuuucuauaauucaaugugagcuguaaaaacuguggcacaagcuugguuauacaccagguagacaguuggcaacugguccacccaugcuauuuuggaaugacucugcccucaugcagguauggccugcaaacagcauugaugaaugugaacuguaguaaauaacacauugcauauguaagcaaaauauaucguguauagccuccuaagugaaugcuaauugaucuaugggugcucaugaagcccucugaaaacuggaggaauagaucuaugaauuucuuugaauacauuacagcuaaauuuaauggggugcuaugugccaagcauuauuuuaagcccuuuauacaacagcuccaugagggcuauuauuauucucauuuuauagaugagaaaacugagcuagagaguguuuaaauaacacaccaugauguuaacaaacaaacacacacauauauguacaaacacacacaaguuaaaggcugugacagggugagaggacaaccauuuuggauacuaaaugagacauggucccagguggcagaggaggccggagccuguuccaggcagggccacagcagggacuggaaggugaggcuucugaccaucacucuccauuugucccacucaaagggaugaacaccccuuaauaucgaggggcagcaaggcccuuuccaguuuaaaaccccacagggacucacuauccacuuccauccccuuccucucuaagccccagcacgcugcaguggcccuccccuccgucugucugucugucuuucuaucggucugucccaugaccaccugcugcacaccuguaugacaccggcgcugucacagagccaggcucccuuucuaguggggaacaugaaagacacacaaauaaauguauucugcaacuucaggcacuauuaugugcuaugaagacacuguuuuuuucuugguucuuggaaacagagguaaggaaaggaacaaauaguguuuaaagaagccucacugucuaguaucuguaucauguuggaacaaauaguccgucauuagaaaaacauuaaaaggugaagaugcagcccggugugguggcucaggccuaucuauaaucccagcacuuugggggccaaggcgggagaacugcuuaaugccaggaguucaagaucagccuaggcaacauagcgagaccuuguuuguacuaaaaauaaaaaauaaguugaccggguguggcagugcaugccuguggucccagcuacuugggaggcugagguggaaggauugcuucaaccugggaggccgaggcugcagugaacugugauugugccacugcauucuagccugggugacagaccgagacccugucuccaaaccgaacugaaccgaaccgaaccaaaccaaaccaaaccaaacccuaaagauucuagcauucagaccuuauacaaccacuggcgggaugcaccaucuccagcucucagcaucagcagaggggaugcagaggcacggacacccgucuaggaaucagugaagacaccuucaccugucugaagacuuccuccuccccuaacagggagggaggcuugggcaagccugcucacuucccgggucuuccauuuucucaccuuuuaauuaguguuccucacauucuacucugugaggaauccuaggaaagacggauucuaggucaaaugaauuugggaaacagacuuugugcuguguuuaucucucggaaauucagucuauuaaaggcucugaagaguccuagaguagaagcaccugcuuggccugugcacuguagcauuccaaacacggcauggaggcagcccugacccacccagcccugccggccaccuucucuggggaaggccacccgacccugagucgaaucccaacauucuaugaugcugucauucaacaugggugaguuccagccagcucuuccaagcacccacaggcacucacgucacccauacucuaggacagugugacaucauaaaaauaauuauuuggucucuggcacaaucacaaggcuccuaaaacccuugucauuuccugagccacagggguuuuaggagcaucuuucauucuaguguuuggucuuugaccccgguucccaacaaacagcuccuacucccuuggaauuuauugggugaugggagugucuuguucuaaugaagcaacucuaaugggcuccuggacggggcuggucaccagaaagaccagguuaugcugagaagcuugaaaccgucagucccccgccaccccauccucugggaagggaagaggagcuggagaucaugcccaugugaugaggccuccgucaaaguccuugcacuccgggauguggcugccggacaugcggaggcgcugggagagcggcacaccuggagagggcguggaagcuccaacaccccaccuccacaccgcgugcuaugcaucucucccguccagcugcuccuggguuucagucuuuccuaaugaacagguaagccacgaaguaaaccguuuuccugaguucuaugaacuauucuugcaaaugaaugaauucaaggcgaggucgcgggagcccugauuuacagucagacagcaggugacaacuuggacuugugacuggcaucuggaguagaagcaucuugugggaggaagcccauaacccguggggucugugcuaacucuggguaggcagugucagaacugaguugacaggcaugacacucaguguccgcagagaauuggagaauuggagaauugcuugguguggggggaaaagcccacagggcuggugucagaggugagaaguuuugugagaguauaaaggaggaaaagcagcuuuuuuccuauucacugggucacagaguauggaagguguggaguguagagaggaagccguguguguuucccauaggcagauggcguucaggauggagagggccaggaagaagcacauuguuccgucccugcacucacaggggcuggggacaccaccaggaugugugaaacugugguacacagagacgcccacucacagugaagaggagaguccugaguaagagggacaacgcugguauggagaaggguuccagacugucccuggcagcagguguuggcggaugcuggauggucugcugacacccaguuaaagaucaugucugaauguuuuuacaaccuccuugcuauugugugcuuaauuacuguaaagcagacuuuacacaggauuccagaaaaacuaauucagcugggcaaacaacagagcuaguugccguuuuguucuucuguugcauuucaauuaucugaauuuguaaaauaaaguucauaaauauuuaagaaaugcuuuuuugagcugccacucuuaaaaggcauggccauuaauuuucucauuuccugugugucugccaaggcucagccggaaaccagauaacaaaccucacucuuccaaagcaccaggcccuauuuucaguugggaaauauuacuuacccucucguuucucauccgugucacacgcuaugcaaaaaagcaucacuuucuaucgguucagagaggacucacgcacaguggguuugugagcuggaauaucugagccguacugucuaaugugcuagcuacagggcacccagggccauuugcauuuaaauucaccagaaugaaaugaaauuaaacuuguaauucacacuagucauauuucaagugcccaguugccacaauguggcugauauacugaauggcagauguagagcauccccaucauagcacaugguucuauuggaaaguacugauaguagcccacuggccccagacuggcccaggcaguaaggugcucccaagcugaggguguaacauacaucaugucauccugccaucucacaucacauuguaugugcugauguguucaucuuuccacuagaaaacgcuugcuccucaacuccuauuuuuuaaaaauuuuuauuuauuuuuuugagacagaaucucacacugucacccaggcuggaguauaguggugcgaucucggcucacugcaaccuccaccucccggguucaagugauucuucugccucagcuccccgaguagcugggauuacaggugcccacuaccaugcccagcuaaucuuuuguauuuuuaguagagacgggguuucaccauguuggccaggcuggucucgaacuccagaccucgugauucacccaccucagccucccaaagugcugggauuacaggcgugagccaccgugcccggcccuaauuuauuuuacauuauuuuaggaacauggucucacucuguuguucaggcuggaguguaguggugcaaucacagcucacuacagccucgaccucuugggcuuuagcaauccucccaucucagccuccugaguagcuuggacuacaggcacaggucaucacaacuggcuaaucuuuuuuuuuuuuuuguaaagacggagcuucccuauguuguccagccuggucuugaacuccuggccucaagcaauccuccugccuuggcuuccuaaagugcugaaauuacagguguguaccacuacagcaggccaaauccucauuuagaaucacuuguuagcucuuagagaucugguggugcccucugacccuagacaaauuagaucaggcucucugggcauagcaccuggcaucagcauuuuguaaaaguucucugggcaggcugguugugguggcucacgccuguaaccccagcacuuugggaggcugaggcauguggaucacuugaggucacgaguucgagaccagccuggccaacauaguggaaucccgucucuacuaaacauacaaaaauuagccgggugugguggcacgugccuguaaucccugcuacuugagaggcugaggcaggagaauggcuugaaccugggaggcggagguggcagugagccgagauugcaccacugcacuccagccugggcaacacagccaaacuccgucucaaaaaaaaaaaaaaagccugggcaacacagccaaacuccgucucaaaaaaaaaaaaagaaaaaaaaaauuucucugagcaaucccaggauguggccauuggagggggacagagagugagcagggagucagcacuuacugcuggaaaggaagggaaagcccacaugugagaacaguaauggcugcacaacagcaagaaggaaaagcaaaagcagagugggagacacacccugcagacccgaucuuguucacuccuuggcacagcccuuugcugaccccugaaguuggugcagaggcaaggaaugggcgcucugugucaaaggucugugcuguggcugcccucagcacugugcagagaggaauccuggagacucucuacugggcaggaccggggggugagggccacagcccugaaggcgggacacaggcuguccuccugagggcaggugaggagggucacaggcagcagcuacacagacaaagucuuugguucccguagaccugccaccuccacagggcccagacucugucucguguuacuagcugugcgguaauuaaggugcaaugcuggcggggggugagccagucacagagccugacgcacaggggaugaagcuggggcccgagacucugaugacgaacucucucggccggggccugagcacacgcuucuguuuaaugugcuguagcguaaggugugucgcuuuccagcagaggcgcugacacagaaaggagugaccucuccaaccuuccauaaaucaucagaacacugcagagugacagugggaacuccagagauuaaacacggaggugaggcuggccagggaucacaagaggcccaacacccagacaguacggaaccugggugggcaccucguccguuuugucauccacagaccagagguaagcuucacccaacccuacacgaauuauccacaugucugcauuuggugaaaucugcauuaaugcugugugaucgaccaagccuugcagcaccgucuguccgguuuagaugaaacccagcuugcugagaaugagacccaucauuucccccucccucacagagcuccacuuuucugagggcauuucgguggauuuucacuaugguucuagauggaaacacauaaaacaucucuccccaagcucacugcuuuccagaucucaagaacaaagcccaaaccauggaaauaaacacgcuguuaucaguguagaaggaacacagccagcggagacgccuccuccagucacaccuggaccacagcgggacccacagcagcaccgcacggcgcccuccaucaccucugagugaguccccugggccccccgcuucccagcagugacugagaacacaguuaacagcagggucuuggauggaggagcuacaaggacacagaagcauggacacgguggggauggcaccuuccccuccgccucugcccaccccaccaauaccagcuggcuccuccuccuuucacccgcuucgucuuccacucuguuuguucuucccucccccuguauggguuccucccuccaggugacuccugacacggguggggccugugacgaguacccaggggggcugaccugcuacagugugaaauaccuaaaacuggucccucaggcuauagcugaaggcuggcuugugugugcacccacaccugaagccugcucccuggggaguguccucacagcccagaggcuacacacagacgccaggcccugggagccugggaauggcaugcaguccugccacacagcagagggaagcccagugauuaaacauggaggugagggcagccggaauaacaggaggcgcagccaccuggacagcacagaggugagcaggugccuccucuguuucauaacccacaguggcuccucugcucaacugugaguucuggaaggcaagggauugcuuuguuugccuucuaaucccuuucucuagcaaaauaguacugccaaguaaaaaacccuccaacaauauuuaucaaaaggacagagaucaaugauaugaagucauguacacgaaacagagagcaaaacaagcucugcaucugaguaacagaaaaagaagaaagaagcagcacaugagucuaggugcaugugcacaaggaagagagggggacugagcccgggaaucaggagaagagagcuguugugugagaacgugaugagcauaugugcuauugugugugugugugugugugugugugugucacacacgugcacaggcacuggaagcacacucauaucugucggcaaaccugacccauuggcucuuacccaaacauagcaucacauuuagcuauucugaaccaucgagacuguugacgcugauacggagaauccaggaucaacucuaccaaaaccacacgagaaaaugaggcucucucucauuuucuaacucaucaacgccaaguaucuucuauuuaagggcuggagauuuaggggaaccagggccaggcccuggcuaccugccccaugcccaugcuggauggggacuggcccagucaagccccaggcaggcagguuccucucucucuucuaauuuaggauguccaggccauugcaaguaacugcuaaaaccacaucaccaagugaagaaaggagucaagguauuuguggauugcagucugccuggacacucacuugggaggaggacccagcuuuacacaaaagcacaugcccccuuucaaaaauacuuccaguuaaagaaaguuaagaaaucaauacauucaggauacacacacggaguuaaccugccuuuuuuaaaacugcaggcucucccagugccaggcaaguuuucaggaaggggguaagagcacacaggauuacccuuuggugcaugaagcucacauuucacccaauuccuauuauuaucucaugggaaaacuguuuuuagaauccgaagucucagcugggcccaucaagccuucauuuugucucuccuuugcaaugaugggagaagagaagguaguggguuuuucuguuuguuuguuuguuuguuuuuugagacagagcuuugcucuuguagccugggcuggaaugcaauggugugaucucagcucacagcaaccucugccucccggguucaggcaauucuccugccucagccucucggguagcugggauuacaggugcccgccaccacgcuuggcuaauuuuuuuuuuauuuuuagcagagauggguuucaccaugucggccaggcuggucuugaacuccugaccuuaggugauccacccaccacagccucccaaaguguugggauuacaggcgugcgccacggcgccuggcgguugugcauuuuuaugccucucagaaaagguguguaugugugcaauggaagcaauuaauacugaguaucuucuaucuuaagcuauuaucuaacaggcaggggcuauaacuagcagccgccuuagugcccacaguuaagaaucuguuguauaggcauaccaggcaggagguguagacaucauauucuggggccagacgcagaggcagaaugggugcuuugcgguugagugcacauggccgagaggacagagcuggcaggaagaccagggcccugcaaccagcaacugugaccagugcacccuugccgcugcagcagagccugguccgaagcugaugacagagcugaugcaccaaagugugugacauucuaucuggcccuggugcuggcugccaaagaggcuguggccagcaggagccaggugcuuccucauagacaucacccaucccaggagaaagguggcagcugggacuucuaacaucaggacccccccaacuccugcucucucugggccugcaggugaccuggcuuccccaugcacauaccugguuucccccagcauugugacauucauaaacuccaaccacaccaucagcaaagugucccaaagugucgaggcaguuaguucccugcugcaaggccccaaaagcuauauccugauggucuggaacccugaaaaacaacgugagaaucaccugcuucacugcacaugaccaccagcucccguccaccagccccuuugcucaguggccucaugacaggugacaggaacgagagaaagacccagugacuaggcaucgugccucuuccuaccacagguagugugugucagggacacggcauuucucccaggcucuggacuuccaacacuuuaagacuguauguugcagaaguauucuuuauauucuauaucaggucauuuuuuuuuuuuuuuuuuuuuggaaaggaaggaaaagcuccugauacucuucaauguuagucuuauuggaagucauuuagaaaaucaauguggucagauccuguugccuugaacuuuccaauacacuuaggaucugaccuuuauccaguaaagacgggaaaggugggcagacuugucagguggucuaaugugaacaaagccacagccacggggaagaacaacgugcuucagaaccagauccaaaccucagcccaccucugccaggugcuggcuuucaggcaagacucacuuucucugaagcucgauuugcccuuugguaggcuaugggcuacccagaucugcugcaaguguuacauagaacauuucguguaaagcacacggcccagugccuggcucguaggaggcacucaguaaacggcggugauauuacagacacaaaacacgaggcugaugucucccucaccccccacagacaggggaagcagauuugccagccaggauggugcucagugccucagauguggucuucagugggugcggggcccagugucacuacaaaccaugggugaccucugugagaaauggcagucaacugugacugaaaaagcaaagugaguggcaugguuggguuaaaauccacugaauugaagccccucuuuggcugacggagaguugaugagcagccgccuuagugcccacagucaagaaucuguuguauagggacaccaggcaggagguguagacaucauauucuggggccagacacagaggcagaauggguucuuuuggguugagugcacauggccgagaggacagagcuggcaggaagaagaccagggcccugcaaccagcaacugugaccagugcacccuugccgcugcaggugaccaucgcuggugaccaucuggugcucucaauccccagcaaaagcuguccugcacggcagggauccgagggagaaggacgcuguguucucuccuguucuccuccuagggggcaugggccaccuggcgccuggcauguuacuugaaaagcagaggaaacgguuccaaagagccaagugagcgaacaggagcaacagagagaggccgcauuaccuaacuguccaacaaaucuccgugacaagggcucugaaggagcuguuagcggaaagauaaugguggcaagucuugcguucgcaggcacugugcuggagauaugugagccgcuguaaaaugcucugggaauauuuagaauaaggaaugugccgcauuaaggcacgaccugccugacagucccuuuaagaagaugaagugcagauggcuccuccaccccagcggaucuauaggucuucucacgagguuaucagcaggucccuccagauggggagcucguauucgcuuaaaacaagaggcuggguguggaaauaaugcucagaaagguguuucugccaugaauccuccggagggacguggggcagcagcauuauuacuuccguuucacaugugauuaaccuagcugggaggagggagccucgugggggcuguuaucugcuggcccacaggagcagcaagggugagcgcagcagaucggaggcaugcaaaggcgccuggcggggggaucgagggcuggcugcagacacugcaugcuugcggaggcuggggacugcuccuggucacucgaagagccugucagacaccaguccuucaggucacccagcccaucaccuugccaauggagaacaagccaaaaacaaggugaggcccgggggacugccucugggacuccgaagcaugggagggcagcucugcaggacagagacagcagcaggccaacuugggagcagauucucagcuccacaccauggagugagaccacaggcucucacuggggcccaggugcccaaucucaugccugcagccccaccuccauuuccccucugcugcuucuauggccuuacuggcuucuaagcccuuacaaagugaaaccccagaucccuggggacuuaccuuaacucuggauagacauuuucaagguaccauuugaaaggcuugcagcugaguuucuuccuaagcuccaaucugcucugaauacuggagaagagggaaauaagauuccuuuauaaauuuuaagaauagaugggcuuucuacaucaaacuugaaaaucugcugaggagaacaggguuggggcagguggugugguguggacugcccaugcuccugugcccacaaccccuucccgccuuggcaccuggguagcugaauucaacgcugggggcagccccuuaccucccacccccacaccccaagaauccccaguaauugugagaaggcagaacugccacuuacuuuccauaaggaacguuucuagcagaaggcacugcugcauaauagaaauuuuuguauucauccauccagaccucugcugcccggcggguguuucuagaaagaaaauaaaucuugaggugugauuuccuuucuuucugucugcaucacuccauuugcaccugucugcuggcgugugacugaggcggcucccucugggugugcagcagcuccagcugggaucacggcacacagcagagggugggcuguccccaccagcaccucgagcuggaccuguggggagccagccucagcgggugcuuacugaaccauuggaauggcuuucuugucacacagauggucaaagggcaaaaggcaaaguggaaauuacagcacgagccaauauuuuaaaggagggacuggggucuauaucuuaaagaaggacaaaagaaaguuacucuuuaaaaacucucacauuacgcguccacagagggccggggccacagagcacagcaaggagauuccaggccccacggccuucuccgucacggcuacgacacuaucagacagcucugcauuaaaguucagacuacauaagauaagaguuccugggaaaaucacuuucuuuucugcggggcuaagcugaaagacugccauguuugcacuagcuuuuuuuuuuuuugauggagucucgcucugcugccaagcuggagugcaguggcgagaucucggcucacugaaaccuccgccucccggguucaagcgauucuccugccugagcuuccugagcagcugggacuauaggcauguaccaccacacccagcuaaaauuuuuguguaauuuuaguagagacgguuucaccacauuagccaggauggucucgaucucuugaccuugugauccacucgccucagcuucccaaagugcugggauuacaggcgugagccaccgcgcccagccggcuuuucuagaaggaaagaaaaccauguacuuaaaucucauagagagaaccaugauuugccauaaauaaagccccugggacaagcuacucuugaaugucugacaugcauuaaaagcuaucaucugcauagguaucagcaguguauucugccaagaauuaucuuaaagcauccaugaaguagcaagcacacagcuaaccucuuugcucccauauucuggucucggcuauaagguggacucccacuucaggcuauagcuagcccuccuuaagaaccccauaggaaggcacuguguucuuccaaaauaaauacaguaaggagguaaugcucgccuuuuaaaauaauuccuuaaaauggcgaaacuuucaacugaucugagauaccauuauuaaaauaauuucuguauggggccuauaucuuucauauaaggugauauauauacuuuuucauuuuaguaaguagaauauggacuauuauccauaaugccauucaacacagauaagaacauaugaaugcaccuauucucugacccagcagcucuacuucuagaaauuuaucucaaggcagcaaucaauuaggaaugaaauauacaugugaaaauaugcucacuucugcuuuguuuauaauagcaaaaaaaaaaaaaaaaaagagaaacuuuaugacuaaauaugaggaaggaaucaaaugaaauauucugugaccacuaaaaacaugagugugcaucuuacauguugacagaaaugauguccuggacuugugggaaaauaaaauaguuugcagaauugcauauaguggauauguguguagaggcagaaggagagccagugagcaaacaagagagagagacagaaauagauacugacagacgaauucaucaaauuaugagaguguuauggcacaacugguuuggugaugagacugaugaauuuuuacuuucucucuauuaaaaaauauacagauacaacaaugaguacuuaaagugcugggggauacuggaucauacauaucauuucucagaagagccacuaaacauuguuagugggguuuugcuaagugaccuaugccuuaaccuaugccuagucaguuuuuaaccaguuauuaacuuaaauacuuguaacaucuggcaccuggauuuccccaacagggacaugaaaggauuugauuccagaauguccuagguuccuuucagccuuaaugauuuaaagguuuuaucaacuccagucauacuguuuucaaaucacucaaguuuuuaagugacuaaaucacuuaaaaauuccuaaacgcaaagcaacucuuuucugucuuuguaauagaaaaggauaacuaggcagccccaaggaaugaucuccaugugcuacucagugcuagcuccuuuuauucauuuauuuauugguucacucagguauuuauuugguaucuacaccaaacagucucagugcugcagauacaguggcaccgagggagacucacuuuuguccaggcccuccuuguuuuugcagguauuugcaaguauuuagguaguauuaaauaaguauuaaauaaauauuaaaugucaucuauuacaaguugggcaucccuaauccaaaauguccuaacauccaaaacuuuuugagcaccaacaugagauagugacgaaacugccuuugcaaaaaauuuaacaaugacaaaauugacaguuuaaggcaucugaccugacugacuccaucuaacuucuaacgucuaaacugcccuuguucacuccugggcauaggcagaacuaacuuugggagaaacuuaguuuauaguuuaacuuuaaaacaaagaugguaacagcccuuuccccaaacaaacccucuuuuugucuggguaccagacugccuuuguuggacuaacaaaucagccacagauuugcaacuuccccaauuacuccugcagauaacaucaccauugcagaacguaagauuggccuuuuguaaugucuuuucaggcuucugcacuucugaugacuccauccagaucuccagcuuguccuguggacccauccaugcagaagcagacucggcaggcacaaggaccauuuuccacaccccuaugauugcaccucauccaaucagcagcacccacucccuaguccccagcucccuccagauuauccuugaaaaacccuagccucugaauuuugggggagauugacuuaaguaauaaaauuccagucucccacuuagccagcucugugugaacuaaacucuuucucuauugcaauucccaucuugguaagucagcuccaucugggcagcgggcaaggugaauccagugggcggucacagugacgccuuugcuuucugaugguuuaauguacacaaacuuuguuucaugcagaaaauuaugaaaaguauuguauuaaauuaacuucaggcuauguguauaaggucuauauaaaacaaacaaauuuuguacuuugacuuaggucccagccccaagauaucucauuagguaguacauauaaauauuccauauccugaaaaagucaaaaauccaaaauauuucuugucucaagcauuuuggauaaaagauauucaaccuguauaggagauuaagagaaacugcagcuggaaagagaccucagaaauacagugauauaauuccacuucuuuaucuuucagaugagucaacugagguaaagagcaaccuggcugaaggucaacagcagggcuuuuuaaucagauccaugcugccccaaaauaaugaaacccuggaucagcuucuuuuccaaaucuugagaauacaggcuccugggcugugaaauacaauuugaaaauguuucucuucuaacaaagagugcaaugucuugaguacuuuaacauacuguuuucugaaaucucacuguuugcugguagguaucaauggcuuugguguggggcgucugauaugucuauauaaagaaucucaugcugccccaggaaaaagcacauauauccauauuuuuguuugauuuuguaaagcuuauuguacaagaucacauuuuuguuuuaauaaagaacaaaaaugaaguuucaacauuugugaagaaacauaguuuuugagagaagauaauuuggucagaagcauuacuuguuauuuugccuucuauuaaaguuuucucagaaaucagauucccuaugugaaaaaucugacuucuguauaauagguguauuguauaaucuguacuuuuaagaaguuuaaaaauggccaggcacgguggcucacgucuauaaucccagcacuuugggaggcugaggcggguggaucacuugaggucaggaguucaagaccaguuuggccaacauggagaaauguacuacuaaaaauacaaaaucagcugggugugguggcgcaugccuguaaucccugcuacucaggaggcugaggcaggggagucgcuugaauccgggagguggagguuguggugagcugagaucacgccauugcacuccagugugggcaacgagaucgaaacuccgucucaaaaaagaaaaaaaaccaaaaaguuuaaaaauggcugggcacgguggcucacgccuguaaucccagcacuuugggaggccgaggugggcagaucaccugaggucaggaguuugagaccagccuggccaacauggugaaacccugucucuacuaaaaauacaaaaauuagccgggcaugguggcacaugccuguaagcccagguacuugggaggcugagacaggagaaucucuugaaucugggaaguggagguugcagugagccgagaucgcaccuuugcacuccagccugggcaacagagcaagacucugucucaagaaaaaaacuagacaaaagauaagcuagcaauccccacacccacacccaccccaaggcuuucccuauuucuguaggggcagcacgccagcgcaguuguguaacaaagcuccugggcaucacccuaaauuaauuucccgcucuaccucccuucucucugccgcccuauuagcaaacagcugccugcuucaccauggagcuggaucucaccccaucuccacugcuacacaccugcuccagguacagccaggugcugcuuaaugagagggauacaaccugaaaaaugcauccuuaggcgauguugucguugugugaacaucauagaguauauuuacacaaaccuagaugguguauccuuaauauacaccuaggcuacaugguacagccuauugcuucuaggcuacaaacguguagagcacaugacuguccugaacacuggaggaaacuguaacacaaugguaaguauuuguguaucuaaacaaagaaaagguagaguaaacacacgguauuauaaucuuaugggacuacugucaccgaccgaaacgcuguuacaggugcaugacuguaucacaucucuggccugggcuacugcaacagugcucacaggacccuugcuucuggcuccaagaguggagggggcacucguaccauuguuucaccauagggucaccaccuggccacccucugcccagcaaccauacggaccuuuccaaagcauaaaacagacaucaggcacugcugaaaagccccaguguuuuccuucagaaucaaauaacauccaacguuucccaugaccugcaaaggugcauggcccgggccugucuagcucuucugccccugugcacuguccccuuacucucuagguuccagcuacccuuggcuuccauuuggcugauaugccaaacgcaccucagcagccuggaucugcuccuccugcagguagucugauuccucggggucccagagggaccuccucccaccuuucaagucugaacucacauaacaccuccucaaagguucucuugaccaugaaaaccucuccuacugcuuguccuaaucaugcccgaccacaugacugcaucuuaccuucuucacagcauugauuacuauuugaaaauaccuuauuuagcuguguguuuugcugucuacacucaagagaaggcaaucucccugagaucuggcuuguacgcuguucuaucuuuagcauguaagagaauucccuagaaggacacuuggcuugauagaacggcuauuugcuauuuuacuuucggaaagcccuuccguuggcaucuucauguuuacuaaaauauaucuacucuccaucaagaaucgugacucugugucacgaugucuugugguauacacaauuaguacagcuugacuuuaauauuugcuaugguuugaauguuuguucccuccaaaacucauguuaaacuuuaauugccauuauaacaguauuaagaggugaggcuuuuuuuuuuuuuuuugagacagagucucgcucuguugcccagguuggagugcagaggcacgaucuuggcccacugcaaacuccaccucccgaguucaagcgauuuuccugccucagccucccgaguagcugggauuauaggcgccugccacuaugcccgguuaauuuuuguauuuuuaguagagaugcgguuuccauguuggccaggcuggucucaaacuccugaucugcccaaacucaggugaucugcccaucucggccucccgcaacgcugggauuacagacaugagccaccaugcccagccgaggugaggccuuuaagaggugaccuuuaagaagugacuaugccaugagggcuccacucucaugggggggauugaugcuauuauaaaagggagaauuuggcccccucuugcucuuuccugcccucucuuugcccucccaccaugugaugacacaucaagaagacccucgccagacaccagcaccuugaucuuggacuucucagccuccagaacuaugaguagauaaauuucuguucauuuuaaauuacccagucugugguauuugguuagagacgcauaaaauggacuaagacaauguugcuuuuaauugcaccuugaaugguuauaaaaugaacuuucuucuuuaaaaaauuuucccauaacauuuuggggggugguguacaguucuaagagccuucacacucaugaagauuuguccaacuaccaccacaaccaggagacagaacagcuccgucccuccuccaaacaucccuggugcugccccucugcagucacacuccccgcuuuccugccaucacagcuccuggccaccacuggucuggccccaucccuaaagcuguguuuuuaugaggcugugacaugaguggaaucauguauguaacugcuucucucacucagcaucaugcccuggaaaggcgcccagguuguauccugcauccguggaaugcgccuuucaauugcuaagugguauuccauuguauaaaugcaccacacccacugaaggacaucuguccucaaacagcccaaggucagguccugcuuucaggguagucaucaauguuuuggaccccgcucagccuuucacuacuuaccgggcaaagacagugccacugccacccgggaacguguaggggugcugcuuccggaacacgugucccacacggcugcacgggaugaucuccaggcugccaccacacugccacacgcggaacgagaucucugagacgaugaacaagacacaggugacugacagagccugggacgcaccucugcaacagcagacacaccaagcagguacagaggcccccugaccaucccaucauggggcucccaugcccucugcugcugaaggagaucugauaaggaccuuccuccuuccagaaccugaugcagaacucucuaaaggagagacauuugacacacuuggaucucuggaccacaauacaaucaagaaaaaauguucacggggaaauauuuuucagauguggaguagacaccuugagacaagaaugcuucuuggucuacuguaaauauaaaggccucuuggcauaagaucauguauaccccaguaucaucguaacuacugagugacaaaacacuugugcugaauucuucacuagcuggcucacgaucauuugcacuugcuucguaucaacaccgugggaaaaggcaacacugaagguauauaaauauguacaauuaagcuuuauuguuacauauucuagacaaccauauaugccaucuuucucuaaaacuuauuuuuaacagacugaaccccaggaugcaucuuggcuuuucucauccagggaaaaauaaucccuucccucaaauggaaaaguuuauuaaauacaagucccuguguauuagcaggcucaagucuccaggcagaguuuggacuuacggacuauggacuuagggacugccuuauggacuaugguagugaccaaggacagucaaguaacugauugauaucugcacgcugcucacaggcuuggaccagucaguaaccagcuggcccagguaggaaugcucccuggggaaggcugcuguugacuugcuucaacacagaacugaccggcaggaggaaugagauguguaggucuaggcacuacccacaccuacuuaaacacacagacugcccugagcauuggaacucagucgaagcuuagacugacuggugugccuuuugugacacacagguaccuuccaaccagguaccugcccuuaucaccacugacuaggugagugacuggagucugagucagggguccgacugaaugcaagaaacagauucaacaaaaaaacuaagaauuuucugaaaggcaaaaaacaguuuuucuuuaccagguuuguauaauacaaaagggaauuuuccucuguauuaucuaagaucccuaagaacauguuagggaggcaggacaaaaaucaacaguuacugugaaugacaggacuucauuuuuuuuuucuggcuggauaguauucccaggaaauuaagugaaguaagaacagaaaguugaauaccauguuuucacccauacauggaagcuaaaaaacacugaucucauagaaguaaaaaguauaacggaggauaguaaaggcugggaaggaaggaguagggauuuuuucaaggauacaaaauuauagcuagagaagagggaucuugcuuguguucuacagcccgguagggugacucuagggacccauaauauauacagaguuucaaauaaccaggaggaggauacugaauguucccaacacaaaaacaugcuacauguuugagaugauggauaugcuaauuuccuugaucugaucaccauacauuauauguauuaaaaacaucacuauguaucccaugaauaugcacaauuauuaucugucaauuaacaaauuaaaagaaguaaaaauauacacauauaguaucuacagagugugcagucacugucaccaaugcagauugaucagaaauaggguggguccaucacagaccauacagugaguugauggcaaauccugcaggcagucaaccuaguuauggcaacaggugcccagaaugccaggcacauggcaggaaauacaacacaggggucagaacaccaugaguuucuacuuggguccagcaaacuaaugccucacucacuaggaaugggugauccaugcagcuguuacggggcuuuaauaagcaacucucuuguacuaauagaaaauguaugguuacaaucacauaagcauaagcagugaaaguuuccgacuuuacuuuuuacaguucccaacacaaccuaagaaguugucggcugggcgcaguggcucaugccuguaaucccaacacuuugggaggccgaggcaggcggaucaccugagguugggaguuugagaccagccugaccaacauggagaaacccugucucuacuaaaaauacaaaaaauuagccgggcacgguggcacaugccuguaaucccaguuacuugggaggcugaggcaggagaaucacuugaacccgggaggcgaacguugcggugagccaagaaugugccacuggacuccagccuggugacagagcgagacuccaucucaaaaaaaaaaaaaaaaaaaaaagaaguugucucuauuucagaaaauaaaauuuaaauauccauuugccucaccacaagauuuagaauuaggggcuaggaaauccccuuggcuucucuauggggaaucuguuaagccaacaagggauccuuccagggcuuuugugggagauuuucaaggcuaaguauaacuacaguaucuucagcguugauuucauuugaacccuauaacuuugaggauaauuacucaguaaaacucaauggcuuuuuaauuaggcaguuaguguuuacaucuugguucugagacccugggcaaggugucaugaccucugcagaccacacuccguuaagaaagcacaaacagaugauucccuggaaguacuuagcaucauccuugcaugacagggauguagagaaacacagaugaugcccccaaggagccuuacccccauuguuagaguuaaggguuagguucuugguccuccauuuuaauugcuuaaaugacauaaggacuuacaugauuaggaaaaugggaagcucuggucauuccagcggggcacacguugaggaggugguuuuggaucuuacucgggccucucugcaccauacaccucucccaaugcacacccacagaggccccucagguuggcaauggcuaguagugugcacggcccccagaagcagaagcuagagcagugcuaaggagaaaggcucacggcauggccuucucacgugaagcucuugagcccuccaaaccucacugggaguccaaguccuuggcauaacccaggagagccccucacggagggacagaugccccagccuuccugggcagagaugugcuccugcuugcaggguucaucuucaccccaaccugaaccgcucagacccuagaaccuucuagcacagcuacauaauaaauacaaacaccaaaccacaauaaagcagcuccuuacaacaaaucuaccccccagucucugggugaaugccuccuuagauauguaaaucaacacucuuccuacacgaugacacaaaaugcuggcugaugucucauuucagcuaauaguaugcaaacuucugaaaaccacacuguuuuugagaaauggccaccuacacgauacgcugcccuacugggcgacccuggccugcuggauuuccacuaaaccauuaggggauacccauggaacagggugacagaacucucuuuagaggguuaacaauucugaagccuuuuguacucaagugacuucaauccaagcuuucccuagagguuaauguaucauuuuuuuaaaacaacccaaaaggaguuugacucacggucucuccacccgugcaguauaguaaucgagccuaaagaagcuuucaacaucaaaccaaggcagagaaauccucaaagaugagaugguaucacugacuucaacaucauaaaacaauggaaaaauaauaggcuaggcuagucuuuucuuuuaaaguaacaaaaacuuucaaagucucaaaacuauuaaaaaugaguggccucauuuuccccuuuccuucuccccuguccuccaggguacacucacccaaggacgaauguaaguuaacaacacucagcagcccaggagaauucgcucagaaugucaagcauuugaaacaaaaggcuuuaauugaaacaagcaaaaaagaucucccccacuccaaacccuaaacaaacaaaacacaucuuuucaucuuuuaugcaguaaauauaaggcuaccaauauagaccacaaugugcaaaauuuugcugugccuaaaccuggguaaaaauaauuugcaugggguauuuaaaaacaaaaaaacaaacaaacagaaaaacaaaugagaaccauucgcaaagguagucgagaagggauuaagugccaaggccucccugccccaucggauuuucaugauuucaauucaaucaaucccaccagccucgccgggguucauuuuccacucuccaccacucagcaugaaucugagcuccuggacuguuucccucuguuuuugcaagccugcaacauuccaaacacuuggguucagacgccuugaaagaguuugcauuucccuucaaagacuuuauccguauucuggcauccuccacucuaaccuagggaggcacauuuuaaugcccaacucaugagacuuucaagagcaaaagggguguuacauauguguuugcaaggaucgauuaagcccagugaauggucacucugaagccuuuuaaauuuuuuuuccaauuggcacccugccuuuugcagagcugaggcacuucucuguccugagauuugaggcuuguacauaccuagguucucuccuccccacacauccaucaucaugucguacuuccccaguucuucaaaauagaacuuauccaucacaaacagcccaccagcaaucauggggguucuaaagaggcagaaagaagaggggggagggaggagagggcaaagucaagguuagauugccagcacccuugcgccaaggccaagccuugauucccuaacaauaagcugaucuucagaacagccacacugccacuguuuucugcucagugcccagcaugccacucucucugcuucaccacugcugccuucaaaugccucccccacugucccugccuggauguucccacagugccaggggcuggacugagccuccccuaugugggagcgacugcuggggcuggaucacuacucacugacaugcugccauaggcaaagaacucggccuuucugugugucaguuuccuuauaggguagcuacgaggauugcaaaaaaucaugggcauaaagcccugagcacgcuuaggaaaugcuccacagcaccagcucucauuaucacuaucauagaugagacuccaccuccuacaagggaacccaccaugcuccucacuucaucaucccaggaagggguugacaacagauguacacugagcucccuacuuuguucccagaagcgaugcugugcgaauucaguguaaagugcugggaaggucuauggcacacugcagauguuggcuaaaugucagcaaauauauuucagcgcuaaguacucugugaaugcuaucucacuuaaccgugugccaacuuggaagagguggcccccuucucuccccagcuagagaaggcauccugacucucaaccagaaagcccaccgcccggccugggaaucuuaaaagcaugggcuucaugagcaugggcuccuuccucugcaggagagcaaaggccugcugggcaguagcagcaguaagccuccugcugcccaccaagccccuuuuccugggccuggggucagcucggagauccugcucugcuacagaaacgcucuacauuaucaacauacaggaaugcacagaccuagcagauaggccuuauaaaccuaugugagacuucaacuguggaaaagaaaucuccaaggauuuuauucuaugaccugguggaaggugcucaucuuugagcugagacgaggggaaaccggagggcagaaggugaacagcccccacugggucuccaggcggugcgggcccagcaaagaagcuggaaccuggggucucaucugggaggggcacccugaaggaugcuggcacuuacuuuauaggggcgacuggguuccccugccgggaccuucucugcucaggcgucauguaaucccacuugaauaccaaguuccaaucaaaaccugccagccaggaaaagaaacaggguguugacaagagacuggccacuuccucccgacacccccauuccucacagcuuaaaaauauucgauguuuggacagaacucaaugaaaaccaaaacaaagccaaaaaagaagguguggaggagagagaaggggacugggggcguggguguagcugaagagagagaccggcagugagggugaauguugaaaucuucucccugccccucccuaaagaaaaugugagucaggcuuuucuaauauugaaaugcauaggaaaaaaugaaauauggggagagaacuggggucuguguggugauaaccagggcauguccaagggcuguaaggaugugaggaaaaagagcauccaacaugaaaaucaagccgugguaccuccaacacugccccaggggaaggcaaugcuggggagggaacgaggcuuugucaguucccugggccagcaaacuucagacuguauuugcagcaagaauggagugggaacaugcugggaauaugaaaacuuuaagggaaaaugagccagcggaaguugccaagcugggcaaauaagcuucaauuucagauauauuuggcaccuguugcauuucauuuuuggaauccacagaccccugaggauagaagagccuagacccuguacccggacuugguugugggcaucugcagggccucaggucucgcucuugcucccagggucacacacauagugccucuuggaggccagcaggcuccaccugcggaagcuguccuggugcaucaggaggccacuucuuggcaaacacauggcucauggugcugcauuuccaauuccaagggucugacagcaaaaccuaaugacucuagggcaugcaucuuucaauccucuuaagcucucugccaucaggcuuuuugucaacagggcuuuugcaaugccuaaguuuggauuugucugcaugcuuugaauucauagucuguccgcccugacagccccagugacugaaggauggcgggugaggguuucugaguguccugggcuggccaagaauuuauggcucuggacaaagaggccucccagcucccucacugcaggauagaguggccucaggcaaagagagagggaaauggacaggggcccaggcaguggggacagaaaugcacagagaggagaccccugcgggccccugagcuggcucuuaucauggugccucaaaggccacgaaggaaaaccagaaaaacaauguccuggcuguuucacuaacagagaagguuaaggauuagcugacauaaccuuuccuuuguuuuuuugauguuuacuauuaucuuauuauuuauuuuauuaauuugguccaaagagagaggcuauagcagauuaaagaucuguuaagaauggcauccuugauuuuuuuucuaaaggaauuucauaaaaugcucuuagggugaacguggccccguuccucugacccagaagaccugcacccccacacggaacaccuggcuguucuugccccugcucugacauacgcagcugcuuugggagaaauagagccugguagaucucagcucuucgaauacuuggggaaauacaacauucugaaagccaggcuuucuagcuaucuaaggaucccuccucuuuaauguccccaaacauuuuacuucucaccauuugcugggaaucguuccugaauguuauguuucccacccuagguacaguccuccaagcaugcccgcccucccgcugaugucuaauuccauuaugcccuguguggccagcacaauuaucaucccauuucccagagggggaagcugagaagcagaggcaaaauggccugcccaugaugacggggccugcaagaggcagguggggccaaagcccacaaugucuaggaccguggcugagucucccuaaaaaguccaaguauucuguuuucugggguuaaggcuugcuugcacacauauguguguguguaugaauaagcagggucucacucugucucccaggguugaucguggcucacugcagccuugaccucccaggcucaagugauccucccaccuuagccccgaguagcuggcaugccaucacacgcagcuaauuuuuuuuuuuuuuuuuaauagagacaagagucuuguuauguugcccaggcuggucuugaacuccugggcucaagcaauccucccaccuuagccuccccaaagugcugggauuauaagcgugagccacugcaccuggucaaggcccuauuuuauaguuuuacugucuucuuuuuugauguuagaccaucaguuaacccucugcccagugucuaucuagaauaguucaucuucacacagaugaaagcucuuugaggucuuugauaauuuuuaagaggguaaacagacaaagugcucuuggggcuccagggugggugcggugaggacauacaggaaacugguguggucauuccaacggaaggggaccagggugauguaggcacagguguugggcugggaaagagggguacaagaaaccaugauacaugcaaggggcuguaucagcagaacagggucacacgugggcuuggugagggcgaggggguugaggaugacacaggucuccaucugagcaaccagaaagagaccaggcugucagagaaauagccagggugagcagagaaggcaaagacaggcuccagccccuugaaucccacaaagccucagcuccgugaagcuucucaccccagauuccugcaaggagggcuucaucaucucuggucauaaaggacgccauaucuguucauggaaccacauggcucgcaaaagugacagaaggucaaggaagaggagaaagggaaacccaggaagcucuuuaagggagcaagccuauuuuuuuuucucuuuaugaaguccuacucguuaagcacacaggugguuuuuacucagaacacacacuacggcgugaacacuguugucacugucacuccugacaaugagagggaguggugaucagaugcugguguagacgggacgagcuaggcaggggcaccaugacagacaccuaccgcccuucaagucagcagaugcccccacauacugaaaguuguccauauuaaugacaucgaugaugggugacacaacccgaguccuguccuaaaauacaaagagaggaguaguuaucaaaaucccagcaaaacaaaaaaccugcccaaccacagaaggcauuaguauuaggcaggcacagggcaaacccaacuggcccuuacuaccuacuacccuaggcccucaagaacccagccuccccacccagacccagaaggucuugcucuuggccauccacagaugugcuguggccugcugggaggcagggagggaggucaggagugggugcguagcaggagucacucuaggaguggagacacccaugguuaugggacagguagccaucaguucacccagcuaaaggcaaaaacuguguugcugugucccaaggguccuuuucuguuugcccaaauaccauuagugauuugugagcugcaguaaacuucaggaauggagucacugcuaaaaugcucauacaucaaaauuaggaauauauuucuaugugggagugugugugugugagagagaugugguaaguaucaauauuaucacagcagaagguuaaccaaaucaaccagagauuuccagauucuacguuugccucaucuguaauucuaucuuuuuuguuuuuuuguuuuguuuuuuuuuugagacggaguuucacucuuguugcccaggcuggagugcaauggcgugaucuuggcucaccacaaccgccgccucgcggguucaagugauucuacugccucagccucccaagcagcugggauuacagauaugcaccaccacgcccagcuaauuuuuguauuuuuaguagagaugggauuucuccauguuggucaggcuauucuugaacuucugaccucaggugaucugccugccucggccucccaaagugcugggauuacaggcgugagccacugcguccagccccugugauucuauuaaaaaaaaaaaaucccccuagauugagccaugucuuuaugccacauugccaucauucugguaagaguuugugaacauaaggccuuuuaacaucucuaaccucuuuaagcucaaaugacggaugcuggugagagacccuggacugugccccaugcugacaguuaaccaaagagcaaguguuuucccugagccacuuagagaacccuuauuagccagaagaaagauuuagaaauacaacuuaguaacagaaccagcagagcuaagaacauacuacaucagaggaacaggugaaggaacaugcuaauuaggaacacgcaaacacugcaaagcucuguaacacccaggugcaaaucuacagggaaaaguaggcuguguggugcauugagggcagagaagaacacaacuuuccuugccuggcucagucugguucuagguguaugaguuaaaggauauaaucuacuuuacauuuuguuucauaaggcucaauuuagugaaaguuaauaggcuuggcacuuucucuccuuaauuuaggagcaggcguucgaagcaguucugacaaucugaccacugagcucggugaccuucgcacacccaaacacugccauggcaguuuugguuuugacugcgcuucccugagagacagccuggcggagcguagccagggagagcaagaaguugugggguugggguggguggggauuccaggguggguucuucuuggauauagcuguaugcacauguguuaagagaggggcucagauagggauuuaaugaaacuggcuuugcaagccuggcucugcuaccuguaugauuuugcgugcauuauuaaaguucccugaaccccagccuguuuaccugucaaacggagauaacaagugcauuacagguaacauauaaaaaaggccuagccccaacuugauaaaggguaaugaauaugaucuucauaauuccuaguagcuugugguuacuuaguauuccaugacucacagcccaucagcuauccuugcuaugcuuaggcagaacuacuuguucauuuucuauuuccuuucauuaaguuugcuuuaucgcccccaaggaagugcuuucuuaguaggaaggaaagaaaagucaauaaaacaagcagaaggcgagagaagugaaaaaaggccaaauguaauauuagcaaugauguuucuagaaagcagaaggugcagaaguggagccgcggaucacccucugacaaccccaccggucccuguaugcuuccuagccacaacccucucccacaggagccuggaagccugcugggcuaaccugcccuacucacuaagagcagagagguggccccagggacagcuuccccagcacgccccgcucugcgagcugcaagagauggcacuugcuaggugccgggcaauguucuaagcacucugcgaagcuguaggcggggaaggaaacugcucccaugaaaagggcugccuucaacuaaucaggcucucaccagccucugcugauccucgccuccuaccugucaacggaugguuccuccuacugauggauuccuacagccaguaaaacagucuuucuacaaugccccaaaggcauuuuccuucuaucaaggaaaacugcagacggcgagcucagccccuaccagcccugacgcccuacucccugcguuacaccuccccuggaccaugcucccuucuguccccucuaccaaccacccacgaccugacaccccucccagcccccgucaucucaccuccgccacccuuuccaggaggggcuccagccagugcucauuacacucgcagugacuguccaggaaggucaggaccuuggcuugggcagcaucggccccccgaacccgugagcgcaugaggccugcagaggcgaguuggaaagcacgucaggagagagaagccacagggccagcacaaccccaugccaaccggcgacgccucccugcccgcagcucugcagccugcuuucugggcacggacauuacuguaaacuugcuggaugagaucaaaacugcuccaugagacagacuauugucagaacuuuuaauuuuaauaguuauauuggaugacugggaggacaacguucuuagaacuaccgucuucugagaaaggcccuuuacauuacugaagucuccuuuaucaacuaaccaaaauguggaacuuuuauaacuacauuccucugacacagcagcaguuuucuaacuaacugggcuaaggaaggugucacccagagacuuccagugcuaaugguguugauuuuaguggugauaauauuugcaacaguguugugacuaucucugucuucuaagacuuaucaggagcuaaauaacauaaguugcaaagcccugcugucugccuuuuacacaaaauuaguuauacuauuggucaaauucuacaauuuauauacuugugauguguuaauaaugugcacguucauuaugacacaaaauacaaauaguguauuucaaaaaucagccgugggugguggccugugcgugcgccugugguucuagcugcucgggaggcugaggugggaggaucacuggagccugggaagugagccaugauugcgccacugcacuccagccugggugauaagagugagucccugucucaaaauaaauaaaaaauaaaauaaaauaaauaauaguauauuuaucccuggauguuguggucauaaauggcuuuugcuauauaugcugggcuuucuaugugaagaugaugcaacuauucauaaccggugaggacaagucugcuaaguacuuuuuuccacagucaaaauggguuuucagugauuccuauguggcuguaugcuagaacagggaaaaagacuaaagauuuuaaguugugauaauugcaaaacaacuuguauggggcaaaccuuugcuccaguaacaauuauaaacucugagcaaaauauaaaaagcagcaauuugaaagccagaagcagacagaaacuagauaggauccaaccccuuaaaauaagaaaauaacacugaguaagcuccguguuuauacggcguuuuccacgaggaugcgcuccaauccacugcaauguagccuuuuuuggcuugaguuguuagaggauagagaguucagagcuucugguaucuggaaacugaaggagauccuggaaaggagguaggacccaaaucuggcaauaaccuccuguuaaaucuuuggcugacuucugaaccacacaggaaccaaguccaacaugaaaagcaacaguuaagaaggcagaaaaaacugaguuucagcugcuaucuacugcagagaaaacaaaguuuggaauuugaguucugccaagugugacaugcuugguaaagaucucaguucuucuacaggaacuucagaaagaccacacauaggaauauagacuauguaucaagaauaagggacucauaaaaacaaacucauggccgggcgugguggcucacgccuguaaucccagcacuuugggaggcugaggugggcagaucaccugaggucaggaguucaagaccagccuagcuaacauggugaaacccguuucuauuaaaaauacaaaaaauuagccaggcgugguggcgugcgccuguaaucccagcuacucggcaggcugagguaggagaauugcuugaacccaggaggcagagguugcagugggcugagaucacaccacugcacuccagccugagcaacaagagagaaacgcugucacaaacaaacaaacaaacaaacgaaaaaaaaaaaccauacucauccuagcaaaguacaaaaagagccuacagaaguucagcaucaucaucugguaauuuaacugcccaauauaacaaagaugaauacucuuuagagaaagauaacauaauccaguguuucuacaacauaucauccacaaugucaauuauaaaauaaaaaaccacuacacaugagaagaaacaggaaaauggagaccacaucaaagagaaaaaaagucaucagaaguucacccugagaugacccagagguuggaauuagcaggggaggauuuaaaagcagcuauuauaaauauguuuaauaacucaaaggcaacaauuuuaaugagugaauggguggggaaucugagcagagaaauaaaaacuauaaaaaagaaucaaauggguauuccagaacuuaaaaaugaaauuaucugaaaugaaaaauccacugacuggucuuaguagcaaaauggagauggcagaaugacuagugaacuugaagauggaacaacagaaauagauccaucugguggacagagaaaaaauuaagggggaaaagucuagucaucuauaggacaauaacaagugguauaacauaugugcaacugaaguucaagaaugagucagaaaaaaauacaugaagaaauaaaaggccagucauuucccaaacuugguggaaaacaucaucuuacauauucaauuuacaucagcaaacuugaagcaggauaaauauaaagaaaacuaaaucuaggcacaucauaaucaaauuguuaaaaaaaaaaaacagauauagagacaaaaagcagccagaggaaaugacccauaacauacaaaggaacaacaguaugaauuuucugagacagagucucacccugucacucaagcuggagugcaguggcacaauauuggcucacugcaaccuccgccucccauguucaagcgagucuucugccucagucucccgaguagcugggacuacaggcgcaugccaccaugcccggcuaauuuucguauuuuuaguaaagacgggguuucaccauguuggccaggcuggucucaaacuccugaccucgugauccgcccaccucggccucccaaagugcugggauuacaggcgugagccacugugcccugccuggagugaaaccuuuaaagugcugaaagaaaaauuaauugucaacucagauuccacugaaagaaaauagccuccaauaacaaaggagaaaaaaauucuucagauaaaaccugagauugugcugccuaugagaaaaaauucuaaagaaaauuauucgggcuaaauaaaaacuccaaucuauggaaagaaacaaagauacuacaaauggaaaauaugaggauaagcuuaacauauccacauauucuucucuuuauuuaauagauacugacuauuugaaguaaaaauguaacaguguauugugggguuuaagauguauguagaagaaaagcaugauaacgauaguacauaggaagggaaauggaaaugcaauuuaacuauuguaaaauucuuaaauuuaaagugguaugauguugacucuuaagcagacuguuguaaguuagagcuguauguuguaauucucagggcaacugugcauacaugaaaaguauugcugaaaagcuacaagaauaauucaaauggaauacuaaaaaaaucacugaauccaaaagaaggcaagaaagcaggaacacaguuacaaaaagcaaaaugcacaugguacaaauagagaagaaacagccgaagagcagacccaaaccuagucacaccaaugauuacgccacauguaaaugaacuacccucaaucugggugggcacaaucuaaucagcugccagcacggccagaauaaaagcagacagaaggauguagagagacuggacuggcuuggucucccccggccuacaucuuucuuccacgcuggaugcuuccugcccuugaacauuggacuccaaguucuucagcuuugggacuauuggacauucaaccacugacugaaggcugaacugucagcuuccccacuuuugagguuuugggacuuggacuggcuucccugcuccucggcugcagauggccuauuguggggcuucaccuugugauugugugagucaauauuccuuaauaaacuccuguuuauauauacaucuauccuauuaguucuguccuuuuggagaauccuaauacaaaagccaaauauugguucuuuuaaaaaaugaacagcgucgaugaacagcagacagauaaagaaaauaagaagauauaaauuaccaaaaucaauaaaauaguaauacuaauccgacaaacaguaaaaaaagagacaauaucauaagcaacuuugagccaauaaauauaaaaacguugauaaaauacaaaauuucuugaaacagacacaaaaagaaacagcagaucugaauacgccuauauccauuaaagagauugaauuaguuaucaaaaaucuuuccauaaagaaaauucuugguccagacuggcuaauucuauuaaacauuuaaaaaagaaauaauuaaaauauuauacaaacucuuuuagaaaauaaaauagaagggcacacuuuccaucuuguuuuauaaggcuaguaaaccauaaugccaaaacuggaaaaauacauuuuaagaaaauuacagaccaauguuucccaugaacacagguauaaaaauccuuaacaaaaauauauuaaaaggauacuguaucaugaccaacuggggcuuaugcuaggaaugcaaagcugguuuaacaucugaaaaucaaccaauguauuucaccauauuaacagauuaaaaaaagaaauaccacuugacuaucuccacaaaugcagagaaaaagauuuaucucauuauuaacaugguuuugguccuacuauugucauuaaauagcuguaagggccuugagaaagccaccuagccucuuuagauuuaguauuuccaucuguaaaaugaaaguacuaggcucucaacuuccacuguacaucggcaucauuuuagcagcuuuuaaaaaugcagcugcccacaccccacccagagaaauccagaaauuucuauuuaauugugaaugagggcaagacaugguccuaaauucccuaggugcuucuaauaaauugcuagguuaagaaucaaugcacaauaaaauccacagaagaaugauccuaagacugcuuucacuaccauaauauuuuaggcaauuaauuuacuuugucaucuaguagcaucacuacaagcacuuuguguguaugcuuacauagaugggaucuuauacacacacauggguacauauauacaugagugugugugcaagugugcacauauuuucucauucaauuguuacagacuucagcuguuccauauaggcuuuccauaaucuggcuucucccaacccacccuucucaugccuuccccgaaacaacguaucagcacggguucaaccgaaaugaacauucuagcggaaaguuaauacugagaagcauuguucugauuucuaagcaguuuaaagacaaagacacuguuagauaaggcucauaagugauuuacagugccaacacuaucucucuuuccuccuuccccacuucucuuuuuuuuuuuuuuuaaagccugugccaggugaugggguaggauggcagauacuuuggguuuaaauucauaaaguuauuuugaagguguuuagggggcagcaaauugcccccuuuuugguuuauuccaggcuugguggacugaugugagucuggcaaacagcuuguuuagaaggcaaggcuuaucccacuguuuauguaucuugaaugucuagguugaugacccuaguugguuaaaauaugaugcuguucuaacaggcucaaucacuguguuggccaauaagauuccugguaagaaaaacuucacuccuugacuccagcuggagugcauauguaaugagaagaaagaguuuuacacugaugaaggaauacaaucaccaccccuggaucaacagucagacuuaaauagcaaauguggcauggguuccaaagcucugugauuuuccuauacugaaagauuucucccaaccauggaggagccuaacaauucagucuucagggucucuaacagcacugacacacuggauguuaauuacauugugauuggagcuuccuucccagacacuccaguguacuacuuuccuccuuuacagccucucuucuaacugccaauaaaagaguccucaugagcucagcuccagcacagauaagacugacagaagguuccgagguuggcauuugcaaaaucgcaugagcauauaauugcaguacugucuccccauuuuggaugguucaccuucagcaggcugucaaacuugaaucccgguuauuuuaucagaugccuggagcauggagucauucaacuucuuauugcuaaaucuuuguuuuucuucuaaacuuuuguauucaagggacugauaagacuuccuagguugugaaagaaagaagccaauuuucuaaauacauaaaugaaaauguaauuugauccugcucuaauauacuaauaauuucaauuagucaagcuuuuaaugucuuuccuguguuugcugggagaagucucccaagcggcucugguagagggagacagaaaaaagcuagacaauuaauugcucuuugagcuaaagcacuucuuuauguuauuacaggaaaagucagaauucaacugucuuggcgcugaauuaagaagaaucuuaccuucucgucgaucauuucuaagaacucgcacuuucucaauuuuccccaagagagccccguccucagcuaggaaaagaaaagaagcagagcauuuugaaccuggaguucauaaagggcuuugcauucaaccauaguauucucaaucaucuaagggccgauuaucuccuuggggcaucacagaggcaccucuucuuucuguggaucugauuucuggcuuguucacgccucauuagcacccccacuacaggaagacuggugcccagagaagagccagacacagggauaaaaucagugucaguacucacgaucauugcuguagucauccaccaagaugauuucuuuuaugagauggggcgggcuuuucuuaagcacgcuaagaaaagacaagaagauaaaguuuauaggucuuuuagggguauaaacuuuuagccugggguagaaaauucucauauguugguccuaacccuugguuggaggagcuacacacugcacccugugcugagcagucaggagacccugucugcagcccccacugacagcccuggucugacugugccugggacacagcuaaugucuuaacaccccugacagguaaugcaucuccuggccucaccugaccacgguccugaguagggccgaccuggcuucauugugaaacgugaucaccacgcugguggccggcagauccacccgccacugcuuccgcugacaccugcaggaagagaaagaugguccucugaacaaugacccccagagcagccacagcuuguuuagcccuucagagaacaggcagacugaccaacugggauggacaugcuaugauuaacuuguuaucugcagaaguuccuggccuguucugagaugaacugccaacgggacauaaggaaacagaaaaacacaaccggaguuacguucugagagaugaacgauuucggcaaaaaguaacauauugagaacaucuuucuaacacguuaaaaaaaaguguuuuaaaacagugaaaucccauuucuacucucaagcagauacaccucuagagaugcgcuuuucacaauuugcagucguaauuuccgaagggcagaaccaacugugcgccacugcucuuuucuuguuuucuacauugccuacaacaagcaugugguacuccggugauauuuggaacuugguucucaccacgaacagcagacccacuggagguuuucccuuccugggacagcagggaugcaugucccuugcccuggaaggccauccccaaauaccccaaagggcaguggugagaugaagauggggagauggagugaggguacagucaaugggacccugagccugccugagcucuccucuuccagcaguagggaagaacccugggaucaccucugcacagaagcugauucagaggccagaccuacaaagcaggugcagauuucaacauggcaccucucaaauuugggcucuacagacagacacaagacuagaagaacaguaaguagcuuuuuuuuuuuuuuuuuuuuuuuugagacaggguccaacucugucacccauccuagagugcaguggcauguucauagcucccugcagccuugaacuccugggcucaagugaugcuccuaccucagccucccaaguagcugggauuacaggugugccaccacauccagcuauuuuuuuuuauuuuuuguagagaugggggucucacucuguugcucaggcuggucucgaaauccuggcuucaagcaauccucccaccucagcuuucugaagugcuaggauuaccggcaugagccacugugcucagucagaauagcuguuuuaaaaaauagcugauagcuauagguggaagaugcuaaaguaucauauacuagaaauaagcaguaaagguuuaccgggcucagcagaacccaucaggaggaacccuucaaagcagggucuacagaccuaagagcauccuaguacagagcaauguucccagagaauccugagagaacaacacaccugggcaggacugacagcccacgaggacuucuagaaacacuuaauuucugguuugacuccauucagaguuacuaaauugguaauacuacugauaccagcuuggaaaagaggcuuugguuucagaaaaaugguucuuaaauggugauguugaugccccguggucuugaggaugaacagucuugccugugaggcggcaagaggggccuguuugucugucccaugccaagguuuccuccaugcuggcauuuauuaucugcacaauguuccugcaacucuagcaguuaaacacacuggcaccggaauugaagcagcagaaaaucuuugcuggggcuccgaaaaugauaccccaaauuauauugcuuuggcaugcugagugcuuugaaagaaggagauucacagaccucagaaauaagccucagaaccaaggucucucucugaccuucuccuccccacccccuccaacuucccuucagaagcacagggagggacuuugucucaaguucucuuaucugacugagggaaguucauccagaagaugugcaauugucuuggacccccucucuggaaucuacauuaaccagagauuaacucauauagcagaagaaacuaaaagcccacaccaagaccccacucuuggagagccuuuucacguauucuuucaauuauucuucuaaaggcugucaccugagagauuuaucugcaugauaaaauaaccucuguucacaauagaguucugccccucgccuucccauaacuuguugccaccuccccgagacccuguggaggaaauuuguucccggcuauugucugcauuuccauccuaaucaucuccccuaaacaucauuuacucuucuaaaauugccuacaucccucacuugccucuccccuaugcagagaguauuuaagcuucaaccaucuggcccuucuuugagucucauauuuuguguggcuccugugcacauuugcacauuaauaacaaauuuauuaaucuauugucaguuuauuucagcugacauaaagauucaaaccuucagauggggagggaaacauucccuucacucuuaugccuuccaggggaccaauacauuaaaaaaaaauuauucuguagguuuuuuuuucuuuugagacggagucuugcucuugucacccaggcuggagugcagaggcacaaucucggaucauugcaaccuccgccucccggguucaagcgauucuccugccucagccucccgaguagcugggacuacaggugcccaucaccaugccuggcuaauuuuuguauuuuuaguagagacgugguuucaccauguuggccaggcuggucucgaacuccugaccucgugaucugccugccuuggccucccaaaguguugggauuacaggcgugagccacugugccuggcccuaauauaagcccacuguagcucuuaauauuguuugccagagccaugaauuaucugcccccaaaauuagagauaauaucucagaugggaaaucaguggacgaaggagauagauuaaaaauauauauauuuggaacucagccaucgcuaaaaacauuuaaggaguuaagaacuaaaguggauggucuagcagcugccaaacaaugaccagcaauuucacagcaauggccgcaccuucagagaaagugcucaacagacacucguuuucccucgugacuacuucagagaagugaauuuugaaaauaaacaugaaaagcagugcaauuaaaaagcaauuaggucagaaucacaaaaugggcuucuuuuauuauaguuauuguuuuaauuaaucaugagaaauugcauaauauacuaguuuuuggggggaaacuguucacgguugucugggggaaaaaagcaggcaggaauuaauaucgcaccucauuagagcuccugacaucuaagucuuuccugacaaguagacugacaggcugguuuuucuuucuuuuuuccaauuuuaagaauuagcagauuguuagauuaaggaagugagaaucugcaagacuucaucuguaaacaaauuaccaaagaauguccuucccaagaacccaaucuguaaugcuaaugaaauaaggacuccgcguuaggaggcagcuauccucugcaauuaggucccacuuaacacagcgggaauugcugagacgagcagaccuagguugaaugacuuacugaacaugagcuuaugcagcuauaggagaauuuaaaaagagacauaaggcagcauuuuuucaugcuacaucauaguaaacggaaccgauccaaucauguccuauucucucgguuuccuuuucucugcaggaagccucaucucccaggagcauuugaaagucucacggggcucuggaaacguuuuucagaacacgcagagcugcugcauucguaucauuuuauuaaaauucaucuacauauucauaaggcauccauuuuugcugagaacuggcauucaggaaacuuaagagggaucccauuuuuuaaggcaaagagagauaaaaaguaaaaacuaagaaauauuuuacaucccagaguuagagugaguguguguauguacaugaauuuagauaauaaguccucacauugagccaagaagguggggucggcuugaaacaugucuuuaaaaagaaaaagaauaaauuuuguauuuaaagagccauaucccugccaaccagucuucacuacuccagaacuagugaaagaacacccaauauaguaacucaacaggggagcuggcugccaggggcacuuucauacuugagcuuucuuugggaaucgaguagaaacugcaguuuauuugaagucagcggcaggaacagugugcaguaagguuuguucuaccagacgacgcaggcuagaagcagugacucugagaagagugggcgggguuucgggcugacuuugugggcucaaguucacuugaguguccaaggcucuggugcuaaugugaucauucugcaaacuuccuguucgguaaaauggaggcuuuaaaaacuggacauguaaagaucuguuuuaagaauccuuuauuuagcuuuaaauuucucugagauuagauggcuuucaguaccugaacucuugguuagcuggaaauggaaaaaacuggugaaucuaaaccaccacauuguauagagagucucucaggguagaagaaugacucugucuuuagggcagacguuauaccugggcuugaucaagacauugaugaaauaaccaaacgcaagcucuuuggacugggaagcuccagcuucuguccaauaacacagaaggcuguuucacgguguugggaggaacaaagaaauagguuuccuucucuacccugggcaggccaugccccacccucaccccaggugaccuaguguuuuugcaaagggcccuugguaaccuugguuacuguguaaugugugacaacuaacaucacuccucaucugugaaaauggcccugacgaucuugccugauuauugggaacaccaaauaaaaacgugugaaaaaggacucugaaaacugucaaggucacuuuaaugaaugcaggcuuauaauuugcauuuggcagcugugugucaauggugacugggaggucagaguggagcuuucucuagcaacuuggagaggcagccgaugagacaggcucugagacaucuuccaaguccacaugcagcagcggcuccaaguagagaauacacugucaguuaaagggacaaggguucccaggccugcaagaagggcucaggagaugcaaaggugggagaagaugaggaaacauauuuaaauaaacucucuuuaagaaggagaguucaagaaccucuacaaggcccagagaggggauguggccaacaguaagaccacacuucuuaugagauagccacgaagaccaaacagagggucaugggaaggaaaaacuccuagaugaauaugcaccaucucccugaacugcccuuguaauucggauuuuguaaggaaaauacuacacaacuuaacugauuauuaaguaagcauuaguuuaugccuacacaaagacaggauucuaucacggaagagauggggaauagauacugucaaaaauaaaaaaggaaaguuauaaacaaugccaagccuccacaggcacuuucuggguauccagugcuaaggggcaugcucaguuccucccugaaggaggcaggcacuuccaguggagucccucuaagggaguuguguguucugauuaggacuggaguccuguguaggagcaaaucugcuggcaauggggcuccgaaaugcuggucuccacagcagcuacgucuaacugcgugucuaugagcaggcauuugggcuguggcucagguucccguggaaaaacuccaggacaaacaacacgaggaucaugcaaggucgugguauuuccaagguccugauuacugugcuauguauuuacaaauuaucauacuggcagucuggauacauucgauuuguaaauugaguuugagucugccccugagauacaaaccuaguuuucaucugcaggcaaaaaacuaagaaaaaaaaaaaguuucuggguuugcaaagcugaggggcaagucuuagacugcaacaaauuuaccaaggcaaugagccuccuguggccucuuggcagcaacugacaucacuguguguuuaugugagugaaauauuucacgcauaaaguuuagagauauuauagaagcauccauguaccacucugcuugccaagucuuaauaucuugcaauacuggccuuugauuaaaaaaauuuuaaauaaaaugacacaugacaggaugacagggaauaauuacagcccuuaccucaauccucaucuuccccaggggcaaucacuaucuugaauuuggugcuucauuguuacuauguguauuuuaaauaaacuacccauguauguauucauaaauuauaccaagcauuuuucugcaccuauucgaaguuugcagggauggcacugugcugugacuugguguuuucacuuuuugggaggugcaucuguucugacacacacagcucuguuucauucacccucacugcuacacugcuuuccauuguagggaggaacacaccacacgucaucccuuuucugcugauuaucaauucucuccauuagaaacaacgcugcaguggacacugucuuuuuacacagcagagaaaguuucucugcauuauuuacccacaaguaggacuacuggucauacauuaugaaccucuucaacuugaccugacauagccaacuuaaucucaaguggcuggaccuagugucacuccugcccggaccugcaugagaucauccugcucuguauucucaccaucccuagguaucaccauguuuuaaaauuuugccaaccagauugguaugaaguagucaucauuuuaacuuucauguaccugauuacuagagaggccacauaucaucuuauaugcuuaggagcugacuggaugguuucugcuguuaacuguuuauucauguucuuuguccauuuuuugauuagguuuuaccuacuauuuggcuguaggaauuuauaugcucuggacauuauccuuugucagccagaagcauugcaaaaaucucuguggcagaugcuuuaauuuuguuuaugaugcuuuuugucaaaccuacguuuuaauuuugaguuuucaaacugugacccugggguaacaauguucaggaaaagcuuucuuaaccgaaggucauuaauauauugugaauuuuauuucaaauguuuaaacuuuuacaaaugcuuuuaacagguuauaacagguuauauauccuucauaaauauugaaggauuauguauauccauguauaucauggagaaaauuacaaaacauaagugaaggacauuaaaaagugcccaguauuauagaaauauuaguuuucuucaaacuaauccauaaauucagugaagugucacgcaggguuuuuucauggaacuugaagagcuuauucuuaaauucaucaggaaaaucaaauggucacaaauauccacuggagucuugaagaacaacacauaguagggcaacaugcccgaggagccaugaagcguuacugcagagucacagugauuaaagcagcgugguaugggugcaggguuacacacacagaugaccagaacagaaauggauguagacaaguuccaugcuauccuucauauauagaugaaggagauccauaaucucuuuuuuuuucuguguagauaauccauuguccccagcaugauuuaauaguucauuauuucaucacugaugaguaacgccacugcugucacgccaaacacuuauuuaugucuacauccguuucuguucuggucaucuauguguguaaccccgcaccuguaccaugcugccuuaaugaauguggcucagcaguaacucuucauggccccuacuaggcgaagaucuucaagaugccaguggauauuugugaccauuugcuuuuccugaugaauuuaagaaucagcucuucaaguuccaugaaaaaacccugcaugacacugcacugaauuuaugaguuaauuugaaggaaauuaauauuucuacaauacuggauauuuuaaaauauccuucaguuauguuuuacaauuuucuccaugaaagucuugcacaucuuugguugcauuuauuccuccauaucugacaguucugcuugcuacagugaaaggagucucuuuuccuauuacauuuuugaauuggccguuacugauaccgguuuuuguauguggacucuguauucaacaccucacugugcucucuuauuuguucugauagucaguuugcagguucucuuagauuuuccacaaaucaauacaucuacauucugucccugucuuuccauucguuacacaucuugcaauucuuaagauggcagugauuauggccugcaacacaauauacaauuuuuaaaagugguaaaaaacaaccuugccuugauccuaucuuuaaauugaacacaagcagauuuuuaucauuaagcuuuguguuugccauagauguuuuacagaugccuuucaucaggugaaggaaacucccucacaagugcugaauuucacugcuuucccuccugcauccauuaauaugaccuacagcuauucuccuuuaauucacugagaagauauauuacauuauuuucugauauucaaucauuuuuacauuccuaaaacaaacucuucuuguauauauauauauauggcuguauuauauagcauauauauauauagcuguauuauauagcauauauagcuguauuauauagcauauauagcuauauuauauagcauauauauauauagcuguauuauauagcauauauauauauagcuguauuagauuugcuaguauuugguuuaggauuuucugagucuauaaccauaaauugaacaauuugcuguucuuauacuuucuuuuucugguuucauagcuagauacuacugaaggaaauaggguagcuuuccuccuuuucuauucucugaaacagucuggguuuuacgcaaacccauuugagcuuugugaaauuuugggaaggcaaauuuuuuauugcugaaaauuucuuuugaugguuugcacuuauucauuuuuuuauuucuuaagagacuuugguaacuuaaauaucccuagaaaauuaucaauuucauguaaguuucaaauuuauuuacauaaaaguauacuuuuaauuuucuuaugaucuuaguuauaucugcuuuuuuacaccuaauauuaauguuucuucucuauuuuuguuaaucagcauuuuuagagauuuauauuuuuuaaagaugaagcuuuauauauacucuccacuggauuuuuaguucauuaauuucuucuuuuaccuuccuuauuuccuuccuucugcuuucuuuagguuuacacccugcaguuuuuuccaccuucuucagucacagagugauugauuucagcuacccuacauaaggaaaaaugguuaaaaauccaagcaaauucuacagcuggagaaacacaggcaguuuucucaaccaugagaugggugagugaaauggggagggggagaaauguccgcgggugcgaugacuggcuccccuaacuuugggagagaguggcgaggccccugccucugagccaggucaaggcaccugccuccgcauguguucggaaagauggagcagcccagggagcccugcagccacguggaccuuuccuucuccagccaacacagcaccugaaagucugcgagucuccaugugcacccaucagccaggugagaugagccgagagagccugugggggcguuaaauuagccagcagggccagaaguuugaaaaaucaaaggaacauauuaaaauacagucuguugcuugcuagcccauuucuccauucauauacagauauucgguggcagggggaggguguuagcaccucaggaugcuggaaucaaggcucuggacacagcuggugaugcaauagaggcggugaaugccuucuguuuccuugcccucauccacagaaaaugcuuacgccauucccauuucaagggaaagaaaagggcaggaaggucuguuguuucacugaccauccuggcagccugaugcagcugcccauggacacagaauggacacagaauguccauauaugccucugcugugaagguggggcuccagccaggcuagagccaaccgcaggcugggcgcaugcuccucauucaggacucugauuugcuucugcgguaagggcaguugcuuuaaggccacagacuucugauuaucacaaagcucugacaguuuagugagcauaagacucauucauggagcuuaugaaaaugaacaugccuaggcccugacugcuucucccaucccauucugaauaaguaggucugggugauaccugggaaucugaauucgaaaaggccccugaaggcaaggcuuauacagguugcucuuagacuucauuuuaagaaacacacagaaaagugagagguguuauuagugaaacaguucucuaauguggagccauaauuagacucaucuggauaacuugaauuuagaccuggaacucugguauggaccauauagcacagagguuaaaaaaaaaaaaacaaaaaaacucugccuccuccagauuuugauuucccauuccuccucucuaccacaaucugacccccuguggucaccauacaugaaguggcccagcccacgcuguguuccucaaagucuaccaugacuaugaagccuaacacagagagagucaagccuaagccacugggaauaaggcccaacaugaccaggcugaaaagaucuagcccaagcuggagacuggauccaccacaaggcagaaggggccacgggaaacaggcccuccucaguccaaccccaaacugggcugcggaugcaucucucaaccucagggcacuuccacuagggcccaucccaaacaagauguucagcuucacauuuucaagauguguugcuauggugucuacagaaagucuaggcaggcuacuggauagaauguaaacuggaaauggaagccaaaaaaaggaaaauggaaaaaaguucauuagcuguuguauaauguucauuuaauuaaaacauacccuuaauaauccuccaaacagucauaauggcauaauauuccaccaaauccacuaauuucugauuaguccuaauagcuacagaguuuauuucuauagaggucuuucaaaacuaaacagaaccaaauccuaagacauuaaaaaaccucugcaggaccucugugaaaucaagcuucuuaaaaaucuggucaacaggagauuugaauuagcucaauuaauaacuuuagguuugucucacuucgaaauuauucgucuaaaauagcuuucuugaauaccgcaggcuucugcauucugcaacguauaggagucggaagcauguucuaaaacaaaauguuuauccucccugugacacaggaaacucaagccuaucguauuuacuguacucccuuugaaguccucuaaucucauugaaaagccaaggguuccagaggcaaaaaacaugcacacacacucaggccaagcggagaauccaaaaacacacucuucgcucaccaaacacuccacgcuucggcaccggccacagaaaaugcugcccagaauacgugaguauucuccaacagaaggggaaaaacauuagguuuccccuugaagcuuucagcaagccacuguuugauggaauaaaaauguuuuuucauucaaagagcaccauuugcccuuuagugccuccaguuuuacagacacuacauuuuagcugaaaacuuuucaagagucaagagcuauugaaaguugagaaaauaacagcccuggaugaagccgucugaacucucucgucaugcccuccgagggcugcacuucagcugccaggucccacucaccauuuaaggcuagagucauuucagagagacuaaauuauuauuguccuuuaaacuuucauuccucccgaugccaggggacaagcugccuuuucuggauggaagcucacacugcucaucagacaaugugaacacugcacauuccauuucuucccucuugcuacuccccugggacaaguggcacccuugguccugcuagaguaacuccaguaacucccucugccuccuggugcccaccaucguccucuuggauacgugaguucugguuuccaagcugaggguuuaguuuuuacuuccauuguuccaugaagagaugugcuuucauuuuuaucugcucugccugucucaaaguggugaauccuuuagagcacccuucuuagagguuauucaggcaguugguuuucuuuccuacccuacucuugcaguucuccccacaaaagcugggccagauaauggagucugugggaccccugagcaguucugauugucccaaguggacaggagaaaagcuuaaguucuguggagggugacauuuuaggacaccacucuuuucagauacacugaauugcucuguuuuggccugugguuaaaaagacgaacuuuucggcuaggcacaguggcucacgccuacaaucccagcacuuugggaggccgaggcaggaggaucaccugaggucaggaguucaagaccagccuggccaauauggcgaaacccugucucuacuaaaaauacaaaaauuuacccggugugauggcgggugccuguagucccagcuacucgggaggcugaggcaggagagaaucgcuugaaccugggaggcggaggcugcaguaagccgagaucacaccacuguacuccagccugggugacagaguaagacuccaucucaaaaaaaguaaaugaauaaaauuaaaaaaaaaauggcuaagagucuauuaaacuuuagaccaucagguuggcuuaaaaaucaaaauauauguguuacaaaagauaaaccuaagacaaaauggcauccaaaaaagaaaaaaaaucaguaagauacaaaaauguaucaagaguaagugaaauaaaguaggagauuaacauuuaugcaaagcaaaauguauggcaaaaaaggaaaacuuguucaaggacagccugggcaacacagugagagcccaucucuauuaaaaaaaaaaaaaaagaaaagaaaaacaaauaaagugggguaauuuuaugucaauaaggguauaauccaugaauauauaucuucuaagccccucaugcuuagaaauaagcagaaacuccuagcacuguaauguugaguuucaaaugcuuuuaucaauaacaaagguuuugaauguaaucgaucagguugguugaacauguauauuugaauuuggaaaugaguauagauguuacuagcuuuuaaaaaauacccaucaaauauucauagaaaugagaaguaaagauugcagccucugggggcaggcuguuguuuagaccucaccacagccugguuaauggggcaaguucuguuucucuaacuaucaaaucuuaguaacaauaacaacaguaccuaugccucauaggguugcugugagaauuaaaugaguaauguguguaaauugcuuagcauagcaccuggaacgaaaaucucaauuaaagguagcuacaucucaugcccaaaguaaaacccuccauauaugcaaaauaguaaaauuauaaaguuguaaugucugacuccacagcaauaaagucaggagaaaaaaaucuccaaugaccuaaguuuaaaaagauaaaaagaaaaaaaaaucaguuucuuacgauuuugaaacucuuuccuaaauaagcaacguaccaaaaaagaaaccaaaaacagaauuccagaguggugagaaauaauaauagcggucauuuacaaguagguuuaaaaauaaccaaaauuaucacacuauauuucguauuaugagacucagccaaagcugcacucagaaaccaauuaaguagacauaaaguaaacauucaacauucaacucucauggggcagggggagugcagaggaaagcagaggcaacaggcagacaugaaugcauuaaagagaaaagcagggaggccgaggcgggcggaucacgaggucaggagaucgagaccauucuggcuaacauggugaaaccccgucucuacuaaaaauacaaaaaauuagccgggcguggugguggacgccuguagucccagcuacucaggaggcugagacaggagaauggcgugaacccggcaggcagagcuugcagugagcugagaucgcaccacugcacuccagccugggugacagagcaagacucugucucaaaaaaaaaaaaagagaaaagcagugaaauguauauaaaaucccagcacuugaugucaaggaugaaaagaagacagaaguaaggaggagaaaccagagacacaucacuggcauuuuuaaagaagaaaaaaaugaaaaguuuauaauuaauaaagauuuaagugcauauacauauaacacuaugccaauaaauuugaaaauccaagggaaauuuauucuucugggaagauauaaaucaaauuaauucaaguaaagcauagaaaaacugaacacaugucaauauucauggaagaauuuuaaaagguuaucaaaggauuacuguaaugaaaauaaaaauagcucuaaguuuagaugacuuugaaaggugagcuccaagaaacaaauaacuccuuuacaaaucaguuuuucugaagcaucuaaagaaauuuaggaauuuguucuaaauucauuuuacaaaguuaacauaaucuugaagccaaagcuagaugaaggaaggaagacgggagagaggaggaaaagaaggcaggcaggcuggcuggccacagacacuuucagcuaugaaucuucauucaaaaccuaaaauaaagcaguagccaaacucagcaauauauugaguaaauucugguacauuuucagaaccaaauaacacacugucaucucaaauagcaucuccuuuuaaaugaguaagcaaggagguuauucgaaaauauucaucccaacguuagcauuaaaaaggaaaagaaucuagcaguccauuaccagagagcuagcuaaauaaacauaaaaugggauauauacagcuuuuauaagggaaaguuauauauuuaacaguccuagaaaauauuuccuauguauuacugaaugaaaaaaaaguaggcaggcaaacagcaaauacagugucauuuuacugucauuguauuuauagaaaaugacauacaucgaacaucagaggguaugagacaaauuaggaaggauguucaccagagacaaugugaagcuuucagacuuuucuuccugugugcaacaaacacguaucuacuuuuaaaaagcuuuuucuuuaaagaaaaaaccaguuuugaguaauucgguguauuuaaagaaaggagaacuuggggaguucaugauacaagcuugcuaacagcccacugcguagaccauuaguaucuaggugaaacacagaccaauucagagauuuuagcuaauauuuggccaagauaagguuugccaacaauagaaggcagaucauuagcaucaccgucacaucauaccaugauuuccuuagggcgggucugauuaagcccaagaauggaccaacccuaacaaaaguaccuucguuugauggcaccaccaugcgcuggccuccaggggaugccucuuugcagacaggauucuacagucaacuggguuaacugagugauuccauaaaagcagcuaccgagagagaucuaguucagcccacccagcacguggugacagugagggaguggcaaagccuaccaggagcuacgcugggugcuaaccaaucucaagggcaaccugugcaccagaggcccugcaggauaucaagcugaagaccaucccgggaguuucaacucccuuuaugcccugcuccccucaucuacagcauagcaacccaaaaguaggcucuggugccuccggagugggcuguuuaucauguggcagcagaaucaaugguauucuucuuuauuuaccuagcgaggguccauaauuccuaaucuuugauuccaacauuaaaaaaaaaaacaaaaacaccuuggaaaaaaaucuguaucauauuugguggcaaagccugccaugaucugaauuauguggcaguaaaaccugaccugaugacuguucuccugauuuaucccacuugguaugcauauucauguucugcugcaaaaacauuaguguguuugaguacaagguacugucucaagauuaaaaacauuauuucacaaauuguguauaugucauuaauagcucucuagauauuuuuuuaacaaucugaauucccuaagaauuuaagugaggaauuagagaacugucuaauuacagauagucucugucccaaagcaacuuacgaaauaccuggagaaaucaugcacagcuacaaaacaagaaagcccaggcacagaggcucugguuggggguggcaaggucucaagcaagggcagcaaucccauggcagggggccagucagaagcaguucuuuggaagaaucuaggcaaauuguguuuuaagggacacacccauuuagaaagguuuagaagggcaguggagaauaccaugaaugaagacagccacaagcacuuugcaaagaaugcccccacaucuggaaugcauccacgucagaagucucaagaaagguaaguggguggcggaggcaggaccggcuacugcaggccaucuaugcagggcccaggagggggauccagguguccucaccauagguuaguucuugugugggaggggcaugcagaauacaagccugggagagguacugagagaucugaguaggcagguccagugacucagaagggaggacaagggacuggaccaagaguggcaaugagaggaagggguuaauuugagagggaugccagaacagaaagccaccaaggccacuugggcagcucauggucccacgcgccaguacacguuggccaagcagaauuaggcaaccagggcauugcuuuauucuagcccagagcaacauacggggaauuuuccaacuucaacaggugacacuuauaugugaauaucaagaacaaguaccuuggccuuugcacuuaaagaauuaccaagaauaaaaaagauuugguuuaaagggccauggcaaagaugccagaggaaauucaaucaucaucauaaagaagaggcaacagauaacaaacccagugucccuuaagccagcgguccccaaccuuuuuggcaccaaggaacaguuucauggaagacaauuuuucuacagaugguggagaggggagaugguuugggaugaaacuguuccaccucagaucaucaggcauuagauucuaauaaggagcacacaacccagaucccuugcaugugcaguucacaauaggguucgugcuccuaugagaaucuaaugcccaugcugaucugacaggaggcggagcucaggcgguaauguuugcucauccacugcucacguccugcugcguggccugguuccuaacaggccaugugucaccacugguccacggcuuagggguuggggacuccugcuuuaagccuauuuugguaaccagaaauaccuccacauuuaaaaauacacauucagggauagauaacaaagugauuuuaaaaccauccauaaacauugacaaucucaacuguguaacuucuccccaggcuugccuccugaauuccagauuuuuguauaucuucauccaccuacuggacaguuccacuuggaugaaaacuucccuccuaaucuuuccagcaaugcuuccugaauagcagcuaguauucguuuaguacugacuaugugccagccacugugcuaagucacuuacagguguuaacccauuuaguccucacacggcagcccauaagaugaguauuaucaucacccuuaacuuauaucacgaaggagcuaacugacacgccaagaucgugcagcugcuaaagggauaacugggauuccaacaugggagaccuggugccagcauccacaccuuaaccaggagguuguacugcucccugcucagcaaaggacaaguccauucuucaaguugcuugguuaagaaacucaguggcauccuucagcccucucuucuucacauuccacauccgauucagcauaucuugucaucucuaccuuccaaaggcauccagaauccaaccaccucucaccaccuccauuguuaguccccuguucuuagccacugucaucuuggcuggaucacggcaacagguuucucugcuucuggccuuguauuucccaccccacccccaguaaaccuggucuuaucacagcaaccuuuuaaaaaacugacccuuuagaggccuaauucaggucaugcuguuccucugcucccaaaccuacaauggcuuccaucucacucaauggcugcuacaguuugaaugagucucuuccaaaauucagguguugcaacuuaacagccaauguaguggugacagaaccuuuaagaggugauuagauaaugagggcuuuuccuuugugaaaggaaugaagacccuuuaaaagggcuuaaugaagggaguuugucccuuuuuugccuuucugccuucugccaugugaggauacagcauuuguccccucuggaagauccacuguucuuggcgccaucuugaaagcagaaaccagauucucaccagacaaugugagcccugccagcuuaaagaucuuggacuucccaaccuccauacuauaagaaguaaacuucuguucuuuguaaguuacccagucucagguauuuuguuauagcagcacaaaacggacuaugacagagacaaagccaaugcccuuaccaugcgccuccaggcuccuagggcuuggugccuugacuccucucagaccucaccucuuucuacucuuccucauggccaccugccuagcgacucuggcuuccugcuguccuuuagauaggccuggcacacuaccucuuuggggccuuugcccuugccaccuccccugaugagaacucucuucccaguuauucaaacgcacacucccucgucccuucccucaggucuuugccuaaacaccuuccugucagugagaucuucccugaucaccuguuuaguacuaaaacccuugacucuuucacacuccuaaccuccaccgcuuuuuuuuucucuucuguauuuaacaugcuuuuuaaaaaccacauaauuaaugauuuauuuuauuguuuucucccccauccucuuaaugugagcucuaugacggcagaguuuuuuuuuaauguuuuguucacagcuguuuccccagugaccagaaaaacaccugucauguaguuagcacucaaaucuuugcuaaauaaaugcauaaauccaagaauaaaaauaaaucuucagugaauauaaaacuuuaaauccaaguacaauauuccuauugggauauuuccuuuuuuaaauaacuugaauuuccaaagagguguggauuuucucacauuauugucagaugaagaaaaucauggcuuauucaauauaguuaagauagucguuacuauaaaagucugaacuuuaaauuuuacagauggcaguggagauuaugggcccucauagguucuaccauuaacauuuaacaacuccagaguacaggccaggcaugguggcucaugccuguaaacccagcacuuugggagguaaaggcaagaggaucacuugaggucagggguuugaggccagugugggcaacauagcaacaccccaucucuacuaaacaauuuuuuaaaucagcugaguacaguggcgcacaccuguagucuuagcuacucagggggauggcuugagcccaggaguuuguuacggugagcuaugaucacaucucuguacuccagcuugggcaacggggugagacaacuccaaaguauaugugaauugucaguuacaccagugaacagaucgguguuuugacuuaauaaugaauguaccauaaacugacaaugcugcuucuuuuaaguucauuagaaacaucacaaguaaucuccgaaaccauauucaagugaaauacguagccuaaaugacaaaaaaaguuaaaauaaauuuuacaguauuuugacuguuuccuaaaauauacaaaacccuuccacugaaaaagaaaguuguucuuucaguuucaugguuccacgacggggggcaaagugauggguuuuaaauggauaguugaaguaggacaguuuguuaggacucgaagauugaucucauuuaucaagcaaaacucuguugacuccauuuuuccuggucuaauuucuuucugaaauagguaggaucacugcuucacagcuauuuccacaacuguuuuugguucuaugauaaaacaauccaauaccaucucagugugacagaggcauucacauacuggaagcugaaagucugccagccaugucacacacauuuugagagcaaaguguaacaaaauaacaguucauucuuuacuuaaagcugauauauauacaagccacuagucacuauauuaauguccugaauuuguguaauuaauguauguaguuuauguguacaucugagccuaauaaaaaugcuguaagacaggccaggcaagcaugauuauuguuuuacagauaagaaacccaggguuuacagagauuauuuuaaccucagucugggagcuaacagcugguugagcuauuaauaaaagcaacacaucccaacuucaagccuguauuuccauuuacucuccuucgagauagacauuauugcucagggcaaaauuuauaaacugccaaauucagaguggauuugaauuccaaauaaaacacucagguguuuuuccugcuuccagugacaguaaaguuccuugcuguagaccaaccuacucacuaaaagcaaccagaaauucgggaugaaauacacugaagaaucuauuugaaggcacuagagagcuagcaaagcagccaggugugaggucagguuuccagaaaggagaagcaccuagagaggaaggccaacauucucugauccucuuccccucaaacggcauagagccaaacggccgacugagccgagcagaagcgauggucuuguaggugcagagccaagugaaagcuucuggaggugcuguggagcuguggaggccagaaauggacuucagggcuugcugaggaaacugggcucugauacauaucccagacuuccaggucgaaucccacagggcuacuuccuaguggcaaaagagaacuggaaacucaccagcucucucacaaaagaccgaaacccagcuuuauaccagcucaauuccagacuugauuaaggugaccugcccuauuuuaacugccugccagagaacaaaacuaaauccucuuuggaggaaaaagucagugagagcccugaaauaucucgguauuuauucauacacaacaaaacacaaucacugaaaugaagaauucagcaguggauuuaaaagcagacuagacagagcagaggaaaggaucaaugaacaggaagcaggccaacagaaauauauccagacugagacacagggaaucaaaaagaauaaaaaguacagaaaagagcuuaugagggacagaggaaacgcagaauuaucuaacaaagaugaaauuagggucucagaggaagaggagacagaacugcagcauggcaaaacugacaaggcaugaagcucaagagucaggaaauuccacaaaucccaaacagguucagcacaaggaaaacaacugcuaggcauauuauggcaaaauugcugaaaaaaagaaauaucugaaaaggcagcuggaaggaaaagucaaaugucuucaaaaagaacaagacuaacgguagacauuucgccagaaacaacaaaaaacagaagacaacugaaagacaacguaaaggugcugacagucacugucaacccagaauuucacagucagugaaaagacucuucaaaaacaaaaguaagccgggcgugguggcucacaccuguaaucccagcacuuugggaggcuggggugggcagauggcuugaggucaggaguucaagaccggccuggccaacauggugaagccuagucucuacuaaaaauacaaaauuggccagguaugguggugggugccuguaaucccaguuacuugggaagcugaggcaggagaaucacuugaacuggggaggcggagguugcagugagcuuagaucacaccacugcacuccagccugggcaacaugagcgagacuccgucucaaaaaaaaaaaaaaguaaaguuaagauguuuucagacaaacaaaaggauacaauucauugccaacauacugggacuaauagaaauacuaaugaaauacagaaggaauauggucuuagguagaaaaauagaaauauaagaaaugaggagcaaugggaauauaaauaugugaauaaaucaaaaggauauuuacugcauaaaacaauaaaagauauccuauagaguuuauaaagaaagaauuaagcuaaaugacaacaagagcacaaagggcugaagguaaguggaagguaaauuauuagaaggucugugcauugucuaagaaguaauaaaauuauucauuuacauuaggcucuacauguggacuuacuagucaagaauuuagcaaaccaacagagaagaaaaaacguaggaggaugcaagggaaaaagaaacacaaagcagguggaacuaagagaacacaaccagugagauguugguguuaaaccccaauaaacuaguacuuacauuaaauguaaaagaacuaaauacaccauauaaaagauaaagauugucacagcagaugaaaguccaaaauccaacuauaggcuacuuacagaagauacacuuuaaauauaaggacauaaaaaguuugaaagugaaagcaugggaaaauguauaccaugcaaaaacaugaaaccaaagaaagauggugcagcucuacugauauuguaaaacaagaagcauuaccacugacaagaagugcauuucauaaugauaaaagggccagucuacuaagaaaauaacagaaacucacaaacaggucuaaaauagaaagaacagagcucuguuguaaauggucuagaggugguuagguuauccuuacuaggcuacguaauugccuguuuccuugucugccucuccgggaagacuacaguuucuugacaacaaagacgauccucauggucaucacugcauucccaggaugauggcagaaagaaaagacuaaagaguaaagaaagcaaaucacacaacucauuuagcaucauugugcuuuugcccaaaccauaacccagaguuacagauggggaaacugagccacacaugugggcagccacucagggguuaagcuuugagaauacguuugcuaaugaucuuugaaaaggagacuugaaacgggcccuucagagaugccaacaucgacacaaacgaaaucucuacagucaaaucaauacagucuacuuauaccagucucaaugcauucuuuaauucagacagagagaaggccugaaauagaccaaaaaaaaagaggaaacauaucaagggaagaaaaagaacggucugugguugaaaccagaaguugguuuuauaaagacacaaaaaauaaaaacaaaacauaaacaagcacgcugaugaauaaugacauggcuuuggugugaacugugcauaucagaugcaaguuacaaccugggaugaguuggugggggacccguuaagcaaggagccauuauugcuggccacuucccacuccccacaucucguauaucucgcugagccugccagcacccuuccaacagcaggcagagaugucacacugacaggcagagaugucacacugacugaacacacaagcagucucacuuccugaacggcaucagcaauguuccaagggaacagaaauagagugcacucuuccaauacauuuucuucgagaaucugaagcuggaaaaagaaaaacaaccccauuucuucuccauuucucagcaucccaucaacguguggccagcuucccuuaggagguuguuuggcugcaaguuaccaacacccaucucuuccauuuuuuaggugcauucaggccucaugccaagacucaugccuaaaagccgggaguaugaaagacccucugaagagcggacaguaagggagccacaacuguuagacagaacccugagcccaggauacagagugcuccaauuccuccaccagugagcccuguuagaacucaggcaaguggcucaccuuucucgucugccucauagacaagugauaaaacuucauggcuuaguaacuguaaaaucccuggggacuaaggcucucuagauacaagguggugccuuaugaggccccgggauauccuagcugccugccucuccccaaacauguuccaaccgacaaugugaaaaaugagaaaaacaaccucugcucugcaaacugagcucacauccugccgaaccugacuccugugugcaacucuucuacuuucuggaaguggggucugaguuccgagccuucugggaacugguauacgacaucaucagaaguauagcaucccuacccacuuuacaggagugugaugcagaguaaauaaaauuuuuuauuuuuagagauagagucucacucuguugcccaggcuagagugcaauagcaugaucauagcucacugcaaccacaaacuucugggcucgagugacccuccccuuucagccucccaagcggcugggaguacaggugcacaccaccacacuagaguaauuguuuuuuaagauggggucucacuauauugcccagguuggucucaagcuauccuccugcuucagccucucaaagagcugaaauuacaggugugagccacugugcccagccuuaaauaaaauuaaugcacacaaaaggcugagcaugggccuugauaccaaaaaauguucaaugaacugcuuuguuacugugauuauugaacaagcuuuuaaacauucacuguuacaccacacccaaacuccaccugccccacggccacaaaugccaacaaagccagaacagcuaagccuagagaagcgccuguccccaccugugacaccccguguggccucccaucuccuccaccaggacccuguggugcggcauacagaguuggaguugggcagcaaauugaugcgggaggagugggugcucgggccagcucuaccauggagcagcgguuccgucacaagaaucucaggaggccagcggcgcauguuuaugagacgccgcgagcugccgagaaguacaacauaaggacaaagcuccagcccugccugggucuccaaucacacucccacuggggagcuguguggauuucccuagaucuucugccccccuaaaaagaaaacucugaguccccuaauaguugccuuagccaaagccucccuccaagcuggcugacuuaaugcugaaaaccuucacuuggcuucagcaauguuuguucuuccagaauaagaaugggaaguuuggauuuuaucuuuccccacaauccuuaauccugauuagccacucuuaaaacaacugauaucaauacugacauuccagugagaguaaacagcacaacccaggccuucaaugucugcccucuuuaaaugccccuaaaaaauaaauaaaagaauacacccuuaagagcuuugaccuauguuuuggcuguguuaaaggcagacauuucaaaaguggucaaaauagaguucuuuaguaauucuucuaaacaaagggugagccacuauaaucuguaacuagaguaaaaacaacauauucuugacuuaaagauaaaccgauuagauguacaacuuggacacacuccucucaaagaagguuccuuuguagggaaaugguucaggcagugguauuucagcgugagacacaaaaauguuucaaaaccccacauuuuaaauguagugguggcaaggcagagaaaagcuuucuaauaacuaaacguuugaaacccaaaggaaaccuguuucuuuaacaagcaguucuuguuuuuaaaggauuuaaugaaacaagucaaaaggaacggugucuaguugacaggggaaagaagaaaacaaagaaaaugguuuccccccuaaagguugauuucauuuuacaucuguaaauaauuucaauguaaacugucccaaguuuucccuaguagagagaaagagauuucauaaacuuccuggguuccucuacuuuauuuucuuaucagaugcauuuccaggcaaaaacaaucaaaacccuccuggaaaggaguuuggaucccggaaacgcuccagccugacgacacucacuuccuaagcgcagcacacucuaaagaaggcaucaaggggauguuaccccaggaaccucugaaccagacaacacuggggagaggcuucagaagagcuuaagagaaaaugaaggcaaguguuacccaagucauuucaggaucuggcuggccgguccucccacuggccugccggucaugcuguaucguuuccacucuguauuagucagccugggcugacaauaccacagacgggaccuuaaacaauagacuuuuuuuuuuuuuuugagacaaggucuugcucugccacccaggcugaagugcagugcaggcucagccuccuaggcucaagccauccucccacuucagccucccuuguagcugggaccacaagugugagccacuaugcccagcuaauuuuuguauuuucuuguagagaugggguuucgcuauguugcccaggcuggucucaaacuccuggacucaagcgauucacccgccuuggccucccaaagugcugggauuacaggcaugagccacugcaccuggcccaacaauagauuuguauuucucacagcucuggaggcuggaagcucagcucaagguaccagcagaucugguuccuggugaggccucuuccuggcuugcagguggcccuguucugcugugugcucacaugguagggaaaaaaaucucucuuuccaucuuccuccuccuauaaggacaccuguccuguaggacagguggaucagggcgccacccuuuaggaccuccucuaaccuuaaucaccuccacaaaggaccugucuccaaauacagucacucugggguuugggacuucaacguaagaaacuugagggggcacaauucaguccacaacacacucauacuuccaugcggcugcuagucagagggacagagacuuccuguggggccuguaugggcuacaaggcucaggaggugauggcuuucaaccugcuuuugagggcuggcugauggagaaggcagguaugacucagagcaauaacagaaaaaacaaaaaaacaacuucaacaugcuuuuuuuuuuuuaacuaauggggggaaauaaguaaaugagggcuugacaggaagcccuguggccauuuggguaggacagucucuucaaugugccagaccaaccugggcuauacgaaauauguggcuucauugggcccuggugguaaaugccaggagcaccccacggguauucuaacaacccccgauccuccacccccacauuuccaucuucgcucuggguggguggcacagcucaaggcugagaaccacugaauuagacacuccccugaggcuccuuuuagcuucacagucgcauagcuucauaaaauuauaucuccugaucacgggaacacagccuaaaauaguacgcaaucuacaguguuagacuguccucaagugucagccguuggcuccagauucacagcuaaagaucucaauguuggaaucguccagggcucaggccuugggccucuucugucugcauccauucccuugggcuuaacacccagccucacgguuuuaaauaccauccauacgcugaacauuuccaaauuuacauucccgcuaagaccuuccuccugaacaccagacacauaucccaccaccuacaaaacagguccaccuacacugagcagcauuaacauguccacauuucccuacaccugcuccacucacagccucccuauaucucagcugaggagacugcaggucuucccuugugccagccacaauccuuggcacccucuuccaagccauaccccccuccaguccauuagcacauccuguuggccccaccuucagaauauagcccaccagaccacuucucaccaccaccaaugcuacuuuccauuaccuucugccuggacaguaagaacagcuucccaacgcagagagagagagaaaaaacaaacacuuacuacaaaaaagaaacuucagaauucccauugguuuaauuugcuuuuaagucuugauaauuuauuugaaauuuccaagcaagaagauuauuuuuuuaaauugagaaaccaugcagagaucacuguuagaggugagggauaucccaauuacccugacuugaucauuacacauuguagacagguaucaaaaucucacauguaccgccaagauagauaacaacuaugauauaucaauuuaaaaauaaaaagaaaagaaauggugcuuucaaaacuaggauggggcugaaugccguggcucacacuuacuaucucagcauuuugggaggccaaggcgggagaauugcuugaggccaggaguuugagaccagccugggcaacacaguaagaccccaucucuacaaaaacuuagccuagcgucaugaugcgcacccacggucccagcuacucaggaggcuggggcaggagaaucacuugagcccaagagggaaaggcuacagugagccaaaauuguaccacugcagccugggugacagagugagaccuugcagaaagaaaagaaaaaaaaaauaagaugggcuaucaucuuucuaauaucuaagaggaccuaauauaucuuauacauaguauuuaguauuucacucacagcuggcuuuugugugcuuccugauuccauguaaauauuucuucuugguacaauauauacaucuagaaagguaaauaaagcauagcccagaguuuuuuguuugucuguuuguuugggaggcucugaagccuuauuccuuguaucuauccuucaggguaauaagggguggauuauaaucgcaguuuuccaguccugggagaacacaaacacaaugagguuauuuguguguggcccaucuugaguucacaggaccuuuauacuuaaauaucccccuuuccuucuccuguauucuuuuaugauucuucauaucuugcaugauuuauugggcacucaauauaugccaggcacucugcuaaacaauucacucacucagcaaauacuuauugaauuuacugagugcccggaggugucugaauaacaacccuggauacaauaacucacuauucggaagaaaaaaauaaguaaaauacacaguguguggguggugagaggaacuguggagaaaaaucaagcaggaaagggggacgggaaguuuuggagugggggucaggggguugaacuccuagggaagauggucaagggauaccucacugagguggcucaggggaggggcaaccagcccauguaaacauguugcuuaaucuucauagguuacagauggaguaauguucuaucaucuuauagaugauaaaggucacagaauuaagaacuggagggucugagauuuucaacccaggucuguaggacuccaaacaccucauucuuaauuacccuccaccuguacugcuuucagauuuaucaaaacuaaagacugaauucuacugugcaagaauuucuauugaucaacacgaagguagauacugcagagacaaaaaacauuuuauacagaaaggucaaauucugaaauagcuccccauuagauauauugggagagaaauucaaagagguaacccaaucuucuuaaccugacauucaacaagaaugguaauucuagagcuuacacuuugagacauuaaaucggcucagcucuaggcauccaauugacuauggauagacuuuaauuuagcccaaauccaacaaauguggaaggcaucccagcugccccuuuaacacaugcaaaugaacaugacacacuggcuggaacuaaaauuaaacccaccuaaaaugcaucccacacugugggaugaauauucaaacaucuguuuggacaaacucauauuucaaaaacuuugaaaaaaaauauacguacauauaguuuuggggacuuuguagggacuugcaagggaggcagaugagaaagccagcccacaugcugaugagccaugagaaagaacaccauucuucucucagcucacaggguaaguuaaguauguaaagauaaaaucuugugggaaaacuagcucuuaacccacauggugaaaagaaauucagaccaucucauggagaugucaugccaagcagucgacugaagucaucagggaagauuucugcacuagauucugcuagacuuuauuccccugaguuuaggccaagcccuucuuaaaagcuacacggacgcuuucuggucuucagucaguagcucuuaaucacugggcaaguuaucaacauuccgggcaccuccguuuccucucuguguaugaagauaagcuucaagccuaucuuaaaggguuguguggauuacgugggugggggccggagaagcaccuggcaugggcugcuuggccugguuagccuggggaugggcuggugguggggaaguacacaccugggacccucuggaaaaagugaaggacccuguccccagaaacgcaccuacauauacacuugcgaucuugcacacagcuucggccucaacacuuucacaacaucccaaagcccaugcauggcucccuggagguccuuggaccccagguugucaccccuuauuuuagauacaguacuaaacaguuagucaagcugacuuuaaccaggacagcauaaggacugaguagagcuggcuuuagaaaagaaauuaauggaugacaggaaacauuaaucaaagacaaucuuuuggaguggaguuaggaaaaugaugagauucuuacuauuauauaagauauguauguuuacauauacucauauguaucagauauuaacacacaaacacacacacacacuuuuccauggcccuaaaaaaacuguaaagcuacauauuucuuaaauaugagcuggaauaggugaacagagcugacuagaacccaaagaaagcuguuaagaaaggaagcuccuggcaguuaacuggcaccuacacuguccauaaaguccuugagaguaagagagaaaaaucuucuuucacuguaugcagugugugugaauguaguuucacuggccauuugucucucuccagcucucccucccccaucaaucccugaaacuccagcccgugaaauuagacacuugcuggcucucugggagccccaugcuuuccuggcagggcuucugcacuuccuucuuccuggguguccccacccaauucaccgcucuugggaccuguccugacccucccacccuccugagugccucaaaaguauucaugcaaaguagacugcccaacccauggagcuacacgaccucacuuccuggugcaccugccaccccuagcagcuggaaugggaccagauuuuucugggugaaaugcuaggauccgagcacagagucugacauaugguagauguguaaucuauauuccauucacugaugaaugaaugacucuaacuuagcaggaagauauaccaagcacccaggaaaacagcugccuucaaaaugcagcuccuuauuuuuuaauaaucugaaacaagacuaauucacugagaauuccaaugugaaagaccucccaaucaagguucuuaucagcaaacuuacagguaugggauaacaaugaggguuaugcauaucacuuuccugauaaguggugacaaauacucuuuuuaaaaugccuaccaaccuccugagcugagcuucauagaccccaaaguacccuccacucucaagaucuuugaagaauaaaaaggggugggcaagguggagcaugccuguaaucccagcacuuugggaggccgaggcgggcggaucacuugaggucuggaguuugagaccagccuggccaacauggugaaaucccaucucuacuaaaaauacaaaaauuagucaggugugguggcaggcagcuguaauuccagauacucgggaggcugagccacaaauugcuugaaccugggaaguagaggaguagagguugcagugagccaagaucacaucacuauauuccagccuaggcaacagagcaagacucagucuccaaaaaaaaaaagaaaaagaaaaagaaaaagaaggaggucaggagagcagugguucauguuugugauuccagcacuuugggaggcuaaggcgggaggaucacuuaaggccaggaguucaaaaccagccugagcaaauggagagacuucaccucuaccaaaaaauaaaaauaaaaaauuuuaaauaaauauuaucuggauguaguggugaaugccuguaguccuagcuacucaggaggcugagaugggaggauugcuugagcccaagaguuugagguuacagugagcuaugaucgcaccacugcauuccaaccugggugauagagggagacccuaucucuaaaaauagaaagaaagauguggacaagagcccuuccuuuaguacaggguguggagauguggcaccugucccuccuguguuucugcucaauuuaacaucuauugugcuggguaguucauuucuccuuucuaaucuuuagaacauuuccaauauaagcugucacaauaagcaggaauuuagauuuucuuccuccaagguugggaacaaugacaaauuuugcauuuuugugaauggaucauaaaaauaacaagugaucacuaaauauaaagccagucacacaacucucuuucugacuuccacgcucuggccagaaacccacagccucugcacacugccacagggcaccuaaagacuagagcugaaucuagaaccauccuuccacugccuauggaugaaguuccauugccauauaccucaggauuuuuccuaguuuuacaacacacauucaauuucccagaguaauggagaaguucuagugucacaggugaaagcgacguacugguuugugugaaagcaaaugaagcugcagcaggugcuuagugggguacuuacuggucaugccgggugucagggauggcucuguccauucgaagcuuaucacucuccaccugguugaacuuguugcgggcguaaggguccugcccggagcggaccaucgucccuccaacauaagcuuccugguuaaagucuggccaccguacuuucccuaaaaagagcagagcagaggguagggaugagggaaaaugugaccaagugcucaucacagagacugcaguaaguguuaacuccagaaaucacauccauggcuucuuuauauaguggccauuuuaaacaacaaacuagcugaaaacagcacaagcaagcaucauccugucuacaacccagagaauaggaaacugcagguuugccauuuacagcaugaaaguuaaaggccugguguacaggcaucuguccagugaacaaaguaagaucaaaguaccuguaacuguggcaucauucauguuuucuauaaaaggagauguucucagcuugucccaccuuuccagggauuauaauguugacauuaucucagguagggugaagaagaucauguauaaacugcacauaagguauuccaucauguaacaucagguaacacaaaaauaaauguuuauacaaaaaauaaccccuaaagaacaggauaucaaaauacccuuuggugagaccuugucaagggguccuuuuugcagcuguuaguaugccugaccccacggggagaaagugaaggauguggcucucagagguguccucauaugcacagcaggggccuggccauuccuaacacacacaucauaccuguucucuuccuggaagaaaggaagccaaggcagccugccuguccccuggcauuggccugaacccuagaaugccaggcacaagguucuccaagaacacaccacugcacugaggagcucuacccuagggcagaggcaguguuggcgaccaaggagcauugagaggagagcacugcuaggcgagugaagucaggaugagcccagguguaauaaaggcagagccagagaaaugcacaaaggcaggaugcucaaacagcagaagacagguggaaggagaggcagacuugaagcaaggagaacauuuaugauucugugucaaccuggguuucaaucaagcaccauucgccauuugccaccuauaugaucucggauacgcuauucauuguuugaaauuaaguuuccuacaaaauaaguaaauagaauaacaaaagguucuucacgaggacuuaauggccuacaauguuccacuucauagauaugacaaacuaaaaaauaauaauaaacaccaccaacaacccugcucacaugaaacucauacaauuuccagugguuggaacugccaugaagaaacauaaggcuguuaugggggcagggaguacaggguuccuguucuuuaugggguggucugguaaggccuagcaagaugauuuugagcagauaacugaacaaaggcagggugugggcaugcaacucuccgggagaauagggcaccgcagugcaaagguccuagugucgacaugagcaugcccauucaggaaccagccaggaggccagugugacuaaggagcaagcaagagccuggccgucagagccaagguuggagaggggaaggcagggcugccggcagcuacacgaaacagggcagcaagggggagacagcucuuuugcagcgugucaacccuugggucgugcaguugaccuugaaaacacgguaugauaauagcauguguaccuccauaucuacuuucccaacagaaaucccucauuacacaauugaagggccauuguguuccuuucucuauuucagagaugaggaaacugagaaucaguuacauguaauuuguucaagacagaagaguaaauuuucuaucuaaaagcucaucugcuucuuguugcaaugguccugcgaggucagaacccccaucucaucacagcugguugccguggaaaugaugcuuggggggugucacagaagucuggccucucaaaucgaaaaucaguuccaaaacccacgagccuggcuacagcgaugauaccacggccccaauaaacagcugccugugggagccggccaaggugucagcaucuucuuaugccgcaaauaaaauguuuccaaaacauguuacuggaaacauguuuuccgugcaaagaccauccuaaaaauacuuacugauccuccacucucuccucaucuuccugccuucacccucauauauuuucaaggaugagaagaaaaauaacaccuaccugcgcucaagagcgagcagcuucuacuccucaccagugaguuuauccuuucacggacuaauacaaaagaggcuuugaagcuuuuguuaaaaucuaaaccagcagcaccuacggcagaauuccaaugagcugguucuaacaaacguauuuaauguccugaauacccugcaccacggaacuuugaacuauggaauaaagaaccaugacggagucccaugcgcagccagagaagagaccaccacccgagagagguuucauccuaccauguaacucugcuuacagccuacuugcuucucaccggcgugcuggggacagcaaagucugaggacucugguuggugugggccugugugcaaggagagcaguggccaugggauaaggccucugcacagcucuagaagcuucaaucccauuuccacccauacaucucuuugugcucucacacccccacagcccuucuggaauaagaccaucacagcacaggguuugcaagaugucuaaugccagucauucacagggcagcucagacccuggccugcggugcauacuaggugacuccacaugaggugucaugcuagauccugcagggagaauaagcacacacaggcccgugacccaugcuguggacuucauguucuaggagguagagggagacagacaagaaucaaaugacuguacuaggccgggcgcacuggcucacgccuguaaucccagcacuuuggggaggccgaggcagguggaucacgaggccaggcguucgagaccagccuggccaacauggugaaaccccaucucuacuaaaaauacaaaaaauuagccagacgugguggcaggcgccuguaaucccagcuacucaggaggcugaggcaggagaaucguuugaaccugggaggcggagguugcagugagccgagauugcaccacugcacuccagccugggcaacagugcaagacuccaucucaaaaaaaaaaaaaaaaaagaaaaaaaagaauuaaaugaccauacuaauaaauguaucaauaaaaacugagcuaagugcucugagggugaagaaugaagcaucuaauggagcaaucuuaucuagacugggaaaccaggggcggcuucccugcagaaagaauaucugaacugagauuugaaucaugaguaaaaaugaacuuggagaagcccuugaaacuucacaaaaauaucaucuuucuucagcacccaaagacuacaugagccuacugagcgguacccugcccugccgccuccuuugacacaggagcgucuucaacaggacccuggugugggcccugccuugucuuguggcaaucucccugagacacacagcuguuuuacuagagacagacuaucaacaguauuucuuucauaaaagcuuagcaguacuggaauacuacaggggcuuucaaguuugcuugacaaugacacacuuuuaacacugugacccaggugucacaaugcaaacauacacacccaacugauacaaaagucucacaauaccaaacuuacccucacuauaugcgaggaacagaucuauucuauuuuuguuuuagguaucucucgaaacuggcuucaccaccuaaugaugggucacaacccauaauuuggaaaacgcuaagcuaaagaaccauuacuaaaauugguuauuucuguacuauauagaauugcuagguuugaagcuacccccagaggcaaaggcaggaaaauccauggagaacaagguuugcagagggcacacgcgucccagcccaaccccacgcaaacagggacauggcgagagguacacagaguaggguaugagucagagguuagagagaaacagccacaaaacaaccaacaaaacgucugaauauauugccuuccuaaaaauaugacaugucauccauacaucaucuugugcuuuuaucaucuuuuuaaaaaucuuuaaaaauaguucuggaaauuaaacagcuuuagaaaauaaaaauauaugagaaucucgggaaaguggacuuggcuaagcagaagcagcugacggaaaauacuucaaagauauaacauuuuacaugaggaggcagaaacuagcuucaucaccaaagaugacaggaaaauaaaacauacauuuaaauaacaugagaaagguauuuaaauaacaugagaaaagaaagagagcauuauccuaaaaagggcugcgaaaaguuugcuuauuaaauaagguuaugaaaauauuuuugaggaaauuucuuuccagaagauagacuucucuuagauguggucuuugaaaccaaagaaggaauuguuugaccuuaccagccuugaaaccccugauucaguaaaaaugagaagcuuacagcugauuauuccgcagacagaacaagucaccugucugcgaccccaugccgaccuaccugggcuggaaugaggucugcgcuagucccagucaaacccucagguggucccacagacugcccugcuccacacaugcauggccauguccucugagaagcacugggcccacaagggucucacucuccugggcugcuguccugccccugccacuccucguacgcuccugggcugcuguccugccccugccacuccucguacgcuccugggcugcuguccugccccugccacuccucguacucuccugggcugcuguccugccccugccacuccucguacgcuccugggcugcugguccugccccugccacuccucguacucuccugggcugcuguccugcccgcgccacuccucguauugcuccaggcucccuuuccuacccaggugaagauggagcuccucaccucacagacucagccucgcccgcagcaccucagcaucccacaugcgcaguccacaagcaccuguuaagggcuuuacuacugagggucucguccugggucgaagguaccggaggcugaccgugaaaaggaauccaauccugcgcgugacugggaggaacgcagcuucguguuaguucuuacacaucucaucgcugcgugccgauacagccgcauaugagacgugcuguggucuugcgccggacgcuuacuccuacgccucuuucgcucguuugcaggcauuuuuuaaauguguuccaccgcaaagccugucagcccucccgagccugccugccccaucagucagaucgcuggcuggagcacgggggaacagagggugcagagcuggccaacagggguccaggccaaugcugugucacugauaaggauucaaggacuugagcagaggagcagcagaacacacacacgcacgcauguacgcacgcaugcacacacacacacagagcacaaaauccaagcaugagggugagccuggcucacugacucccucugacacucugguuuguauaaaauggaaauaauauuccacuucugggguuguuauaacaacuaaaugagaugaucacagcaaaaguccuacacuacuaacuauaaaauuaacugauauuuacaggcagaaaugaccgaacacaaacagaaugucccugccucucugauguaacccccuaugcccucacccagaaagggcugcugggaaccacccagccaccaggcccucugugacacccaugaggggugucccacucugcaacugaccccgggggggcgagcaggaagcauagagggaaucccugcuuucuuuauggggguccugugggcacugcccaggcgagcagggguacagaccugcggaugcacugaauucaugcccugcuguuacccacgaguaccucccgcccuccccauagcgcugugagaagugagaaggcggggccaguggaugauuucaccuacgucuacacuuguauccuuucauuuccaucugcugcucccaagaaacaccuggaaauaacaacucaaugucauucucugcuuguuucaggcagggggagaugcgagacaggucccaugucagguggaguguggaggaagagaggcuugcucugaagccagggguguuagugcuugaaagaggaauaguccagacacagcccacuacaaaauggaagugccaggggccuacucuaagagaaaauuaguuuuacuaucagccauaucaugaucaguuaggucccuagguuuuccacuuaagcuguuuuucacauuccuuggcgguacugggucugagaaacccaguucucaggacugugcagagacgggaagcaccagcccucugccccucaccugugcaugccaugggcaccuuccuuuaccauuuucuccugcucucugcaucacccagagggcuauugagggccacaaagccucugggggcucccacucagaugcggaacuucuccugcucaguggggaugggaugaggagaagcggggccugccugcugacagcagcuugugugcuggacggggcaagaaugcagaagccuguguccccagguggagcuguaccuucccaucuccugucaagacccacacccacccucucucaauccuaggguuggaagaauacuaaagggacgucucgcacuugccguccugaggaauguaugggugaccucauaagacagacauuuuauuuugggucuuaauuuuggagaaaaacaguccaccacccucuauuuuccccaaguugaucagaacagcccaguacagugaaaaugccaagcccaagcaaauguacggaaauuaacaaacaccucacuggaaagacccgccauccaaaagugaggaggagaugggauagcuccauaaccaagccaagguuccaagaaagccccggagaaagggcacuugggcugggucuugaagcgugagcaggagccugccagaugcaggaggcauguaacagaagacacccagagacagaagagacccaguagggagggacggcaggcaggaggugagggggcccugugcccaguggcugcaaauccucuagccugggcugaaguacuugaaccuuacuccccacauucuagagugcacaggauauuuggaguaaaugagugcugauccacuuugcacuccaggaaugugccucuggcuguggaacgaaggaugcucagacaggagacgaaagugaggaggcugacgacccuggugcaaguguguacagccuagugcacaucugcccccugcucaggaaggcccugccccuaucugaggauuguccccagccaaaugccaugucaccuccaagccagcccagccccugcaagccccaaacucacguccaggucucugcucaccuccggcuuguguggccaguggugccuccccagcgcucccuccuccuccaggaggagccacgguggaaucuguggcggugcgggcacagcaccucucaggaaggcugccaugcuuccacuaaccuggcuaauacuucauuacuguuuugucagucccaucggcaaccccagaagguguaccugggaacucuuacuaaagcuggucuuccuagccaugcccgcaccgcugaugcugugcauacuuacagauaaggcagggccacugcgauguaugugucuaccccuccugccagcugagcugccucucaauguggcuaccuccuccaggagcccucccuggggucccuagcugcugccucucugcacccucucucuuuucuuucuccucucucugcaagccucuuccugcccccucacgcagagcucuaucccaaccacagcuuuucuaaaacccucuugccagggggccuuauaagugcuuccacucuucugucuaauaacuugaaauuccaccaaggcuagagcucaaguuuaaccacaucuaacugccacugaacacagcaacaaacacagagacaaugguguuuguuccugcucugccggcaccucagugacucccaagucacuccccagaaauuauagccaccucucggguucuggcugugcccucccugucuugaccuugguccggacuuggagacacauucacugaaagccguuuaaaaugaguccugucucucuccaccugacucagacuucaauacccuucuaaccuuguuugcuguacccuuuucaguuuggagaucaagucuggacagagaagauggaggcccaaugggaacgggcaggcuccacuucuucuccccgcagagcugggaugcucuucuugcucucucuccuccccucguguccacagaccuaugcuugucaucuucagcacugaccccuccgcacgcacuggaauaggcugccacagcucucucugcuccccucuaugguggaugggggcccagcccggaagcugcuaagcagugcacuucaguaaugaaaaugaacauccugcuaagcccuacaggcguuccugcaacuuguucugacacuguucccagaggccuguggcacuguggggagagugucccuccccuccuggccaccucgcagcugcaucugaugucugauggcaaauggaggccaguccauuugaagggcugggcuaaccgcaagaggaagggagauuccuuguccauuaccuuuggacugauggcccuaaggccuucccuucuuaucccuguagccaugaaaaacaauguguacagucagagaggggaugggcccagguuaauucuucugccucugggagagaagggccaggaccuggagagacagagcagaccuacgguggccugacaaguccuggcucuggaccccugcaggagaagggggcccuaaggcuggugugggaggugaacuucccaccacuucugucugccgguccauucugcaggacgcaucccugcccacuguccugacuagccacuacccggccacugcucccuggguuacacagacuucaggcccagcaacuuuuucuuuuuucucuuccccaucuuugacuuagucggcaugccuccccacugauacucuucaucacacccgcuaucauucagggcacaagguuuugugcuuugcuacuuccuuggguacagaauuucuucucccucccguaacccauccaccaggcucugaguuauagcuaccuuuucagaaucuguuuuuuccugguuuaguuuugggaacuuuucuccccaucuuaucgaggcuggagagcaggacagugucccuugagcagagaguggcuggcgacuguaacgguccauggugccugggaguggaggcugagcauaggcacugaggccccgggaaggcugcucggggccccgccagcaucagcucuguggcugacacucuaggaccuggcugcagccagagacacagccagacagcgcuccuaagugccacucaggacaccauuuccaugggacaguucauucugggauccuaauaaccaaucuucaagugaacuuuuugaaaaagacgcuuuugucaucaggggacuacuugcauuuggaugacuuguucaaauaaauguugguuuaaaauaaugcuaccuuuccaaacaaugccacuucuuucuuaaaauuuuuguuuuuacuaaaccuuauauuugaaaaaaaaaagaugacagaaaccuauaaaacugacccuucaaagaauuaacaucacaaagcacaugaagaccccagcacacagaggcgcacgcacaccccagcacagagaggcgcaugcaaaccccagcacacagaggcucacgcacaggcacaugcacaaaugcggucuuuagaggacucucaguugcgacuguccuucagcagcagaucaggacauaugcucuugggcaaagagcugucaucuaccacccgcagguguacaaggggaggggagguaucuuccuggaugcaggucccguugugcaggaaacugagagucucaguggauucaggcugcaggaggcuucaggauucuauacagguauucacugcuguacugcaacucuucauucaaauccuccccaggaaagacagcuuaaacaaaucuaaagcuaccccacguaaaacagagcaaccgcugggaaagcagccaaggaagggaaacagaauguauuuaauaucaaaggacaaggcucucagauuuauuugguugaucucaaauugaauguaauuuuacugugcuuaaaagaaaaaaaauccuaauauucuuccucuagaaggucauaaugcuacaccaugaaagaaaagacgaggacaaggccaggauuacaaacaaauagauccauuucaauuacaaaggcccauaaauuauguuuuauuauuugucacuggauaugugguaucacaggaaauuuucuucaccugugagaaaccgucucuugaaauagggaaucccacacauccaugauuaaggacaaaaaaaccaggaaauccaaagaagugauaaaaagcuauuuaaaagaaaaccuaagaaaauaucagauguuauagaggaaauaguuuucauuuguuuaaaauuaucugugcuaucaaaacaacuaaaaauauaccacaaaacaguaucaaauugauaaagugcaauaaaucuucauguaugaaucauccuauaucucuucuucaaauuugaaaugaaaauucuucauuuuucguuauauguuguacuaccuaaccauaauaaauuuagccuauuguacauggucuugaccaaucuucuuuuucauccuaaauaucaguaauaauaucaaagugaaucuacugcccagaaucccagccaacagaugaaaaagacagaaggagagaaagacagcaucuguuaaccagugacuacuuggucugcuacuucauacaagaccuuguccacaccauaccauaaccaugucaaauaugaggguuucugcuuuacaaguuaggaaacuaaggcacagaaguuaaacuuauccaacauaucacagcuguaagacgauggaaccacaacucaaacccagguccuaauuaugcccagucuguguucccuccacugcacccgacaacucacuuuuaaguggggaaaauugaagcgaaacaccaaaaagcaacccugcaugccugugcaguucucagcugcccagcccccuuucagguggcagugccaguccugucuccacccuggagugacugagucucugacuuugagagcagguguuccugucucugaaacacuggcaucaccuguuguuggacucagaaggaacuguggacaucaucucuccaggugugaaaaucuuuccauuacagucccuaauguccagccacagcugaagaggugcugagcauggggagccccccguuucaaaaggcagcuguuucacuggacagcgagaacuguuggugggggcuuccucagauaaaaacaaacgcugcuuccugaaugggcacgguggcucacgccuaugaucccagcacuuugggaggccaaggaauagggaucacuugggcucaggaguuugagaucagccuggggaacauagcgagaugcugucucugcaaaaaauuuuaaaaaugugucuggcauaguggcacauacccguaguccuagcugugugggaggcugaagcaggaggacugcuuaagcccaggacuuugaggcugcagugagcuaugauugcacuacugcacuccaaccuggguuggugagacccugucucaaaacaacaacagaaacaaaaaaaugcuucccucuaauuucugcucaaauaaaagaaacagaagucucaaauaaaaagagaaaaaaagucuucagccucuuuuauaugguagccuuucaaauauucagacaucaugaucccacuuccccuuggaagcccuucuguaaaaacauccacaguuacugcacauguuccucaucggacacugcuuccgcuuccucaaaaucugagucacugucagccggacuaacucuaguuuaucagcaucccugaacacucugugcucugaagagaacuaaacacuucagcuauggggugggagcccagagaacacuggaugucacgugacugcuucuagacacuguauuucgacuaauaaagcuuaagauaacuauuuuuaaacagcuccauuacauuucuggcuacugaucucagcccuuggucuccacuuucuugcuuguuggaacaggagaaggacaaugaagauuuuuuaauguuggcuagaguaagaaaauaggcccccuguggaagauaaaauggcaacuaauauuaaaaaaugcaugcauugccauugacccugcaauuucacuuuuaggaauucauuucaagaaaauaaucauggacuuaaacaaagauuuaccucucaggauacuggcuggaaccccucuuuaugucccacaacaaaaaauaaguucaaugagccgauggcggucgagauguugcugccauuaaaaugcuauaggagauguuuauggaugugaaaaggaguucccgauauaucgcccaagcagagaugguacaccacagugcuguauuuguaaaaaucuagcuguaagcagaugguagggaacugcccauagaaaaaggccccguuucaggagagaagagagaggaggguggcccccgaucagggagucagagcccagagggggcucugaaagagagaugggcguguguggagagacgucucagcaaaucccccaaaucuacugaaaugcuagucaccuuguggaugaccugaauuuucauagaaauucacgaaaagauugaacuuugaaugugggauaaaacucaggaccuguugucagagaggccagaugcuucaggagcauuuggucccaggagccaacucuaagaaacugugcaaggccugaggcuucaagugcgugggucuuggcgcaucccaugcagaggagaccccuucgucucagcuaugggggcagcacacccaccuggguauacgcccagggcaaguauggaggaacacgcagugggagaggaauggugguuguuucuggaugguagaauuauguaugaauauaauuuucuuauuuuugcuuaucugaauuucuaaaacguacaauacacacauugcuugcuuuuuaaaagaugcuucccuaaagacacugacagccacuuauuuuccuuaugacaacacugugcagaucacuggccucaggccuggcucaugaagaacuacguagacuucgcuccccacaagugucacacgguuccaccucacacgacauguaucacagggcacaugguucacagagacacaggaagggaauucugacccacaacaugggugaaccuggaggaguuaugcuaagugaacaagccagaaauaaaggacaaguacuguaaggcugcacucauaugagggacccagaggaaccaaauucauagaaacaggaauaccagggccugggagagggaggaaugggacauugguacuacauggguacaguuuccauuuugcaagaugaaaacagcucuaauugaugguggugaugacugcacaacacugugaaugcgcuuaaugccacggaccuguaugcuuaacaacgcuuaaaauggcaacuuuaguguuacgcaucuuuuaccacaauuaaaaagauaaaugcacaaugccagaacccauuaagucaccuagaaaaacaaagggucggggaacacuccucucugaugcugcagcaaugcugaacaaauaacacaagugguuuaucucaucuuucuuccggcaggugggaaguagaaaagcuaaaacgucucuguuaggaucaguggcaauucacacccuggauuuaaguucucuuaacacauuucaucauucccauuucauucaucuuuacgugaacauuagcaauuucuguucugagaaauccacugucugggguaacugaaccaacagcacaucggggagggguggcugugaugaagacacagcccaggaccaggauggggagggggcucaaggagaauccagacggccuuaggacucuccuuucugaacucucucccuacccucgucucuccuaagccucagcccuuuacacaagguuacuaaggaauacaagaaugacacuaaggucucauaaaggcaaagagaaaaucugcuccaaaaggccacguugaccaaagggugagagaucuccaacaagaaccucaucaacagcuguccucagaggcagaccucggccuucuagccccuacagcugccccugcuccucuuccggccccacuccucuacuggccccugcuccucuuccggcccccgcuccuuugccaguccuucugccagcuggcuggcuggucagauucagagacaauuacagggagaaacuuauuuuucaauccagaaguuuuuccacaccaaggggaaaaaaugacauucuucucuaucagauagauuuccaaaauacaaaauauugacuaauauacauacucuauuugaagacaauauuuuaaaaaccaacacugaaaaaaaaaauucagugguuccaaguagaaagcaugaugcugaaauagaagcaagggucacagaguuuaugggcaaaaacucauccacaguagaccugaaaugugguaugaggguggggggaacuacagagauauauuuuuacagcauguaaaagaaaauaaaauuggugauuccaaucugagaauagagauuaaagggaaaugguaagacacaguuaacagaaucaaagaguuuuagagcaagaauguaucuaaauuuuacagacaaggaaaacaaaacccaaauacuccuuaacuugucuaaggccacaggacugguggcacagcugagccuagagcucccggccaucauccuuguuccgaacccagaucccgugcucccagguuauuguucuugcccccauuccaugacuuccagcugggacugccacuugggugguauacuuuauacaaauuccagauucuuccccaaaguacgaugaaccaaggcaagaaauagaguuaaaacaauaaucuggguuuuugugaccacggcagccccaagagugguagucuccaaaguggggccacauaagacaaucuucuggggcaaagaaagaaaaugacagacauugucaaguauuuuccucauccuuuauaauagcuuauuuuaaauacacuuuaugauacaaacaggaggcagggaaauacuggguaggagagaguggucccuagcaaacgccacacccucaagccuggaaccguagggcccaaagugagaacaugcauuucuguuuuccugcccgaauguugccuuuuccaaaaccaccccggcccgccccacccuccaucuuguacccauaaaaaccccaggcccuaccagcaaagcaauagagaaggagagaagaaacagccggauguuggagagaaucagcuugauuucagagggacagcuugacagcaggacuuuggagaagaguuuggcuggggacagcaggacuccaggggaagaccaucuucccacuuaacccccuuucuagcuucccaucccacugagagccacuuccagugcucaauaaaguccuccacauucaccauccuucaauuuguuugcacaacuugauucuuccuggacaccggacgagaauucagguaccaagaggguggaugcaaaaggcugucacacugaccuugcacugagcuaacacuuaagucaucuguggacagcaaaucuaagagcacacuguaacauaugcccucuagggcuccaggggucacagguagccccacccagaugcugccggggggcugcacagaguucuacuccugccgaugcccaaaagcacucaccccagccccugcacccacucaccugcaugcugcuccucccaugaggggcugagagcugugggcugaguccugugaaggggucaagggaacuaucccauuucauuuagaauguaucaauaaaucuguacggcaauaugcauguaauuccuaaguaagcauuuuaauacauaugugugugggagguggucuaaauauacgucuguucauagagugugcgaucagaaaauuggagacuguuggccuggaacaucacugcucugcccuguuagaucuggcuccuucaucugucaguggguucuguggccauaaaagcauccagcuuggugucaugucuucccgcccaucugucuacaacugcuacaugcccaacacacagaacacaggaagccacugagcuuccugaacacaccacugacacacugggaagugccauggccagcgguuucuugcaaaccauaaaacuuuagcuguguuccucaugcuuagggaaaauguauuuuucaaucacaagaaaauaauuucuaacaacaaaaaaauuauguguauguugguuuaguaagaaaaaugguuucaacauaaaaaggaaagaaagcccuuuggcaaaauaaaaagacauugugcauuuaucaaaaauuacuacuaauaacucaaaagagaggcaaaucaguacauucugaucucuuugaagauaagaaaaccaacuguaugcaauaguuaaggauaugaaaggcagagucaaugugagcacucaaaugauuuuaaguaagguaugacucucaauggucaaauccagccuaugaccugaagauggcuuuucccucccucucucuauuugccugaaaaccaucagaacacuuguauguuuuuaauagaagauaauccauaggaagucucucauuaauccacacaacagaaguguguauccuagcuuccuauuauuauaauaaaggaauauuaacuauucuauucagaugcuccccauuguguggguaauguuuacuuuacauaugaaagaacuguggcucagggcuucaugacucauccaggagcuggaaagaugacagggaggccgacuuaacacacaaauugacugcaugcaugcguccagucagaguuccuggaggagacagugacauaccugcaucugguguaggugggacaacgcauggggagggcacaaaggaggggcuuggacucccuggggugacgcuuguccaaccacagucaagaacacaacgugcaaacacucucaccagcaaacacucucaccagcaaacacucuugccagcaaagcaaacacuucauaaacggacguccaguucccaauaggcauguaaggagcuugaaagucguuauuccguccuaacaguaaaaagcugaauaaaaugaaaaaucagcacuucuuagagaucugccuuggaucuguuggagaaaugucacaagccacagccccccaaauuggacaggugaauacaaggaaucacaauucacuggagcagaagccuguaaguagaaaccccugaagauccacuacggggguaggaaaaccuaaacuguaguggaaaauuccuggaggcucacuguggacaagccuaagagauuaaaaacuccagggggacccagucauggggguguggcagcuauauuugugugaguuuuaccuccuggagcucuaccagauccucacagugaauauugaagaaauauccccucaugcuuacaacagugagaggggaaaauaaccauuuugaaagaagccagggcacuguguucuuauuaauaaggccugccaucgggagaaacuauuuaaacagggacuaaacugcuagcauuuaucagagccuguccaaucugaggaacaggaaauaaccagccucugcuagacuuuaguaucaccuaaggauguggagagggggaagcugagaagcaaaugugaggcucacagcccagacacaaagguucccuaaaagaaugagaccaaaucauaggacuauagcaagcuuccccucccacuacaccuuaacaccacacaacuaaaggccuguuuaccaggguuccgugcaccaaguccaucacauccagcuuucaacauaaaauuacaaggcacacuaagagguuaaacacacacacacacgcgcgcacacacacacacacacacacacacacacgcacgcacgcacaguuuaaagagacacagcaaguaucagaaccagacucagauauagaacaauguuggaaugaucagaucaggaauuuaaaacaacuauaauuaauaugcuagggacucuaauggaaaaaguagguaacacacaagaacagacagauaauguaagcagcgaaauggaaauuaugagaaagaaucaaaaggaaaugcuagagaucaaaaacacuguagagaaugaggaaugucuuuaaugggcucauuagcagacaugacaugcugaggaaaaaaaucucuaaacuuuaggacaugacauuagaaacuucuaaaacucaaaugcaaagacaaaaaagaugaaaaaaauugaaauaauauccaagaacuguggaacaauuacagugguguaaauaugcaugaugggaauaucggaaggagaagaaagagagaaaggaacaggagaaauacuggaagcaauaaugacuaagaauuuccccaaauuaauguugaacaccaaaacgcaaauuaaggaaacuuagagaacacacagaauaguauaaaggcuccaaaaacuacacugaggcauaucauauucaaauugcagaaaaucaaagauaaagaaaaaaaauugaaagaaacaccuuaccuaucaauagaggagcaaagagaaggauuauaacuaaugucuucucagaaaccaugcaggaaagaagagaggagagggaaauauuuaaagggcucagagaaaaaaaaaaugaccaccuagaauucuguaccauuuaagauugaucuucaggccaggcgcgguggcucacgccuguaaucccagcacucugagaggccaagguggguggaucacgaggucaggagaucgagaccauccugccuaauguggugaaaccccaucucuacuaaaaaaauacaaaaaaauuagcugggugugguugggcgccuguagucccagcuacucgggaggcugaggcaggagaauggcaugaaccuagaaggcagagcuugcagugagcugagauagcaccacugcacucuagccuggguaauagagcgagacucugucgcaaaaaaaaaaaaaaagauugaucuucaaagaugaagaagggauagagacuuccucaaacacaaguugagggaauuuguugccaguagaccugccuugcaaaaaauguuaaaagcagcucuuuuaacauaagaaaauaacaucgaucagaaaccuggaucuacaugaagaaaggaugcaucaaagaaggaauaagugaagguaaaauaaaaacuuuuccuuuuuuuuuuuugaguuguagucuugcucugucacccaggcucagaauagugguacgaucucggcucacugcagccuccgccucccagguuccagcgauucuccugccucagccucccagguggcuggaauuacaggcacgcaccaccacaccuggcuaauuuuuguauuuuuuguagagacaggguuucaccauguuggccaggcuggucuugaacuccugacuucaggugaucugccugccucggccucccaaagugcugggauuacaggcaugagccacugcuccucgccuauuuuucuuauucuuaauugaacuaucauauaauggguuguuugaaauaauaauagcaacaauauauuccaucauguauucuuuuauauauuauauacauaugcuuauguggauguaaaaugaaugacagcaaugauauaagugaugggagggaggaaucaagaauacuuuguuguuauaagauacgugcacuaccugugaaaaaguauaguguuaucugaaagaagaccaacuaauuuuuuuuuaagacacauaauagauaugcugagaagagagagaaaaugggaucauacagaaagcucaauuaaaacgacaaaaggcagaaaaagugugaaagguaaaaguacaaacacagaauaagggcaauaaauaaaaaacaauaacaaauauaguaaauaugaauuuaaauauaucaacaaucacuguguacaucgauggucuaaauacaccaaagaaaauaccaagauugugagaaucgaaaaauaagucccaauuauauguugucuacaacaaauccacuauaaauaaaacaacacacauagauuaaaaguaaaaugauaaagaauggccuuuaccaagaaaaguuagaucuaucaugcuaacacuaaucaaaagaaaguaagaauagcuauauuaauuucugacaauguagacuuuagaucauaggaauuuuuaagggaucaagacagaacuacacaaugauuuuuuaaaagucuguuuuccaaaaagauacaacaauccuuaauguguaugugccuaaaaggagcauaaaaaugcaugaggcauaaaaauguccaugcaguucaugauagauagaacugcaaggagaaauaaaugaacucacuguuauaguuugagaccucaauaguccucugucaaaaaugggcagauccugcaagaggaagcucaauaaggacagaguugaacucaacaacaccaucaaucaacuagauauaauugauaucuauagacuaauucagucaaaaacagcagaguacacauucuucucaaacucacauggaacauucaccaaaagaggccacauucugggccacaaagcauaccuuaacaaauugaaaagaacagaaaucagacugugugcucucagaacacaauacaauuaaacuagauucaauaacagaaagauagcuagcugggaaaucccaaaguacauggagacuaaacaacgcacuucuaaaugacacaggggucaaagaagaaaucucaagaaaaaaugauuuuaaauuuccaaaguaaauaaaaaugaaaacaaaacuuaugaaaauuugugagaugcagcaaaagcagugcuuccaaagaaauuuauaguacugagugcauacauuagaaaauaagaaagaucuaaaagcaaucaucuaagauucuacuugaaaaaacuagaaaaaggagaaaguuaaauccaaaguaaguagaagacauacuaaaaauuauuacagaaaucaauaaaauugaaaacagaaaaucaauacagaaaaaaacaaaaacaaaaacugguucucucaaaauaucaauaaaaucaaugaaucucuaaccagacuaagugaaaaggaaaaaaggcacauuuuaccaauaucagaaaugaaaguggggauauaacuacagaucccauggauaugaaaaggacaauacggaauaguaugaacaacucuauucccauaaauucaauaagcuggauuaaauggaccaauuccuccaaagacauacucugccaaaauucacauaagaagaaauagacaauuugaacuggucauaucuauuaaagaaauugaaucaauaauuaauaaucuucccaaacagaaagcaccuggccuagguguguucacugaugaauucugacccacauuuaaagaaagaaauuauaccaauucucuacaaucucuuccagaagacagaagcagaagaaauacuuccuaacucauucuaugaggccagcauuacccuaauaccaaaaaccagacaaagacauuuaagaaaagaaagguauggcugggugugcuggcucacgccuguaaucccagcgcuuugggagggcugaggcaggcagaucaccuggggucaggaguucaagaucagccuggccaacauggugaaacccugucucuaaaaaaaaaaaaaggaaacgaaagguacugauuaauagcucucauaugaccauaugcaggaauucucaacaaaauaaagcaaaucaaauucaacaauguauaaagagaauuauacaccaugaucaaguaggauuuaugccaguuaugcaacaguggcucaacaaaugaaaacccauuaacguaauccaucauguccacuagcuaagcaagaaaaaucacaugaucauaucaauagaugcaaaaaaaccacuugacaaaauccaacacccauucauguuacaaauucucaaacuaggaauguaugagaacuuccucaacuugauauagaauaccuacaaaaauccugcagcuaacaucauacuuaauggugaaaaacuggaaacuuucccacuaagaucaggaacaaggcaaagaugaccccucaccacucuucuucaacacugugcuggaaguccuagcuaaugaaauaagacaaaaaaaaaaguauaaagauuggaagaaaauaaauaaaauccuauuuguucauagaucacaugauugucugugcagaaaaccugaaacaaugaacaaaaauuuccuaggacuaauaaacaauuacagcaagguuacaagaugugaggucaauauacaaaagucaacugcuuuccuauauaccaguaacaaaggaguggaaugugaagugaaaaucacaagaccauuuacauuagaaacucccaaaaugaaaaacuuagguacaaaucugacaaaauauguauaaauucuguaugaggaaaacuacaaaauucugauaaaagguaucaaaagaauuaaaugaaaaaauauuugacauucauggggaguaagacaauauggucaaaaugucaguuaaucucaacuugaucuauagauucaaugcaauuagagccaaaaucccagcaaguuguuuuguggauauuaacaaacugauucuaaaauuuacaaauuuauauggaacagcaaaagaucuggaauagcuaaaacuaccuugaaagaaaacaaaggugacuaacacuacucggcuucaagacuuuacaugaagucaugguaaucaaggcagugugguaguggcaaaauaacagaaaaauagaccaauggaagcaaauaaagagcuccaauauagaaccauacgaauauugccaacugaucucugacaaaggagcaaaggcaauaaagcggagagaagagagucucuucagcaaauguuucuggaagaccuggacacucacaugccaaaaaaaaaaaaaaaaaaaaaaaaaagaaccuagacacagcucuuacacuuuucacaaaauuaacuccaaaugaaucacagaccuaaauguaaaacaccaaaguaggccaggcgugguggcucccgcuguaauuccagcacuuugggaggccgaggcgggcggaucaccugaggucaggaguuugagaccagccuggccaacauggcaaaacgcugucucuacuaaaaauacaaaaauuagcugggcuugguggcagaugccuguaaucccagcuacugggaggcuuaaacaggagaaucgcuugaaccugggagguggagguugcaaugagcugagauuucaccacugcacuccagcuugggcaacagagugagacucugucucaaauaaauaaguaaauacaccaaaguauaaaacucauagaagauaacauagaagaaaaucuaggugaccuuuuugucauggugaagacuuuuuagagaaaacaccaaaggcgugacaaugaaggaaauaauugauaagccagauuuuaaucaauuaaaaucuucuaggacacuaucaagacaaugagaagacaggccacagacuaggagaaacauuuacaaaacccauaucugauaaaggacgauuauccuaaauguauacagacucuuaaaacucaacaauaagaaaaugaaccacuggauuaaaaaugcgcaaaaggagugaacaccucagaaaagaaaauauacagauggcaaauaagccuaugaaaagaugcucaacaucauaugucauuagagaauuggaaauaaaaacaaaagugaaauacuacuccacaccuauuagaguggccuaaauccagaacacuggcaacaccaaaugcuggugaggauguagagaaacaggaacccucacucacuguggugggaauggaaaauggaacagccacuuuggaaaacaacuuagcaguuucuuacaaaacucagcauacucuuaccauaugauccagcaaucauacccuuugguauuuacccaaaugagcugaaaacuuaugucuacacgaaaacugguacauagauauuuauaguagcuuuaaucauaauugccaaaacuuggaagcaaccaagauguccuucacuaggugaauaaacaaacuaauacacccagacaauggaauguuaauucauuaagaaaugagcuauccagccaugaaaagacauggaggaaccuuaaauauauauuaaauauuaauauauuaaaauaaauauauauuaaauauauauuacucagugaaagaagcuaaucugaaaagcugacauacccuaugauuccaacugccugacauucuagaaaagcaaaacuucagaggcaacaaaaggaucgcugguugccaggggcuggggggagcaaaggaugaaugggcagagcacggaggacucuuaaggcagugaaacgacucuguaugauacuacaauggcggcuaaacgccauuaugcauuuguccaaacccacagaauguguaacaucgagagugaacccuaaugucaacuacagacuucgggugaugaugacgugucaaugcagguucauggauuguaacaaauguaccacucuguugggggauacugacaauggaggagguuguauguguguugggggugggggugcaggagguauacaggaauucucuguaccuuccccucaguuuuguucugaagcuaaaacugcccuaaaaaauaaagucuauuaaaaauauuucaugaacuaauauauacuaauauauacuuucuacuuuagucuauuuuuauuuucuuuucaacacauuuuggucaccuccuauaaaaguuuuaacuugaccacccacuaauggguccgauggaaguuggcaaagcagugcuuuagggcggugucuccugcugaccuauggaauccagccucuccccacagaccaccugcuccaagagccaugcucaguccacucccaaucacgugcucaaagcaagauggcuuccuggccccuggcaguaccuggagggagggucuccaugcuuugugcuuucucuucuccauugcugugaugaaggucuuucuuuuuaauggggucaauuucauuccaguccuccuaggggaacaaagacacugaaugaguugacuuguucuucaagcacaccuucauucaucaguucaauacauaccgagucuuaggagaguuaacacuuggcccuggggaugcacugaugagcaggagggagggcacaucuuaaagaccccacacaccagaaauuguuagggagucaagaugcaaggggagaaaaguaugggcaugaccuuucccaaggguuugcauuucucucuucauuuuauauuuguauugcuuaucugugggaaggaaauacuccaaaaacucccagggcuuuggggauuugugaggguggggaagcgagauagggaaaguggauuaaaugaaauaauucuagagugguuaaauuaaagccauuaaaaugaagguagcucuccagacaucuuaggugguuuauggacaucuuaggaccagauucucccuaagggcuccuuugagcuccccucagagaguguuaaaugauuuaauuccacugacuaacacaggagcaggggguagggccaccaagcuuuuucuaggacuuacucuaauaggacugccaaugaaacagagauacauauuaaggacucaaugugaaaacagaauaagauauaagcucuggcagaauuuauucaacucaucugggcaaacaauuuacucuaauuuaucaacauuaaaucagacuaaauaacaacugcacgaccacagagcuaaauauauauuuuccaccacugggaaucugauuucugugacuaaaauaagaaagguuucuguauauaacccaaaucagaaauaagccauggcuaguaauuuucccaccagacuccugugagccaagcauugucagcuggccauuuuccugagcagaugcgauuaggcggauacgcaacaguaaucccucccugcggggcggggaacccagcucuccccggguuuauuccaccagcacuccucuggaccagugcggacugugugcugcacgcacguucaccacuggagacguuuugguucuuuacuuaaaacguaaagugagaucugcagaaggguaaaccucagggccugggccaaaugacacauuuuuuccaaaugcaacuugcuuugccaauaaucugcauuuuuacucaagaggugcgguaauuagacagaaacugugccuaagacucccccaucucuuggcuagcuuuugcuuccguugcuucucuaaugaggcgauacagcuggguuuaucacaucagggcugccgugaaaauggcaggaagggaggaacuguagccuuggcgggcuggugagagaaaccauucugcagccggggguccaagccccacccacccagcagaacaccuuccuggccuuuaagugccccauguacuuuugcaagucuuaccccacgcugcaacaaauguauuagaaugcagcuguaucccaauuuaaauaauuuuuacugcaaaaaaguuuugaaaagauauauuuauaacuuggcuuuugagauuacuuggcuauaaagaaacuuucaauuuacuacuggcacugauuuugcgggaacccuggcagauaggcaacggugagagaauuuaacccaccaacuggcuuuacaaaguaaggagauacaugugaauacgaaaucagcaaguaaugaaauuaccacagucacacucugcagacuuuuaauuacgcauuaauuuuuauuuugaggcuugauuguagcauuguggcugauaauucccaccucucaacccccaccccagcaucuggccuucuauguacaccagcuaauggaucaaaucauuuaaacuuguagcugaauaaaaucaaaagugaacacugccaguggggcuggugacucuagcauauuuucuacauguaaaaauaaagucaucaucuguagucauuaucugacauuugcaggucaaccaucaguguuuucccagaaaauaaacuuuuuuuuugugcccacaaauaagauugauuugcccacagguaacacuccucacccucccuucuuccuuccaaucaaugaugccuacuauaaaacuagugcagggugagcacuccucaaccucccuucuuccuuccaaucaacgaugccuacuauaaaacuagugcagggugaguucaugcccauauaauuagggcaugacaagguaccaagcagauggaacaagcccugccauuuacgaauaccuacuaugcgccaagcauugugcauugacccucucucauuccugcauuuuauaauuccugucuuacaaugaggacacauaagauaggcuaagcaauuuguccagguuacgcagcugguaaaaagcuaaaucuggcccuuuauguaagucagagugggaaugacaggcuagggcucgauuuaaacuaaauuauaagagccugauucucaaaaugucauaaaaacccaagaauacauuucuaggaggucacucacauaggacuguuuuguucuggacucccaggccaaaaccugcagauuaucaucuuaaauaccugcuccuacaguaaaaauggggaaggggaagaggagcccccaaggagaaggagggggaggacagugaggaggaggagggggagagggaaaggaggaggaggggagagggagggggaggaggaggacgaggaggggacgaggaggggaggaggcagaggaggaggggaaggagggggaggggaggacaaugaaaaggaggaaccaccauggugacugcugccuaacacaguauuuacgaggugccaagccccacucuggacacugcacauaugcucaucuuccugcaaugcuauuacuauuccaauuuuacaggugaggaagccaaggcacugaacauuuaguguucguaugaggcuggauccacacccuggggagcucagggcuggaguuuauggucucagucauuuagcuguacugccucuagauaagauagcuuccucccucccucaacuaaauagccaaaguucaauuaagacauuguacuaaccauucaucucagaauaugucuggucacuagaaauaaauuccuacaaagauggcugacuagguucacuggcugauggagcacccacacucaacccaccacuggucuguagaugcuugucuugucccacucucuucucuccaccccuaccgaaggccuuggccugguauuaagaaagucagcuccuagagacacagcaggggccaggcaucuuggccugugcugugcaaagacacccacagacaagcguggggaacaacggcccagaggcacaggccccgcguagaacagggcccccaggaaggcuguacacggaagugguaccucgguggagaccuaagggaggcaagaaggaacaauggggacuagcggugguggguguaccagacagauggaacaagggaaagaucaaaaacaggagggcacggaagcggcaggauagucugagaccuguauucuagaaauaucacuauggcuauaaggugggggcagacuagagggcacaagagagcccaggaggccauuucaguaaugcagcaaugggaagauggcaugcuggacccaguccaggucccggagggacagagcggagacaggugcagcuaggaggggcuggcaaugcagcaggaggagugcgaaggggaagaagaaucaaagacggccccagguuucugacugcagcacuuccuacacaggugugauguccaccgagaagaaaugcaagacaguugcuggggaggguaagaagcagugcuaggaaauauagaggaguuugguuuggaaaugaugaagcuacugugagauaccaagaggaggcaucugcaaacagauggaggcacaaaucugggguugugaaaaggccccggguaauuaaagcuacuggugagcaggagggagaccacucagggaaggugaggugucagugcaggggagaggagaggccaaugcugcagggacaaguaggaaaggaggagaccccgcaugacacguggggagcagcacuggccucggagccagagccuuggguuccagccacgccucugccaauggcaguggguguuggagucuaacuucucuaagauuaggaggcugggcucaaugccucuugcacagcgggucccugccugcccaguguucuuguguaggugauacauucaguuagcacuugggggucuuuuacauuugcuaccugcuucgcccauguuugauauccaaaaagauuucagguucuuugaggguaaggaaagcugucauauuccuucuguauccuuaugguaccaagugcgcugguggccuuacaauaguugcucaauaauaaaugcagcugaaaaaaaaaaauccucgcccuacuuacucagauugauuguacuggcuucgccuacucugcaguggaaguuuuucguuacaaucccccucccauacauuuacauacauuauaagacuuauuuacacuagcaucagugccgcucaaaaauggaaauguacugaaugcaaauguaugaagaaggcucuugcgcccaguagccacugguauccuggcugugcuaccaacagaucuguguguuuucucccuuuuaaggggaaacugaugcagugacagacagguccucuuuuuagugacaaguauaaacuacugagauuagacaagucaugaugugguuuaugcugggucaaaaguugcagagaauucaaagccugugaucuuguaagcccgcuuugauuucccaggaugcagacccaucucugcuuuguuuccaccacccucaaaggagggauguugacagugaaugcagaaugauuaccccacagacagauggugcuucaggaaaguguagacaagggagggcucagcagcucugaccaaauacugcauuccaucagggaaguuuaaccagaggucuaggaugcccugccaaccaaaugagaaacaugggacaggagaacgcugcugcccugccuggcaucaccccuuggucuagaguauuggaugcauccacacgcagccucuggaaagaccuagaugcccuaaaguacagcgcuguggucuucgcucccuuuguaaauggcaucugggccagagaaagagaacucuaagucuucuccuacuuacuaacuuaccccagaugguagugauuauuguuauuagacauuuuaaucugguucaaaauuauguauccuaaaaccucaaaauauguaucucccaaauuguucuuacaaaugcacacaacagaggcacaaauggaauuaaaccagggccaugaguguaaucagacgggaauccauggcugagcgacgucuacuuaccugccauaaucagagagcacagcagcucaaauucauccuaucucuaaguacauaaaauagcaaugacaucuaaauacuaugacacuauuuucagaagcaguaaacccaauaggugaguuuauuaaauaguuauggaaacuaauuaaguguaaauauagguuucguuguuaauagaauauucccaguauaaucugucucugauccaaauaagaaaaaaauaagaaguguucuuggcucaguugccaaaggcaaguggucaggggaguggaggaggaaaggcgccguggggaugaggagguacaguggcuggaagaugagcaagccccuuaggcacuauugaucgaaucuaugcgugcagggcacugugcaguccaaccauucguuucccagaggauuggcaaaaaggauccagaagggcuaccugacuuaucaacugcugcaaaacucaguagcuuaaaacaauaaauguuuauuaccucacacagugucugagggucaggaaucugaaugguucuggcccacgauuucuaauggggcugcaaagauuucggccagggcugcuguucucugaagguuugccuagggcuggggucugcuuccaagauggguaacucacguggccaggaggccccaguuccucacuggggcccauccaguagggcugcuuaaguguccucccaagaggcggcuggcuuccccagugaauaugaggaagagggcacauacaagagcaagggaaacacggugaugccuuuuauggccuagucuuggaaaucacucacuguugcccugucacagucuguucauaagaaauaaugaaccaugucaccauguccagcucacgugaaaucggguuugguggagcugagacuagccuccaguuuugagaggaggauaauaaaaaaaauugguuaauauuuagaauauucuaaaaccacuacauuuaucaaugccauaaggcuugcuaguggcagagacugcugcacccagccagucauuugugugggacagggguggggggcaggggcugugagguguuggaagcccaagaauugagucacaaaagcagcaaaaauguggcuucaucucacgcugaugucuuacccauguccaauauaaauacaauuaccaccucugguaacauuuuugaauuaugaaacaccacuaaaauaaacaugcuuacauacauaaaacuagauaauaacaaagaauaaauguuauguauauugcuaaaucauccaaagcugcuuccauauaauuuaaauggcgaacaucauauuuguuaacggagacauaaaaauauuacugcgggagaaaacagaaaauaaaugggcuguuuuuaaucucugcuugcugaaauauauguugucacuguuaaauuauuucagcugacuagaacauauggucagaggcagauuaaauuaccgaaaauaccaucugaaugacuacuugauucccuucuaaucaguugucuaguuuucacuguuauuugaugacuuuucaguaauuaccacuacagccaauccacacagcaacccucaaguuuuggggaaaaaaacagguugccagaaauuuuuaaaugauguaauaauuuauauuucacagcccauuucucaaaagguaagacuaagcuaagcugcaaagcuaagacauuacaaacuaacuaaaauacuguucacucgaaagcaaauuuuuacagaguagacuuaguuucccgcuaaagaccaagaccuccccugaucaagcauuuucccuauaaagugacccaugggagaagcagaaggacuuauuucuaauucuucaagguuggcguuccaccaggguaguguagaggaauaaucuucaggucuucucacaagaaggcaaaaaaacuuacuuuccaaauaggcugugugaccuauuaauaaacucacaaauuuaauuuuaacucacugggaaaggguccugaaaaaagaacaccagaguuaacuaggugauuucaucuggauagcugucuccuccaaaucugauguugaaaugugauccccaauguuggaggugaggccugguggggguguuugcgucauggggguggaucccucaugcauggcuuugugcucuccccaugguaaaggaaagaguucacacagauuugauuguuuaaaagaaccuggcaccuccuccccucucucucuugcucacucucuugccaugugacacaccugcuccccuucaccuucuaccaugaugaaaaguuuccugaaguccucaccagaagcagauucuguugccauguuucuuguacagccuacagaaccgugagccaaauaaaccuuuuuucuuucuaaauuacccagucucagguauuccuuuauagcaauguaaaacaaaccaauauacuaggcuaguaagaucacucugaaccauggcaaaaguucucuuaaaaccagaagccuguacuguguaaaacacugguaucuaugcauuuauaaaagagaucaguuuuugcuucuuaauaaaaauccccauugaaagcaagaacaguuugguuuacaagaaagagugguaucuuuccuccuacucaucauuagaauagaaagggaacguaauauacccuagagaccagagacaggcuucauucagucucucaaauauuucugaagcauguuuugugccccauguagcagaaguagccaugggcccuccuaguuucaucaccuagggagaacagguaaaauauagguagagaaguaagaucagccuacugcaagcuuugaaagcuccagcccaacagcucccaaaaccucuacuuaggcaagaaucaaaagauaugaaagguuuaagaaugaagaccuggguagaguacagagugaggaacaagacagaaaggccaaguuuuggauuucccaaggccuguuccugcccuggccaauauaauuacaacuuuagggaaugggacccagccuuggggguuuuucuagaagcucccaggcaguucucaguguucagaaccacuggcuucauccaugcauuuccaguuucacuuucacugcuccaacuuaguuuaugaaacucaaugcugcgaaaaugagaggagggcaaauuucuauuuuggauucaaagucacaaacugcuuuauacauacuccacuugcucacaaauaaaaaauauguuaugauaaaggucagcacuucacuuauuuuacuguguaaccucagagaaaaacacacugguggggaauaacguggggcugcucaacauuugagaacuguaacaaugacuugugcugaagucgugaacuacaaucgcauaauuauuaauucucaaccauuuaacuucucuaacaggcagaaagccuggugaaucauccugcacauugauuccacgcacagucggucaauugucuucauuuaacaaaaauccuccuauuuaaaucccuauagcuacgcacagaugaaauggccaucggugacccagccaguugagucuagaaccucugggcauagaaaaugcaacuaggaauaguuugcaaaugcacuggcauauccaguaaauccuggucuaucucuaugaccuuaggcaacucaggcugcuucucugagccucaguuucccaagauauaacaugaaaauguaagaaccacucuaucccauccccuuugaacuauaaggcaugacacaaguuagacauuaagucccaucauuaagaacauuaaacuugccuucuuccaaucuggggguccagccuuuacuccucuuccaguuacuauucagggguacuaaacuucccuuucucuccauaauuaacucauucaacaacuuguuuacaaauuuaugcauauuuuacuucuguggucuuccucucccaaacccauaacucucaucuaaucaugagaaaaaacaucaaacaaaccccagacgaggaauauucuaaaaaaucccugaccaagccuccucaaaaccgucaaggucauaacaaaaaaggaaagucuaaaaaaaugucacaguaagaagacauaaucacuaacuggaaugugguauucuggauaacauauuaaaacagaaaaagaacacaaggggauguuguaaaaaaucugaauaaagagagaacuuuaguuaauaacauaucaauacugguucuuuacaauaaaugaaucauacugauguaagauuuuaauaacagggaaacuugguaugauauauauaggaacuuucugcacaauguuccccauguuucuguaagucuaaaacuguucuagaaaaaaauaaaauuguaaaaaauuacaaaaaugugcgcauaauccuauuuaccuaaagggaaagcaacuacacugaaaacuccugggccaacauccgucaaucauguauuuccugggugccuguucauuuuuaauggaaauuuuaagcccucuugccucccucuucguucaagaaaacucagguacaaaucucuugauaaaugcucgaaagccaaucuuccaaugagaauaaucagcucagcuccggggacaggaggggcaaggccucagaggaaucuauuccacgccaccauccucucuucaagagcugccagaccauccuaaacguuuuagcccagagaaagcgagcacaagggaugccacucgcaugcagcuuuuccucauuccuaggucuaaguaagaguuuaugaagcaggucagcucuuagcuccuggugauaacuucccauuccugaaggcaagaacagcagguccuuuaagagaugauauauaauucuagcccuaaguuagcugagcgcccgacacuuuaaggagucuuuuauggcuccauuuucuaacacuugcuccgaguccaccgccuccccagucaggggguggcacacaaagcccucucucaacugcagcucacuucuuguucuggguuucccaaccacagcugaagcagguucuuuuacuuuagaaaaaugaagaauuucugcacacuggacuagaaaaugucucuuuacaaaaaaaagggggggguauuuuagaaaauuauuucccaugugauuuauguaaaaaucaauugcauuuuaaaaauuuaaaaauaaucauugccaauagguaagaaaaaaaggugggaggagagaggugaagcccucaggcagcacuuggugaugagcggggcccaagggccacaguggagcagccgcagggaggccagcaggaggcagccucgucagccggccaggcugcagcccugcacauuucacacccgugcugcuccaccgccccuuccucccaucaccacggcgcuccuccacgcucggcaguucccugaccuccaugucaauauccccgcaaggcugcuuuccuccccacuucaccucagcccacaagcaggucucacagaacuaaagugcaaugcuccuugucaccaguaggugccaccaucucccaugaccaccugguuaaauccuucccaugagggccuaacuuccauacaacugguuccuuccuaggccugcucuguaaccacugagucagaacuggcuccaugcugggagugguggcucacgacuguaauccuagcacuuugggaggccaaggugggaggacaacuugagcccaggagcucaagaccagccugggcaacguggugagacccugcuucuacaaaaaauuuuaaaaauuagccagguguggggaugcacagcuguagucccagcuacuugggaggcugaggcaggagaaucaccugagcccaggaguuugaggcugcagugagccaggaucgcaucaucgcacuccagccugggcaacagaguaagagacccucugucaccccccaccaccaaaaaaauaaaacacuugacucuguuuugaagagcaucuccaagaaaaaaaaaaaagagucucagaaugauaugcaaagagccccaagagggcugaggguuacaaacgaaauggaaaauuuguaauuaagcuucuccccugacuuaucucaucacaaaucauuacagaguuggaaauucuuggcaguacagcccagguacagccaacccaagugugagugagagggacuaauguuuauucaacauccaccccaggccuagcacuagcauguucucucuuuuacuccucaugacucccccacuacagcaauucucccccauucugagguucucuguacagcaauuaccccuuaucuucaaagggagaaaccucaaacuucaguugacuucucuuuggguaccauuagaauuagaucuggauuuugggaaaagggaagaaagcaaggaaguugggggaaaggagaggcuuucccaagcugcccugggagacagcagauggcagagaccagcacaucacacccacuggucacagcaagaaggcagagacaagacauguccgcgugcucacugaauccccggaguccacuguccugcugccaucucuccauggcaaggccaaggcugugcagccucaggacugauaaagcaggcauuugaaaaaggccugacaaauccuuucaaaguugguaaaaugauaugacccacgugggauauuuagaaagauggugaaaguagcuagagaugagaaacaccgugugaggcacaccaugcaaaaugugugcuaucugcacccaagaaaaagaaacucaugagugacgcugcggggaggagugccugaaaaaguuccuaacaaacaagaaauacauagggacuguauguuucuuuuuauucauuuaaaauguacauuuucucauuaacauuuucuuugcucaagguucagcagcuauuagcugugugacuauuaccccaaaacccuauaaggauugucuuaaucuauuuuuuucaaaaggucuuuuuuuuuuauuaauuacaaauuguucuuucacaaaggauuugugcagaggacacugucauggcuuauuagaccacuuuaaagacagguaaacacagggguuaaggcgguucauacagucccaucaaagcccagacuccaugucaaccugauccaaaacaguggucuuuccacaguugcaagcucuuuucuuaaaagguuauuucaaucagaucacaguagcugaguggagcacauucacaucaugccuaauaugagugaccuacagcaggacuccauacagaaaccuccagcccuguggggcaucuaucagcccucuccaggggcucuggcuacuccgagggccucccucccucucgagugcugcccugggacagguugaccagugccacccagggacaagcugugagauccccuaccucuggcgccacuuauuuguaaguccauucucugccuucaacagcugggacauucuccauacuaucucaauacuuggcaucacaaccaggcugcagaugucucacuaccuuauuuuaaaagcaaaaggacacaguguaaauuaaaccuuaucggaaagcaacuuggcuuggcauccaacaucaagaacuagaaagcgacugaaaaucuuuaagccaagaaaucucacuucuguaaauuuaucccagugaacuaaccuaaaauaaggaauaaaucuuaugcacaaauacugcagcauuauuuauaagagaaaaaacagaagaaacuuagaacauucaccaauacaacguuaauuucuguuaacagccccuucaaagaauacuaugcgcccauuaaaauuauaaagaucacagagccacaugcaaaaugcuuacguuaaaugaaaaagcaggagacaaaguuuuauguacacaaugaaacaacuauauaaaaaucuguauccauauggauuagccuggaaugaaaggcacuggaauaaaaaugauuguguuaagaguggagaaugaugaguguuggcucuccuucucagacuuucacauguucuuuaauuaucuucaugaauuguugaauaguuuuaaaaauuuagcccagauauguuaaaguuggaacuucgaccuuaugcaguauuucacaucauuaagggaucuuaucuggccagugguuccaaaugcugcccaaagccacuacaggaaccuauggggcaggggacacaaaagcuguuucuagaaacaggugugagcugaccucugcuuuuaagguuugggguccaggcacuacuguagaaucucagguagccucccuucucccuuggaauuagaaagagggcugagaggccaggcgugcuggcucacaccuguaaucccagcacuuugguaggccuaggcagguggaucacaaggucaggagaucgagaccauccuggcuagcauggugaaaccucucuacuaaaacuacaaaaaauuagccaggcgugguggcgggcgccuguagucccagcuacucaggaggcugagggagaagaaucgcuugaaccugggaggcagagguuacagugagccgagaucgcaccacuggacuccagccugggcgacagagugacuccgucuaaaaaaaaaaaaaagaaaaagggcccagagaccgugcuguccugggcaagaaagagaucacaugaucggaugcaguccgccaagccugcugagaggcucaucuccucuauguacaucacuuucccuacugaaucuuugcuuucuccaagaaacgggucaaacaccaaagugaucuugugcgcuuaucaccgcuguuagcaguaaauguguacagggaacucgggugcugacagugcauguacgggcaaucacacacacaaggagagaaagcaaagcaccggccucuacuggguacuuccccaugggcccgacggcccuucugcccccaacccagaacauggaaauaacagcaacagugaugccacccucacagaacuggcauuuaccagggauuuuccaagugccaggcauuguagaggagcuacacgugugcgauugcaguuacguauguguucuucacaguaucuuugagguaugguauuuaauaccccuuuuauuaaaaaaaagaugacaaaacugagacccucccaaaaaaaacaaagucaagagcacacagcuaacaggcaguguauccagugucacaucaggcugugacuggcccagaguccaggcuccauccaccacccccggccaguucugggacagacagacugaccccguguccaugugguugggaaagcuaaauccaauaagcucacugacaccaagugacuggcacaggccuggcccacagcagccaagacagucaguggggacugucccucuuuccucuuagcuucccugguccaacuucagaaaacaguaauuuuaccaagaucuacuuuuaaagguugcuucuccuuuccacacacuucgucucauuugauccugaugggaaagcugaaaagacagugagcugcugugagcagcucgggcuucgaaggcaaauucaaauuccugcucuggagcucguagcaauaggaaccauguuuucuauccacugugauguggaggaauuaaauaaaaggacauacaugaugaugcuagcagugucugacacacagaaggcucucaacaaaaacugagcccagagccacacaaccgccugagaaguuacaccacaccucccucauacagcuggaaacgcuaaagcaugagagaucgccggagugaccucaucccaugcucucugaugagcaacagcacugggaacagucacugcucaucuuuccacugcaccucagccccacggaguccauggaauucaggaguggccaguggcccacaagaugugcgcacuccauggaacuuguuccaaguggggccuggaucucaccucacugcacaugaagguugggggauuuaacaauuccuuugacaaaaguuuguuguuguuguuguuguuguuguuuuaaugcggaguuucaaagaacauguuuagcugauucuuaucuuucuguaagccaaagauucacguguccacugacuuagaaaugcaggggucaaggagaacuuuccccaucacccucugaagguucacugaaaacucaacucgaaaaagucagauuaauuagagaaaaggcauacacauugauuuaauguguacacacaggagccaucagaaugaagacccaaaguuacaggggaaauuguccauucucaugcuuaaguucaacacaguauggacagucauguggaaaugugacuggacaaaaaugguagguuccaaugccaacagaccgaguggggaagcccagcaaggccuguccaucuagauucuucucagccucucugagcagcauuccuucauucuggguuggggcaagacccucucuggaauggaguggaggggugggucuuaugaccuacagucaaacaguuaagucacauacuguuuuuauaaacaguauuuacauagcaaggcagagggaaaguuagagcugcauuuucaggguugauggcuggcuuuggggaaagcaaguucugguuccuaggaccuguuuuagggaagagggauucuagcuucuauggagggaaucuagcuucuaagggcagccuuggggagaaggagacuggcagcuggagggcaggagaaagugaaaaacuuuugcuucugaggccuucauuuugggauauuguuuucugaacccuaagggaaacuagaaagaacuauauuuagaauucuaaaacuuuauaaauuauucauccaucuuaguagcaucacccggaaugcuaaauucucagaggaugagaaagaguguauggaaaauguguggaauaugguaggugaucagauacaggagcuucauccuaacacccugaagaacccggcauguguuggaccagaugaauuaagugcugggagacuuaaaggaaggcugguuagucuucagugcuugugaaaaucugcaaagaucacuugagucaaaucuauaagaauguggaaacucauucacgucuauacaagcuuguucaacaguacuauaauccugaaucuuaccagcaaaaccaaugaacuggaagcgccaagauuuuuuuuuuaauuuuuacagaauuuugcugguuagucuuacuuuaauaauaccccauauuauuccaaaaaggauuggguagcuuaaaacaaaagaucuaaauagaaacacaaaagaaauggaacauggugguugcagaaaugaccaaguaaagaugcuguggucaaguugaauuuuuaaacucugaacuucccagagacagaaguaaaauaaguaauagaaacaagaauuaagguguaaugagaucaguuauggcccagagacuucauguauagucucaauuaacuucacaacaaucucaggaaggcaaguaucaucauauccauuucacagaugaagaaauggaugugagucacccgccaaaggcacaauggucagagagcaagucagaaucucaauucaggcuggacuuugaagccugugcuccaaccaaccauaugcucaccauccaaauaaagucaugaguaucuuaagagagacugaaauucagcugcuagauuccaaaaugugccaugaaaagaauggauuuuggggacuggacugcaguggauuggaaguggccauauuucuuugccacgucugcacagacagcuggagucggccucuggacuaggccaugugauuugcuuuggccaauuggaugccagcaaccacgaggcaaggaggggcuuaauacacaccugcacauuggacaugcccucuuagaaugcugcccugagaccaccaugguguaaggaagcuggucuaugcuacuggggcauguggagaguugaggagccccagacaauagcuagcaaauacuauaggacacgugaggccaccuuggaccagccagccaacgcugcuaucacuugaccacaaggcacacgugagcccuggggaaguuagcaaaaggaccgcccagacagucacaggacuguaagaaauaauacaucauuccuggguuaggccauuccacuugggacaguuugcuagggaucaaagguaacugagacaugaaugcagagugaaauaauacaggaaauccucaacaacaacuucacaauagauaggaaguagacuguauauggcuguugcccauaaaaacacuggagacacaacaugaaagggcaguucagucaacaggacucuguauggagcaaaaucuaguacuauccacaguuuguaccaaaaaaaacccuauuugggguauuauauccccuucuguaacacagaaaaagggucuaagagagccugcgcauccacagggcuuuuuaaaacagcuuuugagcuuuaagagccaucucugauagaaccaacuuauucaucugaaaguuucguguuuuuuuuuuuagauggagucucacucagucacccaggcuggagugcagugggaccauguuggcucaccgcaaccuccaucuccuggguuuaagcaauucuccugccucagcuuccugaguagcugggauuacaggcgcccacuaccacgaccggcuaauuuuuuuauauuuuuaguagagacgggguuucaccauguuggccaggguggucucaaacuccugaccucaggugauccaccugccuuggccucccacaucugaaaguucuuuugagucuucugcuggaagaagagaugcagagaucauuguauacagggaggcccuggcccucagagaucagaggugagugcaaggcauggugugugauccuggccacguccaacgcccuuccuaaggcucacucucgccuacagaauggggauaguggucaacagucagcacaaaggauuucuguagacaccugguacaaugccuggcccauccuacauguuugauaacaucagggauuguuauuagcacuaguggaaaaucuugauacuaacaguagaaucauuucacuaugacagagacaauggguuggagaagcacuucauggaagggagugaggaaggacuaugagaugaugguggucauccuggagaaggauaaucgucugaucagugagcagaaacuaaggacauuggccuaggaguggggaggagggaagcaccuggguggugcggcugcuggauucagacgacaccccacagagaggacuccccacuccccuuggcaacucuuggcagucccagaaggcacagcagcugacuccuccagaguaggaacaaagcucuagcaaacagggauccagccaaaggccagccaagcuggcacuuccaacagguccacaaugaaacagcgauucaaggaagaggagggucauugcacccaaagccagccagccugcagguggggggagguagacaagguaucuucucccucaagcugaccgacaggcacuuggccugcaugagacaugcagucuaucaccuucaccacguacagccugcccagugggaaccacaacggcucggggugaucuggcacccucaggucacugcacacuucacgguuucccccuaccccauguaggcucaguguggaccucauggcccaaacuuagagcaaagugaccguccccuccccucugagaaaaguaugacacaucugauccucaacuaaccggacuuuaguuuuaagccucucuuucagaauagguagaaaugaaaagcagggauccaaacaaagaaacgaaauaauugggugaauuucuccgguugaccuagccucacacucagggucucuuucuucugauccuucuaauaaacucaggggagugcugaacacuuuaagagaaaaagcaguagaaggcuuugccuucgugugcaaagaugagauaucaugggcauuaaaugugauugcggagaaaggagcaaucauggaccaaaacccugucaauucccagguaaauaaagccucacaucaacagcaaagggugcagccaauagggcagggguacagcguccuuucccacggcuggguaaacucaaaggaauguuugcggauuacagguuaaaguguacgcuuuuuugaaugcucuguuucaaccacuacucucucucucauccaaaagcagugucagcaaccucaccagacacaugccaccugccccuucaccuacuucaaacaucugauguaagaauaauaaauugcugcagaggccacugaaauccaaagcggcaugggggcuggggcacugcucagacacacuagguccaagguucaauccucuuuguugccagcuauucacgaccucgugugcaaacgaacaaagccuuucagauggcauucauccaacucacuugcaggcugaugguacaaaaucuuuaucugugaugggagguggcgggguggguaggggguugcaacaugcaagagcuuccagaaggagagaaaggaccugaaaggcugcugauuugcaagccugacuugguuuacguggagggaaaugacaggaacacuuacaagacacuuugccagagccccaggccuucugucccauggggcaucuccaguuccguggcccugaccagcugcuuccacucuuguggauaccaggcucccuggaagagucucaggucaagagagggagcccaggcuaaaaagauuuugcaggucauaguugcugugcauaaaguuuggcaaagugccucaggaggccucccucuuacuucuauguuuagcuuuuuuccaaaauaaaaguuaauguuuucaugccuuaguuuccccaucucugagaaaagacagugcauauauaauguaaucaggucuaagcuccagucucuccagaauccuacaaccaacugcuguguucaggccuuaucuacagacuagagaacugcacuaguuccuggcuggaaccucuggccucaucuccccacgcuacucaucccucacacaacacgaaaugcccccuucauccugccccccugcuacccgggccucccgagggcucucuguguuccaccacgccccaugcaaacauuucccuuucaaugccucuggagucacaguucauccuacccauucaaccugaucugugcucaguucuggccuguuccaugacgguucuccacauacaacaagauccuucucacuucccugacuuggcuuaugauuuuuuuucucugcuuuuaaauuaaaaguauaauuuacauacaguaaaauucacucuucuuaguauccagaucugggagcuuugacaucugcauauagucaugcaaccaccaccacaaucaagauauagaacagugccaccauccuccaaaacuccccugaguacauuuguaguuaacucucuucuccagccccuggcaauccuugaucugcuuucucuguaguuuugccuuuuccagaaugucauaugaauagaaguauacaguauguagccuuuggaccuggcuucuuaaugcacauaauguacagagauccauccacauugugugaaccgugcuugucuccuuuccacugcaggagguaucccgccacaugcugcauuccaccauguacgcaaaccacagcuuguucauccauuccccagucgugggacaguuacguaguuuccaguuuuggcaaauaugaauaaugccauuaugaaucccaagagcacauaaauuuccauuucccuuggauaauaucuaagggugggauuacugcguuguaugagaacauguguuuagcuuuauaagaaacugcucaacuauuuuccaaagugguuguaccauuuugcauucccacuggcaagggauaagaguuccagcugcucuauguccuugccaguacuugguggcauuuuugcuuuuuuuccccccaaagccacuccccuagguguauagugacauaaugcagcuuucuauaaguuugcuauaauggugcuuacgacacgccagguaucaugcucaaugguucacacacaucucaauuaaugcucacucaauacuacacaguaaguuccaauguuuucucugcuuuuaaaugcaucuaaacugaaguggcaucugaaccaaggucaaaugaccacaguacacgaggccuuaaaugagagcccuccugggauggucuuauuuacuccugcagggauucuccacaauucucucaggcucugacucaauguuaccucuuucgugauaguuucuccaaaucaaaacauaauacagcccagucugaccuugccucuuacugcacuugaucagcucucuaaugauagaaccaaaguauuuucaaaacaguugauguuucuuaucucccaaacaagacggcuagcuuccucaggccagaggaucugucuccccaacauuucaucuucacauuuuagggacugacugaaaugaaucagaguguguagacaguguucugacaucaaaggaugagaugugcuauuaaaaaaaaccaccaccaacuugcuuaccauggccccgaguuccacauugcuuucuaaagccacaaccugcagguuacauucugccccugcauuagaaaguuaagcaaauuuaacugcagaaaaugugauaguuuaagggccaaaaaaauaaauugauccgugacaaacgauaauaaaauauccagcaucuaggaagcauguugaaaaugcuggcaacuuuaugaaggaauaaucaauuuuaggaaacgaacguugaagguaaagaaacgcaaaaaggagucucuugagugaacucaccaaugaauauauccuaccaaggacaagcugacuucccuaggaugacauugcaaaccaguguggaagccagaaacaggccuaaaaugacacggugaacuucagccauguaaccagcccaauauguacaaugcaaggaguuuucuccccaagauucaggauccaggucuuugcuguaaaacacacacacacacacacacacacucucucucucuuucucucucucucucucucucucccucgucugcucccccaucccaaaaccgcaccgucuccagacaucaaccccagaaggucaucaccacccagaggccaggucuacgugguauuccacuuguaucuaaaaucaaugacucucucuucucuuccccacccuaaaaacacaaaagcuuuacucuucuaucacccacccacagacugagccccaugaccaggacacagucucucccacccagacagagcccaccacacaggcccuuagcacugaucccaugguuuuccugaucugacacaauaguucccuccccucuccauguggcaaaaucacuacagaauuaguccuuuuaaagcaaggcuuuuguccuccacucagaacuccugagugaacuggagguugacgccgaaugucuuagcgacccucagagugcccucacgaccuggcccucaaucuaaucucucucuuccagucaggaugggccauuugugaucuucugugggguccuuugugcuaugcacuugggagcccaguuuugggguuauaaucacucuuucucuuagaaauggucuucaaaugacaaaagcuccaguccucacaaaaccuagcucugcccaugggacuguccugggagaguccugcccugucccucccagccccaaaggaggagacccuguccugauucagucauuccugaucuguuuuggaagauccugaaagaagcuaaaauuucuuuaucuugacccucucugaauaaggcaguuuuuaaaacagcuacagguugaauuguauuccaauuuucaguucaaggacagccagcugaaaugaugaccgggauuaagagaugagcuauaauuagggagaggccggucucucccggaggucagcggcugcaggcagggcccaccuccgagcgaaaaccugcagggagcccuaggcagccaacgaagaacagggcgggcaggagccagcacaagggcucucacaaccccaugcaggccccaaacggugacugccucaggacuuccgcuccacagaugugagagaaagugacgcucucacacagaagggaaaccgaggaccugggaaauacuuccgcagaaaacugcacgcggaaacgggguggggggugcaugcggcgcggggcagccucaucugggaggacccugauguuuggaaaccaaagccccagccccagaccaagaccccauccagcaaagacccuguggucagagaaagucuuuuuaagugcuaguacguaaauauuagaacugcaaggggccuuggaugucaugccaaaugauaaaaccacaaguuaccaaugugauaaggugaguuauaaauaaccugacagagacuaccugaguaaguaugccagggcugccauaauaaaguacuacaaacugggaggcuucaggaacagaaacacacuuucucacaguucuggaagucugcgcucaaggggcgacaggguuuguuccuuccgagggccaugggggaagaugcuguuccaggccucucuccuuggcuuagagguggugccuguugucuauucucuugucacugucuucccuccacgugugucuggcucugucugaaucccccauuucauaaggacaccagucauacuagagcccaugcugacgaccacauuuuaauuugauuauaucuauaaagaucuuaucuccaaauaaagugacauucugagguccuggggguuagggcuucauugucccauaauacuaccuucucucccagaaauuucucagaaggggcagaauaggcaaauauaaggggguccagagaucucucaccugugccgguuuggcacauuccuucugacucaagauuauuucuuaaaaauaccaacggcaucagcucuguaccaacucggggaaagccagagcagagggugaugagcuaaagggccgggguuucuuuucuaguaagaauguggcccacguggagaaaaacuuauccacuguggacgaagggccuaugucuccacugcaagugcaggguggacggcagcuugacuucugacaagacugaauggugaaauauugaaaauguacaaaauccacauccccguugcacaauggcaauaugcucuuggccucacagcucaccagacacugauuaugcaagcucuuuucaaaaagcacugaggccccaagaagcuaaucugacagagacuuauuauucuccaaacaaugggugaaaagagaaaccauuucugagucuuuauaagguagacacccacgcagacagacccacacgauaaaucugcaugagaguuuguaagaggcacugggcaccaguagcuuuuuuguuguuguuuuguuuuuaccaguagcuuuuaugaacauaucaguuccaccagaccccuccacagagugaauggugagugccaccaaccaggggcccccgaggccacgccaggaggcccaggagugggaacaaaggcuguaauccaucuccaagagcggaguggccucggccagacagacugagcucacugugucugacaaaagaaacuuuucacaacugagaccucuggguuggaaucaugaaaagaacucaggggcguggggcuggaaggguacuuaggggccugaugauuggugaaucuggaaggcguccucagauguucucgaugaauuaauuccccagcccuuucaaaaaacaccaccaaggccacuguaaugcuugcuucuacacagaaagcauuauggguguuuuuucuuuuucucuaauacaugaaaaugugcuuacugugauuaaaaauaaaacuaaaaacgcaaagagacccuuaaaauguugaaggcugaccccccaucaaugacuguuuaaguguguagguguccagucugacuacagaaacacucccgcauguaaggagaaaagaaccgaucauuagcagacaucugaguuugucucaggcauggcaaugggccuauucauuuucauucucucauuuaauuuuaucucauuuaaauguauucaggccaggggcaguggcucaggccuauagucucagcuacuccacagacugagauaagaagaucgcuugagcacaagaguuugagauuacagugagccaugaucacgccacugcacuccagccuggacaacacgguaagaccucaucucuaaaaauaaaaauaauaaauaaaauguaaauaaguauucagaaggacugaacgcaguuuagccaagucaccaaguauugauuaugcuucacucacaguggacaaacacacugaaggcacagaaagauggagugauuuucccuaaaccacagccagagagaaggccauagauacaggcagcagggcaagaagcuaaagccugaggaagcaaaggaaguccaagaaaggugagcaaaugaacaucacguuagagccaaggacagggcuggcgcagauggucacugccucacaaugacaagcgguucaaagaggaagcuaccugagaguggacgcaggcugaggagugucccacucacacaaaacacgagucuguguaggagaaggauuaucuaguucucucauagcuucuucuuauuucccuccuggcuaugcacuauccuagcagcuuucaaacuuuuuugccaaaacccauaguaacaaauaaauuugauguagacauccaucccccaaaccauguauuuaaauauauacguuauauaaauacaugcacgcccauccauccacauacggugucauaaaaggguaccuacucuuacauguaugaugugcuccaguauuuucuauuuaauuauucaucaugaauacugauguuauucuccucuauuaguuucaugaucuacugagucacaacuuacaauuugaaaaaccuugcccucaucuuugaaagagucagguucgagauucuagccaagugucggaugcgcuuacaggccaugguuccaagcccgacuggggauucaaagaaguaaaagggaacccaucagccugagcccccugagagcuuuacuuuugucagaggcaugugagccaaagcaacuccaucuugaauaggaguuggguaaaaugaggcuaaaaccuacugggcugcauucccagacaguuaaggcauucuaagucacaggaugagauaggagaucggcacaaaauaaggucauaaagaccuugcugauaagacaggcuacaguaaaggagccggccaaaacccaccaaaaccaagauggccacaggaaugaccucuggucguccucacugcuacacuuccaccagcaccaugauaauucacaaaugccauggcaaugucaggaaguuacccuauauggucuaaaaaggagaggcaugaauaauccaccccuuguuuagcauaucaucaagaaauagccauagaaaugggcgaccagcagcucucgaggcugcucugucuauggaacagccauucuuuuauuccuuuacuuuuguaauaaacuuuucacuuugcacuacggacuugcucugaauucuuucuugagcgagauccaagaacccucucuuggggucuggaucgggaccccuuuccuguaacacugguucaucuguaguugaagccaucaaugaacugaggagcucugcuuuccuuccuuagcuuacguggugggcacagggacauguggggagauccuacagaagaaggcacugcuguagagagaaucagaaauucuccucccagggcuaucuuggggaggccggguagucagaaaaucauugcuucuucaggaaacagcacuguuuacaaaacaacuagaccaugcauuacuucgagggcaucauccugugccccaaagccaccuuacauaucuggcuuggccaucauccugagcuuccuggaggcacuacguggacaauccgacccucaucuucuaccaucacccugucacgggugugcagcgcugugcugcgaugucaacgguggucagagcaagugacacaacagugcguucuacugggacacuucuccaggggccuucccuccaggaggacaucccggagguccagaaagcugcaggggaauggagggaaaagacaacgguggccacggugaucgucaacuguaaucauuauguuggcaaagcuauaaaaucaaacccaggacaccacacaagauccugaacauauuuccacaagaggaagaauauugugcuccaggcaacccagguagugcaccuuaaauaggaaagaguucaacaagucacacaaaguuacagacaccugcaugccgggugcaccagccucguccugaggaguugagaaugguggcccuggcugggaauucucuaaguugcucugccacugggaaaauagauuccuuagggaagcaaagaaaacgauggauuccuuugugcucagaagacagcaggcuuccauccagaaaacugcacagucagggccaagcagucaaagcccccauucugaacgccaaaucccugggugggaaaaggagugugugucugugccucccgccauccuagaaggccaaggagaggcugaaugucgcagcgcauucucuaaugaggagccaggcacuccaacugcuccacaaaggugucuuagacagaauuauaaguagagcuuaaggucuaaaaacaaacaaacaaaacaaaaaugcucuaccaaagagaugagacuuuccuuucagaaucaagucacacaucccuccccaauuuccaacuccaacucuaacagagacauucacuucucugcaaagguugcggacaaaaacaaagcgggcagaaagaggaaguggaaggaguuguuguacuaugucuuuuuaaagcagcuguuggaaaccguuucaaagguugaaaaaggauuuuuguuuuauccaaauauaaguuucugagaagaaauaugacaccuugggugauguaugaagucaugccuuugauuccaagccugucaagccucuucugaguguuacaucucaggcuuccuauggugagguaaagagggaagcuucgguacagaaaaacggcagcacacggagguaggcagcuuugcagucaccaagcaggcgauggcucuccuggccccagggcggagccagugcaugucuuuuaagccacucaugggcuccgcauccaggaauggagagcacccuccuaggucucugccucagcagccccacaagcccacccagccauccucacccugggguccaucauacuguguggcugucaaccucuauuaugguauaauuaagaaagacaccaacgguguugagaagcguuucugagaauuaaaucaagagugagaagcccucagaggcaccccaugugucaagaucaauugaucugauggccaccggagaagcccugcugaaacaauucggcaaaucugcccagagacggcucugccagucucuggagacagaacucuuaaagaggcaggaaagaccagagggagguuuugcaguuauucacgccaugcuauucuaaaagugaggagggcuuggcuguaauuucccacucuggacauugaaugauucaauguaucuguuuauauuuacauggcugaggcauaaaacaacaaaacaaaaagcccacucccaccucauuaagcccaccuagguaacacuguggcaggacgcacacaaaccaaucaggcgguuuuuaaaaacccucaaaaucuaaggucccucaaccgcuuguugcacucaauacaugccccugucuacaguggcucauccuagaaucacuacuacagagaaggacuauguuuaggcagaaaucuugcugcccucaacgccagaccuaagaaucacugcaauaauaggaugcucaaaccaccaagcuauuggcagccuguaagagaaacacccuauaaaacagcaagcaggcagcaaccaucacccacccuccagggauguuccugaacccagugcucaaccacacaaguccaaucuagguggccucgcaauguccucccacccgcuccaggagagacaaggucaagaccauaaaaugacuucaggagccauaaaagcagaagcagcaccuucugaaaucaagcaaucaagaauuaaacaaguaggcuaggcucaguggcucacgccuguaaucucagcacuuugggaggcugaggcagguggacugccugagcccaggaguucgagaccagccugggcaauauggagaaacgccgucucuacaaaaaaugcaaaaauuagcugggcguggugguacgugccuguggucccagcuagucagauggcugaggcaggagaaucauuugagcccaggaggucaaggcugcaaugagcugugaucacuccagccugggugacagggcgaggcccuguuuaaaaaaaagguggggaggaguggggcuggguaugguggcuuaugccuguaaucccaacacuuugggagggugagguggguggaucucuugggcccaggaguuugagaccagccugggcaauagagcgaaacccugucucuacuaaaaauacaaaaauuagcugggcauaguggugcacaccuguagucccagcuacucggaaggcugaggugggaggaucaccugagcccagggacaucaaggcugcagugagcugugaucacaccacugcacuccagccugggcaacaaaccuugucucaaaaacaaaaauagaaagaaagaaaaaaaaagaaaacaaaaccccuugaaaaggcugacccacacccuggaguuaacuccggaaggcgagugagggaccgcuagaagcaaggcguggagccgccucugcagcaaggacagagagcacuuguguuaaacgagggcuuuccagggcugugggaccuguuggaugcacccagguuaccugugacuugcagauuuagaaaaggaguccacagugaggaagggacugugcugaacuacuccagcccugaaaacgcccccuuucccuaucagguuucuggcuucagcucuaggaggaaaauaacgcagugccacagggcucucccucugagugcacugugcacgccccgagcuggccacugaucugguugugccggugggcagcccuucaccuaaaguccaccucguggcucucagccacgcagcgccacugucuuuucagauuugaagcuuuaaagcgggauggggaagagugugggcaagugggaggcauguguccaguggggcuggacacacacacagguauguaagagggcugcaccuguauguaauaauacagugacuauccucgagguugcugagugaucauaguuuaggaaacuaacuaaacagggacagugucuggggacagagcguuugcccugaagguguggacgugugcuaggagcaucuaccacugccaaccuccaacaagcaaucaugcuuagaaauagcagcuaaagacgagcucucuucaugaagccugcaaugccuuccaggcugggagccagaggugacccacaggcagagcugaggcccucacucaggagacagaagcucuccuucaacgggaagagggcaacagggcaggaaggagggacucuuggaggaggaaggcagcuucucucaacagugacuguuuagccucaaccacugcaggggaauguggccacaccacuagccagccacuguucgcagaaucgaagaguaggccaggaguggcccuggccugagauuauuuuacaacagagaagaaaagaaaagcccccgcgggaccaggaaaggagaaccaguggccaagccaggcacacggcagagcaggccaugcuuucaagggagaggcgacaccagucucagcccacagcagucccguggcaggggcucuaggaauguuggccaagagucaaggacagcaaagugaauauaggcaaacccacaccuuaaccccaaaguaggcggcuuucagcuagaagguuugaacacaaugaauguugaauaaaaugaagucuuuauaauucacggucgaucuuggaaacuagaaaaugccagaggaaaggguuucaguucaucaguccagggacaacaucuuggaaggaacacaaagguaauuccuccaaauugaggaugcugucaaaucagagagcauucuuuugagaaucauggucugaaaucucccccagcuuggcacugcccaccccucauccccaacaucucaccagcuggccagauaugcagacacugccuccuguuucucuaacucuggccccuccuucccaauucacccugccacagcugaaggccugcuucccuucucaccugggcucuaguggcccaccugccuccugucuguccccugccacgacucccacacagugcggccagcgggacagacaccgagaucugacagugcaggcgguagccagcucuggacugcagcauacaggacccugcgugguucuuaccuaaccuccucacaggucacguuuccagcauaacgccuccccgccaacacguggggccgcucugaggugcgugcagccccuggcaugccauuucacuuacaugcacgacacccacccuaugcccucucuccuucccaccccucccccugcaaccugggccaucccuccagguuagucccaaugccguuucauuaaugcaucuuacuauacuaauuuguuuccuuuuccuaaaugccccagcucccugagagccgaguuugcuccuuucucaucuaauacugagugugcaguguaugguugguauaagguggcugaguuguaaaugaacacaggagugcuucccaagcaggcuuuucugagcccacaccugcuucacuccaaccgggucaggaagggaggcaggcaguggccuccgaucaacaccuccagaggaaaugaaaauacuguccauauuaaggaaauaaccagaaaugugauuuagcuauuaacaaaaaaacaaaacugaaagaggaagaggggugaccaggcacacauaagacaugaauagcugcgaacaaguucucagaccuggugcgggagagaaggcgcgggacuccucccaaagcuuccuccuccagggcucccuaacgagauacaugaaaagggaggggaaaaauaacuacagucuuuuagcuuaucaauuucucacauccaacuccaaacagcagaaauacaaagacugucuuuuucacuccuaacccaggaggaagaaggaaaagugcuuauuuuuagccaagccaaaaaacauaagcagcuacagauuaauaagaagcagagagaaaaaagaacccucacaagaaagcagaaccucaaggaacaccagaagcagguccacuacagcccaaagcagccuggacaaggaguggaccaacgucuucucucuuaaucacaggauaauaaaaaugcaagcggcgagcaucuuugaaaggcacacuucccagaggggcugggcaggcaggcaagcaagccgaaaugcuaccucucauuucuuuacaauuaaguaauuacagggaccuuguuucaaacaugguauuuccaaguccagauggaaccacugccaccaagaagacaggugacguucugggccugccugacgucugggcuugccugacguccugcugugcugcaucaggcaccacacggggcaaggcccccauuggcacuaugccaagguggguggcuuucaaccaacuagcuguggauaagaaucucaaaaggcaaaagaaaaccguguaaaugucuaagccccgaccucagcggaggaauccccagagaaccaccaaguuggcugcauucucuaaaagucuguauuuauuacaaccaucccuacaguaugugauaacaacaaaaacagagggaaaugggggacuggcuucaaacaccagacaccuaaaaggguuccuuugggggagcuucccuugggggaagacaggauuuccaggacaaacccccucagaaggcccaggcccgacugccagagucugaggccuggccaggaaaccccacaaacuuaggggucaggggagcugacagugcagauuucugagacgcucacugagaaauucagauucggccagucugcacuggaaccugccugcuaacaagcaacacagggggcgaucugagaaugggguuggggagggggugccaaggacagucuugguacugaggcaggaggggcccacaggcacaugggucgcucuaaguguaacgggaugagugagagccugcagaugcugcagcagaaaacagaugacgcagcucuggaguggccaucgggagacccuugggaugcuccgccgggccucucaccuugcuugguuuguagguuaccaagcaagagaggagccugacaucacuacacaucucaccucaaggccugcggggagaucacugaaggcugccaaagauaaacucauccuucccacaagaagcuuagaagccacuguaucagcaacaccauaaccucugccccaaaucaaccaccuacucccaggcuuuuuaauacuuuauaguugcucuucaaaucccuuagucuuuaauuaauccucaccccacauaagaacacuggcacaagguuagugguacuuacuuugaaguaagcaucacaagaagaaaaauaacauccgagauuugcuuuaaaacacaccacuaccaccccuaacuccccaccacacacacacaggcauaaacaggaaaagacaaaauaagcauggcgaaauccuggugggugcuugguaccuaagaguauacagcgucuauuguugcagauguuggcacaauaaaacuuucuuaaggaaaaaauacugaagucgacauaauuauuacaaccauaauccuacuuccaguagcgaggaacacaaaccgcccuucacaugcaggcaccggcuacucugagcuuuuaucauuuggugcugcgggugacgcuggcucugugauccucugguuauagagaagccgaguguaguagucuuucuugguuucaggcacaaaacaggacaaauguucuggauacuaacuacugucuccauguaauuauuaacauuuccccuuucauucucaaaagcacucaggucuggacacuaaauagcauggucacucuagauacagggagaggguugugaaauaacagugucaacucuuugacauguggcccagaaggcagcacggagacgucuccuaccccaaccugcucugccucccgauccagguguggccaggaggaucugcaucaagccaccucccacgacacagcugucaagcacucgcaggugcugcuuuuguaaguggaauauguucuggcaaauauaggagguaucguucugaauguccuaagaugugucaccuccauuuaaaagagugcuauuuugaaagugauuagaauuuaaaaguuagcaauuaaagccuaauuacaaagaaaauucuugauaucugacaaacagccaaauaacaggagggaccaucaucaggacaaacaagaugagcuggugaucgcugagcagggcgacaguuaaauucugccugucacagcugggggcaucugguuggcgcaucaaugucacccacgugcguguggcagauaaagacaagcacaauacccuuucaguuaucagagcagcaacagaggccuggaagaacucaaugcuuuaauaagagcguggggcugacacuuucccaugugaaaagcaacaugcugcguaaagccaagaaaaaaccaaggaaguguucaggccgacagacgaccucuuucuccuuggccccuacugcaccugccaugccucuuuacaggucagcagcagcauccacaagaacuucagcaggaccaccccgcaguucugcaugggacuucaggaccccaugaaggaugggcagcggugcugugugacuguggaaccugcacacaccacaccuuguugcugcuucugcucuucugcucucgaaugucuccaguucugcauuucauuccuagcagcugcugcaaacaacuggacaucucuuaccaaaaacuaacuacaccuuccagagaagcucucaggcugcggauuccccugauuuuucacacgcagaaacugaaagccagagagagugaggacccugcccaaagcccagaugcucacagggaauggggcugacagugcccaguaccccaauucccagaauccacugcaagggaaggacuaggagguucagucucuggacucaggcuccaggaguaccagaagccuagaggagccagcaccauucucuucaccagcugcucagacauggacuugggcagcucuccagcccacuccccuaaaaacaguuugaaccagggaugggcccagccugcaggcugcugcucugaagagcagccacaggaaggaaauggcucuccuggaauugcuggcccccaggacccaggagagcucaaaccuucucccaggguacgggccaauucucacauagagagcaucuggcuuuaaaugaacagaaggaggauaauuuauaagcaaguguucagaaaaacccagccuucccacgcaggccccacaguaagacagaggacaagaaguagcugaccagcaaguaugcagacagcauucagcaaaugagcaugcgaacuuaggugaacagagcaggcaacgaccagcuuaggaaaguuacacuuuagacuuccagacucaccaaagcacaggcguauuuuuacccauaauguucuagacacuuaaauggugcuuacuaugcacguacuagguauauuuaauuauauuaacccaggucacccucagaagagcccuaggagguagguacuacuuuuuuccccauuuuacaaaggaggaaacagaggcacacagagguuaaguuacuugccccagaucaagagugaucagcuggcggggcuggauauaagcccgggcccuuaacgacuucaccauacagccucugagcauggggggcacagugagucccccuacacagacuacuuggucagugccacucuaagagccaccuggaguucucgcagacccuguguggcccaagugcggaagaaugcugauguggaaagaaguggccggguggauggaggccaucccuuaugcuuccuguggccugguggacggaugccaucccucaugcuuccuggcugggaugccaccguucuccuuccccacccuccccccaccuccacaggagguccuaaucccaaaaugcagcccagccuuuuauuaagcagugugguggcaaggucucggccaggggugguagcucaaaccuguaaucccagcacuuugggaggccaaggcaggaagaucacuugaggccaggaguucaagaccagccugggcaacacagugaggcucucgucucuaacaaaaaaacaaacaaaaaauuugccuggcauggugguaagcacuugucauccuagcuacuugggaggcagaggcgggaaaauaagcccaggcguuugaugcugcagugagauaugauuguggcacgcacuucagccuggacaauagagcgagacccugucucaaaaaaaaaaaaaaaaaaaaaaggaaaacaaaagaaagcggggucuugaagagauaucuguauacccauauuucacagcagcacuauucacaauagccauaaggacccacguguccaucaaugggugacuagaucaacaaaauguggccuaaccauaaaauggaauauucagcccuaaauagggagaaaacucugacgcgcgcuacaacauggaugaacccugaggacauuaugcuaagugaaauaagccagucacaaaaggauaaauacuggaugauuccacuaacaugagggaccuagaggagucaaauucaugaagacagaaaguagaauggugguugccagggggaggggaggggagaagggagucaguguuuaaugagacagaguuucaguuuugcaagaugaaagaguucuguggaugcgugaggauacugagcuguaaauuuaaggaugguuaagacagcaaauuuuaugauguauguauuuuaccaacuuuuaaggauuaaaaacaaaguaaggaacccagcccgggucuggagccagagccuguacgagucccuucugcgcaguguuaagaugggcaggaucucuccuuucagcuguaauauuaagacuccaggacacacugucaacaaauguugccaacaaaauaaaucaguuccuacuaaucuccuguggggugauccaauucacauucacucacauuccccuugaagaaacagaaugucuuuaagcaugguuaccuacagaucuaugcauucuuguuucguuugucauuuguuucaaaauagacacacauuugcaacgaaugcuggaauuuuucaaugaugacacaaaagcagagaaaauaagaauauagcuauuucagaacuagaaaggauacguaucuucccuuccacacuaucacuugguaauggaaaagagguccucugaauacacugaaauacuguacagcuggguuguauaauggcauauacuacugggagucacauuauuuuguguuuugcuacaugauuuagacaauucauuuacuacugaguuaugcacaagcuuuucccugaggaaaaggggaagggaggggugaggagaaagguucgaaugaucucuaaacacuugacacagacagaacucauugugggaggggagaagauaaaaccauaauacacguuugcagagaagccuccagcuguggcagcgcgucacuccaggaagcacaggcuggaggaagggggaaguuucccgagcaccacugacaguacucccgguuccgaggcuggauuucuauagcaacggacagcagcuucacgggaagucacgcuccacugugcucccauccccucaguaggacagggaccacucucugucaccuaggcacugcuguccaggggcuggggcacugggaagggcagggacuuggcccagggcaguggagccaggcaguggcagggguaggaauccaacuccaggccuuggccaaaccuaccagccacacuacugucuguguacacacuacuggcagggacuguugccugguuaaccaucaccugucuccaaacaugaagcacaggcuggcagaggugagccauccccuaaacccaagccuugggauucauuccuccucucaggcagaggugagcuggccauuaaaaagccgacccccaaggggaagaaagggguguccaagaagcagacagaagccccgugggggagggcgcacucagcagacaguuccaguacagcugacgcagggacccggcagccuggaccaggcacagccucucugggccugggguggucgcaggaugucugaggaaggcugggcugauucaucuuuauggucccuuccucccagggcuacgcaauucugugagucuguggauguacaaccugaaugaccagcccacaggacaauuaaagguucccaggagcugaaagaacuucauuccaaguagauuauuuccgcaacagcccaaagcaaaacaacucuccauaaaccugaguaaucuucauaggugggaacgaaacuggauuuccuuuaauacaccaguucauccuuccuuaccccuuaguccaugcaacggcaaauuauuacgcucgcagugcuuugcuuguauuuuccuuggaauuuuaccaaaaaacaaaaaaucccuuacuauucuacugcucuuuccauugguggccauuuucuuacaauucuagcuguugucaguggaacaggugcugguucuggacugccugauaggcuuacaguggcuccccuccaggcccagugccagcagcccugcugcagaauaaccguccucccuucauggggcaggaggagugaggcguugcugaaggcagaggcugagacccugaacuccaggcugcacugugcugucuuagccuagaagaggggucuuggugugucccaugcagcuuggaaguuguggcagggaaccgagagggauaaacuucucaucagaagggacacauguggccaggaaggagcacuuggcuucaacgauaacaucgggauucuucagauuuagcaagaggacccugauuguucucaucuaaaugucuucauuuaaauauaaaucucugaaauggggauuauuagauaccuuucaaacaguaaggugaggggaccaaagccggguaaaguggcugucaauggucaacaggaaguagcagcuagaaaaagccagaagcucuuguuggucuccucacaccauaacccccgugaggguagacacugagugcucaugucagauguguuugaaccagagugacuccaucuugaauaggguaaaaugaggcugagaccuacuggcugcauucccaggagguuaggcguucucagucacaggauaagacaagaggucagcaugagauacaggucauaaagaacccacugauaaacaaaacaggaugcagugaagaagcugccaaaacccaccaaaaccaagauggcuacaaaagccacaccuggucauccucacugcucauuauaugcuaauuauaacacaauagcuaaaagacgcucccaucagugccaugacaguuuacaaaugccauggcaacgucaagaaguuaccguagauggucuaaaagagggaggaaccuucaguuccaggaaaaucccugccccuuucccacgaaacucauaaaaagcccaccucuuauuuagcauaugaucaagaaauaaccauaaguauacucagucaagcugcccaugccacugcucugccuauggaguggccauucuuucuucuguuucauuuuuuuuuuuuuuuuuuuugagacagagucucgcugcaucgcccaggcuggggugcagaggcgugaucucagcucacugcaaccuccaccuccuggguucaagcgauucuccugccucagccucccaaguagcugggauuacaggcacgcaccaccaugccuggcuaauuuuuguguuuuuaguagagaugggguuucaccauguugaccaggcuggucucuuacuccugaccucaggugauccgcccaucuuggccucccaaggugcugggaauacaggcgcucugagccaccaugccuggcccuguuuauuuucuuaauaaacucgcuuucacuuuacuccauggacucacccugaauucuuucuugugcaagauccaagaaccguccuuuggggucuggaugaggaccccuuuccaguaacacuugggcaauggcagaugaaaggagaagaggccacagacagaggucuggaaaagacgcacgcaacgacaugcaagguguuuuuucuauuaagucaucacugaacaaauuccaaggagaaaaagguaaaauggaugcaggaggauuagaaugaagcacuacugcuuguaaaacaaaucaaaacuaagaaccuaggaaacgauaauaaugcuguuuaaagacuugaaggaaaucucuauuuccaacaacgucaacagaaaucaaaggagaauauauuucacuuuucaagagugaaagauaauaaaagucaaacccuauacaacaucaauccugagccaaauccuaucuuaucucuacuuuuuucuucuccuuuucaacguguguagcuaaaccagguugcaaucuagagcuggacucguccagaaagccuggcaaacauccacagcugugacaagaugcugacgagccuguugcaguggggucuugaugcuuccacuggggaggaaucaggagaauguaaguaaaaagcaaugaaacuucugcaaauaauuaaguaauucacauccaccccuugaagagaaaauaauuccucccuugucacugugacagccucggcuggcugcccagcugagaacacccagcaagcacccucucagcaaagccagguggggaggggagaggucagccacugcagccugcaggcucucugaccaugggcaccuccacagcagacccucccagccaccaaggacaucuggcccaaacacagcaugaagcagaaguggcuucggccauauccaccaccucugugcaggcugucacacagaaccaaccccaccccagccuacgugaagcuccaugcuggagccccagagcagcgggacagaucacugauucccuucuaugaagcaugugugccucccugcauccacucaggcuccagugaaaagcacuauuuggcucccccaaagcuuauugggugcaggcgggggugggaacaguccacacgccucagcuccacuccccagggaaaugaguaugaaaacaggagcuccagcaggaaagaaucagccuuuugguucaaggaaacggucucuuagcuucggaauagcccacugacuauggaaaaaugcucucgcccccaaccacgcagggccugugugucuggcuucgcuguccgugaggugaaagcauccgugaagcagagucccggcugaacugcgggaaaagcaaaaugcacagacggccggcucuucggucugagggugauuucaaccuguucuuguugaaugaccuuggaccagauaaaugccauugagcuucccguacaauggcacuagcagcaaccucuucccacucgccucucuccaagucccugugaagcuacaaacaagcgguguuuggaaaauucuaauaauagcaucaaagcggaacguugcccccguuauuucugaaguccucucucagacccagcgcuccugaaggggcgcggcagagcagagccgcugcggagugugugaucugaagacaacgccucccucauuagggcuggacauauuccgacagggcaggcuguggcucuggauggggggcagugagggggugcaugcaugugcuggaacucacauccgggagagaaagcgcggcagacaggccucacgaaugaauguguguuuugaaacauuagguucgaugucuaaagaguacaauucaacaacucaggccaccaggaacaggccccacucucuccuggagcucuauggcaggguuaucagaggauggcuggugccagacaugugcugacagggaucugggacagucagaccagaagcaaaugaucaggcgcgacccaaucaacguggcacuaaaacaaugcgugcagguucgaucauaguuaccugacccacccccagaagagugaaaaccuaaauuuccucugcucugucacccuccaacuccugagaagaugggaaggaggugacgcugacuaagugccuccucuauacccaggaaacucugcuagggcuuacacaugcagcucauucaauucuccugacaacgcuccagaauauauccuuuuauccucacuuuacagaagagaaaacuaaggaucagaaagagagcacuuggccagguacagcagcucacgccuguaauccuaacacuuugggaggcggagguggggagcucgccugagaccaggaguucaggaccagccugggcaacacagugagacccccaucuauaaaaaaaaaaaaaaugaaaaaguuagccaggcgugguggugcacaccuguagucccagcuacuuaggagggugaagcaagaggauugcuugaacccaggaggucgaggcugccacaccacugcacuccagccugggugacacagggagacugugucucaaggaaagggaaagggaaagagcauucaucugagaucccucaagugauaaauggcagagacugaauucaaauccagagccgagccugccagacugcaaagggccccccacacucagcuccacaagggagcaggaagaugugcaugucauuaagaucauuuugugccuccaccuccccgccgugugauuuccacacagaaaccugauucggauggcuucuguggcucaugccugacaauucaccgaaagaaaaguaaaaagcaccucagaugaauucagaguuucucuguuagcacaacggaaaugagaugaagaaagcuggaaaaugguuucucuucugaaacaugcaucgcaaaguagaauuacaaagagaaaauagagccacaggaaucggcccaaaaugaagauucuguaucauuagagaauaaaauauggguauccaugacugucuuccucuacaccccucgcauccccacccccgagucuaggacacugucucuaccauuucucaccccccaugagagucaggaccaaacaccaauuccaggaugcauggcuuuuccuguuccgacaucucugaaauggggaaugcaucuuaaaauugacaaaaugauggugcaucuuacaacccuuagcaccuaaaggcucaaauuaauacauuaauauugcuuugaaauuaugugagggcaaugcuuuagaugauuugaaacacucucagauacuuccucucauuuaagccucacaacaggcaggccaaauagguuuuuaguucacacugaucauacuuaaauacagcggagaaacuggcugacacagacaacucagugauuugucuaagcaagugguagcaccaagacuggccuuggauuuucugagcacuggguccacggggaggaauccaauacugaagugcagaugacacgggagagaugcuggugggcuugccccgauaccucaccugcucgcugcuguaucaccccacgcccagcuccucucagucacacagccaagcaggcgaagaguacaacugugaaaugucucaugagcugauacagaaggaguuuauaaauauugagcacuacuggccuuaaaaaaagcugcuccucuccaccaggucuggguuggauacccuccuccugggcccaacccagaaugaggggagguuugagagggauacaccacagauagauagauacagcuucucugaaaccaaagaaauaacaaaugguugucucaccugaacaacugguuaggaauugggggaaggggauaaaaccaacuuagagcugcacuucucaaaaauaccaaauaggccaggugcaguggcucacaccuguaaucccagcacuuugggaggccaaggcgggcggaucaugaggucaggagauugagaccacccuggcuaacguggugaaaccccgucucuacuaaaaauacaaaaauuagcugggcaugguggcaugagccuguagucccagcuauucgggaggcugaggcaggagaauggcgugaacccgggaggcagagcuugcagugagcugagauugcgccacugcauuccagccuggugacagagugagacucugccaaaaaaaaaaaaaaaaacagauucagguggaugaagaguuaaauaucaaaaucaagcaaaccaaccaaguaucagaguaauauguaauuaaguauuacuuaccugaucucugguugagacaagcauuucuaagcuuaaaagaaauggaggaaaccagaaagcaaaaggaugagaauuuaacuacauaaaguuaagucuccucucuauuuaaaaaaaaggaaaaguguggggaaaauauuaccuaaaaauagacaaaggguugcaauuuguaauauuuauuaaacagcuaacacaaaguaugagaaaagcaggcuacgggaucagguaacacaugagacacuuuucaguucaagggaacuaaagaaaucaaaauuaaggccagguguggcgcuaaugccuguaaucccagcacuuuaggaggccaagacaggcggaucaccugaggucaggaguucgagaccagccuggccaacauggagaaaccucaucucuaccaaaaacacaaaaaauuagcugggcgcgguggcgggcgccuauaaucccagcuaaucuggaggcugaggcaggagaauugcuugaacccgggagguggagguugcagugagcugagaucaugccacugcacuccagccuccagccuggucgacagagugagacucugucucaaaaaaaaaaaaaaagaaaaaagaaaucgaaacagaaacgucaacuaccaccuaggcaauaaacaaagauuuuauuugcaaauauuaacgauguggcaaagguacaaaagagucuucuggucugaguguaaacuuguacaaccuuucuggaaaagagcugagaacaucuaucaaaagccuuaaaaauguucaaacucucugacccgguaauuccacuuuuagaaaucuauuccaaggacauaguaaagaauguauugcaaagguuuacauaaaaagguucaucauaaguuacaaaaccaaacuagcuagguagauuggacauauccauacaauguuaauaaaagcuuuuuagaucauguaaaaauacaauauaguguuaaaacuuucaaggcagggaaaaaaaccaaacugcaacacauuguuaccacgaguauauuaaaaaaccaaacagaauaaagccuagaaggcaccgugguggggaugcuuacgcggcaugaauuauguguuccuucuuccugcuuccuuaugcuaggcuguauuuuuauaauuaauaugcaucaguucuauaauaggguggaggaugacagaggaagaauguuacccucucaucccacgcucaagaaacacaauuccagggcaaaaggaacacagcacaauagacacucggauauucuuacaggaauucagaaagaagagaaacaacuaauauagcaguccuuuauuuugcaacaaaauagucacauuuuuuuaaauggcuguuuuaauucuuucaaccacugguuuguaccugcuucaagaaaugcacagaucaccuuuuccauuuauguaccacuaucuuccaccucuucccaagcaaguuccaagacagucugcaugucaccucucuaguacagucccuuccucauggcucccaaucucacauucucagcaaggccuggcccugcaggaaaaccaaaggaagagacagacccaacuagagggggugcaggacucagccucugcgggcuuucacaggguucaaggagcugugauggaaggcagccucaucccacugugacgcucccaguaucagcuggagagauggccaccaagccccuggacagaaaaggagucugguguguucuucccuuaggaaaucugggugauuuaacaguucucaggcuggacguccuggucuccccuaccccuaucuauuucggggcagugaaaaccaaaucagaagagaguuacucccaggacccuguugcugaccgccacaguuacuacuguuacugcuacuugagaccgucauuacgagacugauugaagggaugaauguagaaauaacaaaaaacaaaaguaacuauuuuaagggaaggcuagcauggggaagaagagagaagaagaagaggaaaaaggcacccugcuucuagugagcaaaggcagccccccuaagcuucuacagcccuuccuauuuauuggguaacaagagcaggaaggagguaacgauuggucagcugcuuaauugaucacagguucauacuguuacuaacaggcuucaaugaugccuaaucauaagaaacacuugcgucugggucauaacugcccucagcaucacuucuggguggcagacgcaguuugucaguuugccaacauucugcauuuaugagaaacaguucgcugcuuacuuacauagccuccagugguauacugaguugaucacgacccucacucuucggccuccaacaggaccccauaccuggaccagccaagccccugccuuaucucuccagggcuuguuaccaaaccgaacuucggucuacuuggcuggugcagcggagcuaaacgcugacaucaggauagcagcgagacagugcgagguuuaaauugcagggugccaagcaaggagaauuggguggcuagugcuuaagaccuaacucccagauggcuuacagguaaggguuuuuaaaggcggggaggcagagguuacaggcaaagucauaaaucaauacaugaaagcucugcaugggauugaccuagaaaggugggaugucucaaagcagggcccacaggucaaagguggauucaaagguuuuuugauuugcuauugguuaaggaagcaaagcuuugucuaggaauuugggaucagcagaaaugaauguuagcaucuggccuguggaagugucuuccuccaggccucucagaaagaaauuaaaacuggcggucagaguuguguccucaguuuucuguuacccgaggucuaugugcugcagacagcauuuauuauuugguggggguccagguuucuaaaaaacgacucagggacauauguuaagguauuuaauuuuuauaaaaaaaaaacaaacguuuugugccuagcuuuuuagauacuguuuuaagcuaucuuguuuauuagguuguugauuucuuucucaaggcuagcgagaugccuaguuuuuuuaauacuuaaauuuuuaaaauuuuuauguuggagggugccugacaggcuccuaagagggguuccuacccugucucaggcucagccuccaccuuucugcucccaugagacgcagggcagucacgggugugggccagcccucccagugcuuucccauuuaagcccccacccgcccacucagcuuucaucccgacccaguuugcagcuucgcuggugucccauaaacucauuaaagugguuuagccauggucagccaagcuugacugaacauacaggagcugucgccgagacuuccaaaccugcuggaguguaaauuccagacucuugaucagcagaaaucccacuuugggcacagccgggcagcagcuccgggcugcuuguccuucugcuccugcaugggagcauccuacuuaggggagacacaggggucgguccccagggcccgguguuccugauaccacgugacucacgcuggcugacucccuaguaaaccccaaacugccucuguaucaaacugguguuccuugaagcaccucauccaacaguggggguaaacaccaggcucccaaacccuucacaaccggcugagcacagggaguccuuaacaucagccagugcccagcaguguccagaaacgagcaucuagugagugcuuucuaagugccagaccccaugcuaagugcuucucccaagccacucgguggcuauuaugagcuaagguaucaugaggccuggcugcggcagcgcuguggguaggugaagaaaucccucaaaaucuuaucaugugaggcaauuagagagguuuagcuuacagaagaaagauauggaugguaguagaaggcgggaugagaaaggucuucaaauagcagagagauuuucaugugcaagagguauuaggacuacaaaguuccacagugaugggcaucagcucacucaaagcuucagagacaagagaggacugcagggaugguagacuugggcuccacguucuacaaguaagaacauggaggucaugcagaucucaaggcaguaauccugcaauugugcccguucagcguacuucagcagacgggugaugccuguccacaggaagcugcagaagcaaugccugcucugcggagccaggagcuuggccuggggacaaccugugguccuuucagauccaaugcacugaugcugagugacuaacagaacucagcagccuuuucagugucaggucaaccagucacagcagaaggacacucggccaacccccagcagcaugcagaauacccaugaacaaaccugcacaugcacccugagucuaaaacgaaagcugaacuuuuauuuuuaagugacagaauuuuggggggaaaaaaaguaaggacccuuggguguauuguuuccucuugaaagaguuaaauuugugagccaggugcagugguucacuucuauaacaccaggacuuugguaggccgagaggggaagaucacuugaggucagaagcucaagaccagccugggcaauacagcaagaccccaucuuuacaaaaaaaauuaaaaaguuagccagacaugguggcaaacaccuauagucacagcuacuuaggaggcugaggagggaggaucacuugagcccaggaguuugaagccucagggugcuacgaucacgccucugcauucuagccugggugacagagcaagaucucaucucuaaaaaauaaaauaguaagaguuaaauuuguggauuuucuaccccacuaacaaacagguuauaggacaggaaagaaaaaagucuaaagaaacagaaaaauucgcagcauaucugcagucagaauuuggcuuugaauccuggcaacacaaucuauuuugagcaagagacaaguuuugcuaauuccuaaugagccagauuagaaacagacuacaaacgaacagcaaacucaucauaaaauuaugagagagcccgaaauacaccgaaugacugaugcgucgcuagcggcggcauuuggccacugaguaaaagcagggugugugcuucacaagugucgcgggggcuucaggaagaaggagcugguggaaguauugcugauaauccagaaaauccucuccacugacucaaacauccacaaagugccaggcugagcugcucucaacagugcugaggcaugagauguccccgaaccagaaagcgcaggugcccuggauggggcucggggcaccccacauauaggaagaugggggcuuaggaaggcuguccugagcugaugcucuggcagaaagaggaacuuccaagagaagaggagacuggagcaaggaaggcccugaagacagaugccucccagccaacacucaggcucuugugacacucaggagagacuagcuugggggaaaaaaggaaagccuaccuccccccaaccacccccgcccccgccacacacacacccuuaugaaagucccuucucuaagaucauuccuguuuuacuuucucccuuaccucccuauccaaaagccagcaacuccagaggcaacccagaagccaguggcuccaucccuggugcacaagacccaaguggcccacugaauuuaauaagcagccaugcagacgcugggcucuguggccuccacagaacagagcuucggggaagaggcagagccccccaaaacuccaaguggcugacggcuucagggccacaaaauccauauaacaucggagaacacacgccugcccuuguacacaccacgacaagcgaagguccuguuuuccuucauaaccacacacacacacacacacauucuccagcgcacuugcauuuagaaguaccugcacauggugagugcgaugugacagagaggcuaugcuauaggacagauggccccagauggccagaagaguacuaagaggccuucugggggccugaccaucccuggccucauggguauugguaaggauucagacacccuuccugcagccacccagcuggugaugagaaacucuagagaaggaaagaaaagcugcauuugggacaaaucaucccauucagucugugccugcaucccccacacagcccuugggggccgcugggauagauggcuccucagagggcaccaagggccacagcggcuggcuucacagggaggacugaggggagguuccgucuuggccuguaagacaucccaucuuacaugccacgucagcaauaccgugguaaugaggaaugaguuacagugcaacaauucacaccucaaaagaguucacgcacccaggaguguucugaugaacugagcacgggagcguaucacugaggaggauuacagcaaccaccaccgcgaggggcucacauagauccagcucuuuaaaauuaaaaaaaaaaacccucggccggcacaguggcucacaucuguaaucccaacauuuugggaggccgagguggguggaucacgaggucaagagaucgaaaccauccuggcuaacauggugaaacccugccucuacgaaaaauacaaaaauuagcugcgcauggugccgcaugccuguagucccagcugcuugggaggcugaggcaggagaaucacuugaacccaggaggcggagguugcagugaggcaagauugcgccacugcacuccugccuggugagagugcgauacuccaacucaaaaaaaaaaaucuauucauaaugaauuugaaaucaaacuacacuauuaagagagucuuccacagggaugaagggggaggugucaguuuaucacacagcaccagcucaggcggggcucacagcauuaagagagucuuccacagagaagaagggggaggugucaguuuaucacacagcaccagcgcaggcggggcucacagcaggauuuaggguugcugcaaagucacuguuuccgaguaaaguagggugugugggucacaugccccugccucaggcagcaaugggagggggggacguuuguuuaauggguuuuccccaggugcuaaaagcagugcaaaauauuaacaucuauccaaaaaagaggggagacgcuccccccaccuccauucacccacuaccaggaagaggaaaccgccagacugagcaauuagguugcaauuuuacaggaaugguuuaggucugaaaacaaaugucagccccauaaauccuuuucuccucacuccaaauccugaaggggacuaucguccuggccacugcugaaccugcgcugggugcagucacuccuuggcgugccucagucucuccucagcaaagugugcacgugggguuauacgggcuggaacacucuuacccaccaaaaucuaugaccuccaaugagaaacucccaccaucccuuuguacaacuuuagauuuugucaacauugacauuucccauagaugcgauauuacaaucccaugcacacacuuuuccgaggagagacugagguacgugagugaggcugccugcgggaggauggccuucugaaccacucucauucccgcucauguuucuacccgcgaggcaggauggaggcgggggccucucuucccacaccccaaacccucucgaggcaucggcauccguuaguccucaacugcaacccccuuaugauauaagacaaaggucacucuguucccuggucuccaggucucaagaauccaggcuugcaaccuuccaucccucccucucagagcaccccagcgggccccaaaaagugcauggcugcccucucucagcuauacucaucaccaggcccuuuccacauucugcagaggggugccugcccccgccgaacuggcccugccugugucuccacucuggguguuccuacagcccucuccuagcacagcaaccccacacuccugcucugggaaguucccaucaccaucuccacagcucugcugggguugcccccacaccccugcccccacacacucaucuagggaaccucaucauucuucaaguguggcucaggguuucuguuccaaaaggccucccugcuccucgcuccucuuuggcuguagcccacacaccguccucugaacucuggccuccccaugcuugaagggucacuaccugucugugugcugccuccacccaaccucugagcacuggguggggagccaccuuccuucguauauucacauggaaugaagagaggaaaagaaagacaggagagagacauugaaacucugccaauaauccuuucuaggaguggcacacauuccaauccuggagaaaugaugacaugaggcauggcaagagaguuuuaagagaguucagcuuuucacuuaaacagaguacugggaugucacuguuggaaagugcucacaauuucucaucuaagccgaaguugucuguucuccuuccuaccuuaacaguuucucacugccugaaggcagcugccaaaaccccucuaagcaagcagcacucuuacccaccaaaaucuaugaccucugaugagaaacucccacuaucccuuuguacaacuucagauuuugucagcauuauugacgaaaucccacagauacgauauuacaagauacaaaauuuaagacacgaucuuggcugaaagacucacgauccaaacgcaguaaaccuuucaucucuccuuauucacucugccuuuaauuuaaaauaugugacgcugucaaacaccagccaggccucgcuacacuccugagggaggggucgcuaggaaacugcagaauuugagaaacacagggacauucuaaccagcuauuccuucuuucuccccacagcccccucccuucucuggccuguacaacuuccuuagucccaucucuguuacucugauugugggaaagggauccugcacucuaauugugugauggguuauugcaucuucauuuaugaauucucuaaucugguauucacuuucaaacacuuggcccucuuuggcagccaacaaugcauaaccaggcuugggaagccuucacauuugacaagaauagagaacaaccgcuuagcggagaccagguuacacgucaaauggacucuuuccagcuucaucaacaaauaaagcaaaaucugagugcagggcugaguguaggcuguuugguggaagagaacaacacucuugaaaacagccagcggugcagacaccagggugugcuccuccaguguuuggagggcugauuagugcacaguaaccacagggccacaauccugaguuacuaaccacauagcuggguucucagagagaaagaccacauucccagacaggccacaccacccuagucugccauggggguaaugcaggugggaccaucacggcaggucccacccguccccaugacuccauuuugguugcugaauucaugagaaggacucaggccaaaagaaggugggagguuccaagacuguggcuuuuauuucuccaaggaucugcaaaacuucagauuguucaggaacagcaggaaaauguacugccuugguuccaaaucacuccaaugagaagugcugccugccuccuccaaauaccuggagccagggaauuacucccauuaggccccaccauaguuauuucuggacaugaugcaaccugagagauuuuuucaugccacagguagauuuagggagaacucaauuauauuuuccuugcuuuuuaguaacauuaacacgccacuggugacaaggggacauuccagcuugccacaaguccaguacgaccacagaucaggucagaagggcucuugcgggugauagacagcucuugcagcaauguuuugcaacacaccagcacacaacaugcuuaagaauuggugucucucccucugcugucuccaugucuacaucaaaauuaaagagaagaaaauaauaaaauuaacccccagaaaguaccuaucaguacuugcacuuaauucauuuccaccuaaauccaggccggguaauauucuugacauuguauagaucuaaugacaaugucuuuacuucuuuuuaaaguugagccaggcacgugacugguuuaaaggccacuuaguccaaaggacagggagucauaucuucaggucauccucacgucacuauccacaugcuuucauuaaguggucaaagcuguacguuugaagcuacagaguucaccaaauaaacagaaugacuaagaaaccaaaaccagguguuuucacauuuuuagaguccccugacagugugguucggggguuugguuucuguaucacaucugcuaagugugcaggucauuuucaaaaccacgcaugcugagagacuagcaaacaaaggcaaugaucaugagguuaaaguagacaaaagaaggcaauuaaaacauuuccacuacccaucauauaggagaagaacauaaguacaccuguugccuucuaaauaaaauauauauuuuuccuuuccauaaucguagaaaguaaaaaagacuuaagaaaugaagucaaggucuauuuccacaaaggcucaagcaagacaauaccaaauggguacaaaaugaaagacaacugaaaaucaaagguggagucggcucucagaggucuccaaagcucggugucuaaacuuagcugugcgggcaacacacacacagacauacacaaccaguauacgucaguuauuuucgaacccuggaacucacacaaagacaugaccaaccugcaugugccccucuucaaaguaguccccuggggagacccuugguauucccaugaugcugucaucauucaaaauauuucuggaacuccccuaacggguuggcccccagagacaacagcauaauguucauccucuaaagcacauuuguuuuuuggaaacagcuaacaaccacuuggagccaagcgucacgaauaaggcaggugaucaagcuuggaaauuuuguucuuggucagaaacucacagugggcaccaaauggcaaguauaauuucuccuaaggcucauagacuagcugugaccacgaugccaaaagcagagguucaacaauguucugaacgcugaaaauaagugugaagucuccuaaacagcaugcuugaaacucgccacuuugaauacacuuguucugauuagacuauuacaaccagccuugugucuuuauaacaaugucuugauaaaucacuacugcacauccccaacucaauguagccccaagcaaguuauuaauaacaaggggaugcgggacacuucaacugccaaucaagagacgacaggccacaacccugcacagagaugucugcauuccacaggcagaugucaacgcccaggaguacgugcagacauaaauaugcacuauacgcgugugcagagaucuauauauacaccacagauucacagcucaucccaaaucauccuuagugggcuuauccuaaauauagauaauaaauucauguuaauaauagcugagaccuuuaaaaugcucugaaggaaaacacacacacacggaugaacacacacacacacguauguacaugcacacacacacacacacagagccacccuuaugcauuccugcacgcugauccacugugguuuucugguuuccuuaucccuggggggaaaauuuugucaaaaagauacacccaagaaauguaagcuaaacacugacagaggccuucccuggaacacuugucccaacaugcuaugauuugaaaagaugagggggucacugagagaccaggucgagggagagagaggagcagcggagcagccacugauuuggaggccucagggcuugggauuuauuuaacagauuuucugaaccucaaucucauggagaaugaauucuuucaagggaaagcgauaucuuuucuuuucuaaccaacuacaaaagaacugguccacuagccaaauauaaucaaguuugguuugguuauauaguuugccaaauauaaccaaggaaagcaccagcugucugucuacccaugcuugcggggcaaagguuuaugaggaaaauggcauuaucccaguuccuggcaaacaaccuguucauaauguacagcaccgcucaggaggaagggugaacacuggauucaaauucuaaacccacagucccagcuagucgggaggcugaggcuugaaugguugagcccaagaguucaaggcuagccugggcaacagaguaagacccugucccuugaaaaaaaaaaaaaaaaaaagcauaacaguauuuaaauaaacuacaaagggaaauauaaauuuauauaucaaaaaauaaacguuauaagauaaauaaauacauucuaaaucccuccuccccucuucuagcugugugaccucgagcaaguuacugaugcucccaaugucccaauguccccuuuuugggaucuaugcaaagugggguaugcaaaagcacucauccuccuggggcugcugaagggacugacuccgugggcauggaaaguucccagcacagucccugaguuacagucagcuauuauugcuuaugaugauggcaaccuacuaaaggcagacacugauguucuccucggcaaaaacaaagccuugugaaauggacauccgccuaauucuccccucaaaccuugccuugaguauucuggaauggugguaggguucuccuccucaaagaaguaacccaucagaaaccuggcagggacaaagaagaggggagugagggaaugcaaccaggauggagacagaaacaaaaagagaagggaaaaaucaagaaggcaaacaggggagggcaggaaagccaacagaguugucuguucacgcacaaaagccugcuggugcuuccuccagugcagggagccugccccaccgcccgccacgggacuaagacagcgccuccucaggugugguccagggacccauacaaagccuucacaaccccacaggcaugugccagcacacagcaggcaggugcagcaccauggcucuugcagaaaagaggaaagagcuggaagugaccuccagaucccagggaaugucaacaaggaaguggcucuaugccauuuggacacuggcuggagaucauugcguuaaacauccucccuucagaggagcaucaggaaaggguacguggccagcaggaugcaguaccagggagaaccacuuggugcguaccauucuaagacauguuuucaauaaauccggagaaagauuaggaguccuaaaccacaguuaaccaauuucuggccuaguguuuacaucaaaguuugcauauaagccacucagccuaucaaaauauuaaggaagucacugggaauuuuauuuuauccaagggguggaagcagugccaacaugaucuagccugagauucagcugugucuggccaugugugacgaccuggggccacagucacuggaaagaagauaccggcagggcauuuagugugugcggaggaggaugagggaaguuuucucucccaagcagccuggggagaggccgaggagaaaggaaugcuguuguuugggugaccagcccuggggagcugugcgucccugaguccugcggaaggaagggcagaucggagcugagcagccauuuucaugacugaucugcugcuucguguccagcuggcacaggcgacacuggaggggagaggcccgggacuccacuuagacauggaacacaguguuccccaaagccgacuccagggauguguggagguaccaagaggguuuguaguuuggcagguuugagaggcaacacccuuggcggggacugcccucuucucgggaagagcccuggagauggcugacaugggagcagaugacauccacaaggcaggcauccaagggcauccaagggcuguuccugauaggcacguccuggaccccuggaacugaauggguggaacuuugagaaaagacagggcaagcugguuaacacuguuacuauguaaccuuacaacaccagcugcugaggccuggagaaucccagguguagccuuuaacaccgcccacucacccccacccccacccccaacgcaugcaagaggcuagugaggacugcaguguaugguggcagacgcuuggagaugcuccggccaggugccgagggcacaggggaggaacaggaaagcaggccgcccugagcccaauagcgaaccgcaaacgcuucccagcacagagaaccagggcucucugggaaaggcugacuccaggucuggggcaggaacagacaaugugaccccgggaaucuuaccacaguauacagcaacacgguccucaaaggccaugacaaucacgccaaugggauguagggcccaccucaagcagcuuucacugaccaaagcugggaaaaugugaacccuaauaauaauaacuggaauaagcugaaaugcaaauguguaaguccacauaaugccauaaaaccaaacaagcaaaaagcccuaucugguuaccacugacuagaaacugauaaauaaaaggaagaaacugacauggguguuaucuuucccccauggacaguaccaccagguaaacaaauaguggggguggggggaguucucuuuauacaaacagccuagcaaagaaauuacacucgcagauagaauuaaaauguuacaauguugaaagccuaaagaacuaggagauacagacacugaguaucaaugguugccuccaccacagaaacccagugcccugugccuccagguccaagagugcagcacagaccccacguggcgagcagccucgcccaucccucaaagaggaagaaacaaaucaaaugggaaucucaucaaggcucuacacccgacuucacauuugcaggaaacagagcacggaggaacauggaaaacuaccccacggagacgcaagccacaaaauccaggcuggaaaacaguaaggcgauucccagcucccuucacaaaaaccuguacgcacaagucaaugaaaugaccaaaagcagagggaaaaaagaaaacuccgauuuuccaagaaccagagguuguaugaaucaaccacagucgguaacuuuauauaaauccugaauuaagaaaaauuauaaauacagguauaacauuuaggaaccaaauggagauuugagcgauaauuaaauauggaugcccuuaaggaacuuguuaauuguuuuuaaguaugauuuaugguacugugaguucaaacuaucuuuuagagacacacacuaaaauauuuauagguaaaauaagaugauuucuggggcccauuuccaggguggucauggacaggacagggcugaccauaggcugaucggauaaaggcagggugaggggcaggcagaguucauuauacuauugagucuacuuacauauauuugaacuuuacuauaauaacuuuuuuuaauugggcuaguaggaugagaggaagggcgucacagaggaggugccaucugaaccgcaucuuacagggcaugaaggccggacgaugcucccaccgagacagugcggggaggagccacgcggggaagaaccgacagccaguccccguagggcaaaggcaaaaaauaguugaggcuggagagaggugggaagaagccagggcuccagggagauaaggaaccagccauacuugugcuucuggcccuacagggacucuggugacccugcagaugguggcacugaugggacuauaaaagagaggggccucccaggaaggcaccacaacagauguggcugcuaugugugacuaaccgcccuggucaaaaaauaggcuugcacacuuuggaagacaguuuggcaggaucuuacaaaacuaaacauacacuuucuauacaguccagugagcgcacucguuggaauuuauccaaaggaguugaaaacuuauguccacacaaaaaccugcauacaaauguuccuaacaccuuuauucauaauugcuacaaugugaaacaaccaagauguccuuugucaugauggacacaucuaggcaaauggauuaacugugguauauccagacaacggaacaguauucagugcuaaaaagaaaugagcucuccagucaugaaaagacauggaagaaccuuaaauacauaggacuaagugaaagaagccaauuugaaaaggcuacauacugaaugauuccaacauucugggauaggcaaagugauggagacaguaaaaagaucagugguuaucgggguugggagggaugaacagggagcacacagacaauuccaagggcagcgaagcuauuccauaugacacugcccagaacagagugaggcggaugcuuucaucagacacguauaucuugcuucacugcacuucacacugauaugcuucagauacuguguuuuuuacaaacugaaggucuguggcaacccuacaucgagcaagucuaucacugccauuuuuucuaacagcgugugcucacuucaugucuauaugucacauuuuggccauucucacaauauuucaaacuuugucacuauuauaucuuauggugaucugugaucaguggucuuugaugauacuaaucauuuuggagcaccaugaaccauacaaaauggcaaacuuaauggauaaacaugguguguguucugacucccccacucacuggcuguucugccaucucccucccucuccucaagccucccuauucccugcgauaccacgauacugaaauuaggccaauugguaaccuuacaauggccucugaguguucaagugaaaggaggagcggcacaucucucaccuuaaaucaaaagcugauaaugauuaagcuuagugaggaaggccaguuagcugagugugaaugcaaaggaaaaguucuugaaggaaauuaaaagugcuacuccagugaacacaugaacgauaagaaagccaaacagccuuauugcugauacggagaaggugugagcagucuggauagaagaucaaaugagcugcagcauucccuuaagccaaagccuaauccagagcaaggcccuuacucuccucaauucuaugaaagcuaaccgugugugaggaagcugcagaagaggagcugaaagcuaggagagguugacucaugagguuuaagggaagaagccaccuccauaccauaaacgugcaaggugaagcagcaagugcugauggagaagcugcagcaaguuacccagaagaucuaacugagaucccugaugaagguggcuacccuacagcagccuucuauuggaagaagaugccaucuaggacuaucauugcuagggaggagaugccaaugcuuggcuucaaagccucaaaggacagucugauucuccuguaagaggcuaauacagcuggugacuuuacauugaugccaaugcucauuuaccauuccgaaacuccuagcacccuuaagaaugauguuaaaucuacucugccugugcucuauaaauggaacaacagaacauggaugacagcacaucuguuuacagcacgguuuacugaagauuuuaaguccguguugagacugcucggaaaaaaaauauauacuccugucaaaagacuacuacugaucacugaugacacaccuggucacccaagagcucugauggagaugcacaaggaggugaauacuguuuccaugccugguaacacaacagccauucugcagcccauggaucaagcaguaauuucaaccuuuaagucuuguuuaagaaauacauuuuguggccaggcacaguggcucacgccuguaaucucagcacuuugggaggccgaggcagguagaucacgagaucaggagaucgagaccauccugcccaacauggugaaaccccgucucuacuaaaaauacaaaaauuaguugggcgugguggugugugccugcaaucccagcuacucaggaggcugaggcgggagaauuccuugaaccugggaugcagagguugcagugagccgagaucgugccacugcacuccagccuggugacauagcgagacucugucucaaaaaaaaaaagaaagauguuuuguaaaacuauaacugccauagauagugacuccucuuauagaucugggcaaagucaagugaaauccuucuggaaagaauucacccuuacaguugccauuaagaacauucgugauucacagaaaagaucaaaauaucaacacuaaccagagcguggaagaagcugauuccaaccuucauggaugacuuugagggguucaagacuagaguggagaaggaacugcaguugugguggaaacaccaagagaacuagaaguggagacgacagaugugacugaauugcugcaaacucaugauagaaccuggaaaaagacauggaagagcaaagaaagugguuuccugagauggaaucuauuccuagggaacaugcugugagcaugucaaaauuacaacaaaggauucagaauaaacuuaauugacaaagacguggcaggguuugagggaacugacuccuauucugaaagaaguccuacugugggcaaaaugcuaaacagcaacgcaugcuacaaagaaaucuuuugugaaaggaagaguccaucaauguggcaaauuucauuguugucuucuuuuaagaaacugucgcagccaccaccucaaccuucaaccaccaccaccgucaucagucagcagccaucaacaucugggcaaaaagacuaugacucgacuugcuaaaaacucagaugauccuuagcauuuuucaguaauaaaauauuuuaaaauuaagauccguacauuguuuaggcauaaggcuacugcccuauucacagacggcaauacaguguaaacauaacuuuguaugcacuaggaaaccaaaaacugugugugacuugcuuuacugccguauuugcuuuaugugauggccugaaaucaaacccacaauuuucucagacgugugucuguacauuuguccaaacccauagaauguacaaaagcaagagugaacccuccuguaaucccagcacucugggaggccgaggcagguggaucacaaggucaggaguucaagaccggcauggccaagauaguaaaacccugucucuacuaaaaauacaaaaauuagcugggugugguggcaggagcuuguaaucccaccuacuuaggaggcugaggcaggagaaucgcuugaacccggguggcagagguugcaaugagccgagaucaugccacugcacuccagccugggugacagagugagacuccaucuuaaaaaaaaaaaaaaaaagagugaacccuaauguaagcuguggacuugggagacuuaaggaugugucaguguagguuuguggacuauaacucuugcgaagggaaacuaauaggggaagcuggauguugggguagcagguauacaggcacucucuguaccuucugcucaauuuugcugugaacccaaaacugcucuaaaaaauaaagccuauugaaaacagauuugcacguucuacaugguacauaaccauccaucuuuacugccauuaaugccacaccacguauuuagcaccaagauccaagagcucaauucagcguucuggaccagacuaaaaggugagcugagugcguuuacugggucagcugcaucauuuccagcccgcaggccaguucgccggguggcauccaggacuuacgaggucaagggaaugucuaccugcuccaccgccaacgcuguuuccccuguucaugucccagcagugccggguucagcccaagccccuccucucgcugagaaucccuccuaccucacuacaacuuagaaauaucuuuccaacauacagacguaaucgugugggaaacgucugcccauuuacaaaccucaagugccucacugaauuucgccagugaaauucccaagugacaaaggaugagauuuguucucuucuuccagggcucagucuucaccagggaaaauugacuuaggaagauuccuucacaaggaauggccggaagcuacugggggacagcagagaaaggaacgacuaaaccucccccuagaaugaggcgcggaaacaccaggaagacgaacugaaaaccugacccugaauguggccagaggaaucacuguggcccguuuccaagaaucucagauuaccagagacacagcuaagugggcagaaacccccuguccuaacagaagccagcuccgaacugaaaggaaacacacgucaaaaacggcuuuccuuaaaaugagacucugacagccaaggcugggaacgcaaggguuuucauucuaucacgucaagcacuucacggagaugaaguccuucauucacugccucaccccgugagucagaugcucagcacaugcugacguuauucugaaaaaaaaaacaaaaaacaaauccaaugacuugcccugagccacagccauugagucacaggcagaacugggaagaggccucgcuucccacauuuggcaaggccagugaccccuuccccgaaaagaccuucacagagaucaugaccucuuuuaucugaucaggugcaaacaagcugccaacacucccugggcuucugaaggcaaggagaagagcaucugaaaucccgcacgcugucugugcuggggaaagucccaacaggcaacaucagccccaagauacucugagcuccucaagagccacucagcagcgauccaucccguccacuucuugagcacuuugcaugggacacuggguuccacugucauugcucagccguugucccacauggcuguuuagcugugcuaugcaggcuucuugccccagcagguggggucaggucuucuucuuauccaccucuaccacagcuguuccucaauaacagcucccagcugacagcagcuccgcccugcagcuccagguauaaacuggaguuugcccgccauguaagugcugcgcaaacuggauuccugagucaaggagagaagaacagagaaagaaacugguacaaggaagacugagcccuggaagaagagaacaaaacucacccuuuuucagcagcuccucacucuccaagccugaccuucacagcaccacacagagcaagucaggcagcucuggcaucaacagagcuguucagagcacagauccgaugugcccagcgcuggggcucuaucccucccuccagaugcugugcagccacacaaauaacauggggguaagacacuuccucaggccagaaacaccugaagaaagccccaagcaugcuggcaaacacacaugcaagagggcacacagaaggugcugagaccuucaccucugccacaguuacgaggucacugguccacgcucaacaggcagcagagcccagaacaaaauccaggacagaaugaggcugucccaggcaguuccuaagggcauggagacacucuauuuuacuggaaaagaugcuugcuugguauaagauuuuguccuggcucacagcccaagaguggaccagcggagccaggccuggucccccccaccccccugccacacacacugugccaccuacccccugggccaauccacagcagacaagcugcagagcaggaaucuccgcagcacaacugcgcuuccuccacucagccacccucucccuccuccucccuucgccauccucauccccacaaacaagagaaaaggccucuguuuaagucacuuggaaaagaacgaaucacagcucagcaagggaagaguggcuugaaguggcccucacagcagacugccuguguggccagaucccuccuccacugcccucaccccaauccugcccauucagaccagcugugugcaucucugucagaaacaggcauaaaugcuuucugaucucugcgacuccaugaaaacaggaacaagcuacaugcuccacgcacacacucuaaaugcaggcccccccccucccccggcgccucuggaggcaggcucccuuuaagaacuacccaccccaugugcaggcugcacucccucucagggugcgccuggagugaacacucagacuaagcuaagcuaaucuguuuucucaaggaggugcaggcucagccuaugcuaggagauuagacccacagguagacacaugaguccugggcagagaaaaucccacugcagagagaggagaaagcagccaccuggccuggaggagcagagcugagauccagcuguggccaccauggacugggcuggacccaggucccaguucucaugccuucugaggccagccagccuucuuccucucaguaaugagacaccuccccaccauguccccacaauaaauucccuuuucugcuuaagccagccugcacaguaggcugcuuuugcuugcaaucaagaggaucuuuaacaaggggauauguuuaaaaaaaaaaaaaagaauaacaaaaagaggcuacugguaugugaauccugggggccacuucuuagguaagacaggaaaaaaccaucuugcagccagauuucagguccaaagcucuagauuuuguauucuggcuaucucucccuuucaucagugacacagucuuccauuuuugaucuugcaaaaauuucccgagugaaccaguguucauuuuaagaagcuuugguuucaggcaaucugacaauuaauuuaacgcaacaagcuaaucaaagugagagguguaacagcaaacuuacuucuguucaaguaucggcucugggauuuaaaagagugaaaaucagaaguuaaaacuuggaaacaaucccugaugauuucagccagcaagagaaagacuacuuggguacaugcccugaaggagggaugcuuucucagaccaugcuuuugaacacuuucagagucucauugagcagagccuucuggggaggguucaccuugaaauguagguaaauacacauguguguuuguacauguaugcaaacacacuuguguuguacugcauauguuccaugcacacauguguaugcaaaugugcaugggcagugugugaacauguaugugccugcaaacacauaucguaggcuugcauguaaguacacauugcagugugcacgugugcacaaauuaguaugcacacguguagguacaugcaugcaugguacgcacauguacaugcaggcauacuaugcacugcaugugugcaugugugcuguguacaugugugcaugcacagauacgcaugugccauaugcccaugccacaugcccauauguacauaaaugcagacacaugcaguguguacauauguauguacacacacacaaauaugcaugcacaguauauauacguacacacgcaugcagacacacgcacacacauuccugcaagucagguaugaacaacaauucuaauuacuuuaucagcuucugccuggcaaugguggcuuguacuuaaagagaagagcauacauuuuccccagaacucccauggucugucaguaacccacccagaggaaacuauauacuccacgccuccccaguuuuccacggucaggcugauguccaaacuccucucaacucaugcucaauguauuugcauucccagucucuuuuuaccagaaaagacccuagaaaaaucuauugaagacaaaaaaaaaaaaaacagaaaagcacagcugagagagacccucaaggcuuaggcauagaaaaagucugaggaccuaauaaagaauauaacagcgcacuccagcagcagugaguaguucugcauuaucacuguaugcagcacaccauucuaaguguucugguuacauuaacucacuuaauccccacacaaagcuuugauuauccccauuuaguguaaguggggaaacuuagugcaaaggucagacaccuccaacaugacagcacuaggacccaaccccaagcggccaugcuugagccaccccacgcccuguccucaugugacaguaguggggcucccaggccgucagagcucacaacagcuccagugacucaaauaagaacagcccugaacauucucuauucaaccucagagcaagcacagagcagagacagagauccuuuuggucccccuaaaaugucccugacacacaggaaaaacacaggugaggaggggagggaaugagucacaaaaauuaaaaaccaccauaguauauuuaaaugagcuauuagccauacugagagaaugagcaggagcacuaaguuuaaggaaggacacuuucaccccacagcugcuccuaggauggcucagccucugcacagagaacggcugcaucagccugugggaggcacaccugcucugccaggacgccguggcucccagugcuaccccagacggguguacaccaggucuguuucacaucucugaucugcgugacaggaaacagaaacagaacuugagagaccuacgcgucccagaagaggucaaauguuagcaaaugcauaaaaugagcuuguuugucuuucugacuugaggcucacugacugccucccuaacaguguuccuucuuuuuuuuuuuuuuggagacgaaguuucgcucuuguugcccaggcuggagggcaauggcgugaucucucaacucacugcgaccuccgccucccagguucaagugauucuucugccucagccuccagaguagcugggauuacaggcaccugccaccacgcccagcuaauuuuuguauauuuaguagagaugggguuucaccauguugaccaggcuguucuugaacuucugaccucaggugauccaccugccucggccucccgaagugcugggauuacaugcgugagccacugcgcccagccaacaguguuccuucuuaagucuacuccuacccugcagccauacaucuggugguggacaauggugccucuccagucuuuccaggucauuagccagucccagacagaccucugucccccaagaaccuguucgugugacagggcugccuuuguggcacuaguccugacgucccacaugaguggccuacuccuguuaaccaccacaccaugucccugcuacaccccgagggagccugcagggcccccaaccaccacugcugcagccgccaccccaccccgcaccucccugcacccgcucaccugcaaaggcaaggaccacacugggcagcugcaucccaucuacggggguccgcagccgcagcucccagggagacccccaucagagggcagagccuuccaacgcccaggggaggcuacugguggagcgggaauucaacucagugaguugcugccagcaaaguguuuaaugagauagagaagaguaggauaguccaucuagaaaacguuugcacuguucgcgaaacuuuguuucuaacauauauauccugcucuacaucucauccuguuauucagauggucuccaacuuaccauggcucgacuuaacaauucugacuucacgauggugcgaaagcaauaugccuucaguagaaacuguacuucaaaucuggaauucugcucuuauccugggcuagcgauaugcggucggauagucucugacaaugccgggcaaugucagugauucacagcucucagucagccacacggucacgaaguuaaacaacugauacccuacagugugcggugcugucagcauuguuuggauaugacuugcccaauugcaggcuaacguuuaagugcucugagcacaaugaaggcaggugaggcuaagcuaugaugcuugauagcuuagguauaucaaaugcauuuucgacuucagauguuuccaacuuacagugucuuuacugggacaugaucccaucauaagcugaggaacaucugugcauaaaucucauccuuauauaucccaucagggauggaugcuccucgacuuacaaugcgccacaucuugguaaagccacuguaaguugaaaauaccauuauaucagaagugcauuauggacuuaggauauuuucaacuuaugauggguuuaucgggacauagcuucauuguuaauugaggaacguacugaacguguaucacuuucacaccaucguaaaguugaaaaaguguaagcgaaaccauccccagucagggacuaaguguaucaucuucaaaacaugaggaaaacuuccuaggagaacuuuauuaugagcuugcuuguaugcccaauuagaagugcucuuucaggacugugcucuuucaggacugugccuauugcuucacaggcaaaccaguuccacguggcucagggugcaagcuccuggcagcagagccugccuucuccuucuguguuuaccgugcccagcaucccuucucaugcaagccagugagcccuaugaaugagucugcccaagccugggcaauaccugugaccccuuucacagcauuuuaugaugcacgcagguaacauucaccugucugcacccgcacagaaauggggauccagaugugcccacagcugcaaagcuggcagugcaggcaagguggccuaggauucucaacucacagcauggccucccugaaaggcagccucacccaccagcaccccaagucuuagcagucccuugacucuaauuuuuaaugucuugagugugauaaacaucgucuaggaagauuucuguuuuaauuauucacuuaagccacccuccaaaauuccugcuaaagcaccaauauguaaaccacuuuuagucacaggaaauaguucuccuuucuuuaauccauggcuuaaaccaaccaaccaaccacacacacacacacacacacacacacacacacaaaguccaugagaagaaaugagaauuuuuuuuuuuuaacauucuugcucugucacccagguuggaguacaguggcacaaucauagcucacugcagccucaaacuccuaggcuuaagcaaugcucccgucucagccucccgaguaggugggacuacaggugugugccaccacacuuggcuaauuguugguuuguucuguuuuuguagagacaggaucuugcucuguugcccaggcuggucucgaacuccugggcucaagugauccuccugccuccucagccuccuaaagugcuggaauuacaggcaugagccacugucccuggcugcgaauucauuuuuucccucaguagaaucccucccagucuguguaaguggcugauucuccugcaaggaggaagucaccaucuggauucaucagucagugccugaggcuggcguccuuccuuaucucugcaagucaccucacuaugacauuuaagauugucuauuccaaaagcacucauccugcugacgagaugcaacuucugaagacagcaccugcggagcguggaauuccucugcacugcagucuagcucucggagccagcuuccuucuguccagccccgggacucgggagucagauugccuggauccucaaggaaugccuccauugcuacaaggagcccaugggccucugccuuaucacugaaaauaugggggaaauaauagugcccuuuucacagcauuguuuaaugacacggugcauauaaacagaaugaacuuaaacauuaucauccaggcuaaggcaccugugagcaugaaaggguguauguucauccccacacugggcaagacacacuccagcacugcccaagcucaccagcacgcacugccugccugcuuacugcagccuuagcacagagcuuagcaaguguagcugcuuagggcuaaugacaggagaggccaaacaauaauaucaacaaaugcacucuuacgaaugccugccauacagcaaaugcuccauaauuaugcauuacuguucuaucauccuguucccaucucaaccuccaaaagccuuugauguaaaauaaaaugaacagucuccacugccucacagauggaauuaaagcuaaauacaaaacuagaagcccuaaagucacaaccucagguggcuggguuuccgggucagugggccagaccaacagcaguuucagcacacugccggaacucagagccucagguguuuagguauucauuccaggccaggaggaggcauggcuccuggaagcaggcacuaagccugucaucuccauucaguaucguuucucagauucucagacugaaaucuuuaggcaauugcaugccauccuccaugggcacagucacccuuauacagagagaucaacuugcugcucagagauacacagcugaucagggaauacaaaacuuugcuaucacuccgaaguccaggaaacagagcggacaaugccuggaaauucugcacugcacggccaugagcaaaaagaguuggcauacccucaugcacugugucaccaagugguuaauaugcaacuauugcacaagaccugcuucuaagaagucaaguccgaagaccggacuaaagaaaugaaucaucuuuaccgaauuacuacaaucacuauggaggcccagaaauguugaguaaaggugagugggaagaggcuggagagaugaaagugugcaugcugacuggcagauacagcgcuggaucuggcaucagacaggacuggucuguccccaccacuuccuaguuguccaucuugaacaagucuuuugacuucucucugggugccugugccccaguuuguauaauggauauaaucaugcuuaugagccaacaggacaugaaccuugauggagaaugcaaacacaggugcucacguucucugaagccccacagugagacagcaccgacagacgcccucacuuucgaaugcugacauuuaugcaacucccaccucauccgugcugaccacugcgaggaagaaggugggacacagagacucuauguucccacaggagcuuacacaagagcaacacgguucacugaaccgcagggaccaucaacucuagggagcaccauuaauuuugugugccacucaggaagaaaaacacgaucaaugaaacccugaaacaccauccauggaagaugcauccugauuucagacauguuaaaacaugagaggcgggggaaaugugcauuguagaaucaaugauauggugcgacaagagcccccagugggccccagagcucggcucugguccugaccaaacaaugucuaaaaccagcuugaguccacagagcaguggguguucaguuuggcugcucuucaauaacccugggaaccuguuugcauuucagacucccugucccuccuggagaaugauucaguugcucugaaaggaggucugagcaccucucuaacacauccugucugugccagcugggaaaaggaaggcuggcuaaauagcagaauggaucuaacagcacagcagcuucccuuccacacccccagccucuggcaucaguacgcuccuuacaggaagggccccaaacagagccgaagguguggucugaauccacagcgccacuguggcccuccugccuacauuccauuucugcuguuucucugacacuuucccccacucugauucauuuuccgaguaugcaguugcaaaaccuacgcuuagaacggggggacugcaagcguccuguguggcauuucccuaagucagcugugacucagccuggcaagggcccaggugccuucagaguggcuuccugcaaagaccaguaaugacgggccagccgcugcacucaggcacaugagccagcaccucugcgacugagauccagggaaggaacgggaucgcccuccuaccucccagcacugcaaaugucauuuacauuuugaagccacuggggacauggguggaacucugugagcuggugaauuacgcauuccaggauuucugaagccuauuaagaaaggagagccagggugggcggccaucacgaagcagcuccaaccaccuguuucccuccucccgcauuucccccacccagcacaucacauuuauuuuaugacucggugcauccaacaaggcacggcuuuuaaagcuucccauuucugaugcuacagagccaggaaaccaggaaucaagauuaucaggcuaaaauacagccgccucucuuugaggcccaccagcugguucugagaaccuacugcaccaccauggaaaagggauucccuagccuucucuacccaaauaccccagaagauaagauuucagcuuuuuaagauagugguuccauuaaccuuuggagaaaggaggagagacccuguucggggagcucuaugccaaauaaagacagagccaaccucccugccucccucggccccccaccaccccagaaccuacugacccuugcagagccagccugcugacuccuuuggagagaaccauaagagaagcuucaggacgcucaggaguuagagggaaaaugaagccauuuaccaaacagaagcacaugacugccucgcacucaguaagcacaagcugaaucaauuaguuaauuaaaccugauacggggcucugugggguuaagaucuuacacccugaguaaggaacacugcugaagaaggaaacagucgcucugggagaugcugcuaccaaaaucaguggaaggucagguaggagcagcucucacggaguaaaugacuaggagaaggggaggaaugaauaacaauccauuaccuaauaagggguuugucuaaaccagcuaacuuguuucagaauugaggccaaaaucaggguuagcugcaacagugccuacaugauaauuaugugcuuuuuuuuuuuccuuuuggcuuugugugugugguuuuggagggauggguucuuucauuuucuguuuuugugugccaccuacuugucuccuuagaaccacagacaaaauccugcaagaaucucuuuccugggagcagaacucaugcccuggugagccccacagacacagacugccucugcagccugguggcaucugccccagaaccaaccagaaaaaaaggugacuuacauuucuuuccaaccaccaaggcugaagauggaaaucuguucacaguugcagauguuggcuggggagaaaaggggggcugcugcaggaaggcaucugggugcucaacacuguggcuaauuauugcugaauaaaaaauaaucaucuuugcaugacuguagcaagguugcucauggauacaaaguauauuaaggugaagacaguaaacaccacacuaaaggucucaugaugugcaaacugagauuccaugaacguuacuaaaaucuauuacggggauuuuggacugacuccuugaaauccagggaacaauuauuaaaacaugaaaggaccacaacugucuauuucugcagauagcuccuucuagcaacuguuuuccuggacugccucaccuaggagguaacagaggcucuuuacaauuccuccaaaugcaaauuugauagaguuauaggagucucuuacugcacagugcuguguucuaaacacgaucucagcaaggccaauggaccucgggcuuaaccucaauaugagccucagugaguaaaaugucacuacuggucacaugcagagucaucaaacaacacucucguccaugcuaccuucugaguauucuccagucuucacccauggccccgccucuccacugccccugcaaagaaaaaguccuccauccuugcccugccacaacuacuggacaucuucaaccuuuccaccacccaagacucuguuauuuaccccacagaaucuguuuccaucaauggcuaugaaaaaacagagagugauuuaaucuguucgcuuuuuuuuuaaggccaucaacuguccugagucaucacacuaagugucugucauucuaauuggaugcagagguguuuuuacaauaagccugggcagcuuuaugucaaaucaaugaacaauuuccaaccaccauuuguaaacaauaauaaaucaaggacucucgaaacggaacccccaagguauaaacguuccccuacagaagcccaucugcugcaagcucuuccagaaaauaaaccuggaauucuaaaaccuaaaaaaggaaaugauccauuugggcuuacaauuucagagacacaacuucacucuugaagaccaaaauugccacguuuauuuugaugcugccauugcugucucaagcagaagcuccccuuauguugcucuauuccugauucacagaaugaaaaacuguacauuaggccaaggguuacugagcgcucagcaugccgggcccucgcaaggcacuggagacugcagugaacaagacauaccugcccuccuggggcuucgucuaagcuccccuuuucugacuuugaaaggaagcuuguuuuucaggagggaaaaaucuucuuccaagagaacaggcaaaguuuugagcuuugcaugcccuuaaaacuuacuagcaccuaaaauuagcuucucugauagaugugucuuugcacuuuacacaaugcagaaggcuccccaagaagggcaaauugugcccgcaucaaccaguaaaaccauucggaaaacaaagaggagagcuaauuuuaggaagcagcauuuucaguccaacuacuuuuugugcuucugucuggcaaagggacagaauagaagauaaggaaacugcccccacuaaaucucuccuacggacuguccuuacuacacaucaauccucucccaggccaauugcuccaaauuaccagaggaggaggccaucuuauacguuucaugaugaaagagagggcaauucucaggaggaacaagaauaauuauacacaacaaaagcaggaacaguaaucugucauagauuuacagaacacacaguuccacuuaagauacauuuuuccuccaucacucuuauguuguuuauuaaacauuuacuuuuggcccagaguuuggcugaucaggaccugaaaaguuguuaaaacaccacugggacugugucaagaaucuuuuaaaucaucuaaaaaagguauuuguuuaucugucuugacaaacugagaauguacucagcaggcuuaagaauuucaguucaacaaacacaccuuggcaccugaggugcucaggggugggaaaacugagugugaagagacgggcacacgagugaccagaacacgggggcauccgacaggagcugggcauaagcuccagaggcccuguccccuugaaggaagaaaaggacuggcggugggagaagaugcuuguuuaacauuuauggaaaaagccagaauuacaaugaggcacccuugccauaugacacauuuaggaguauguagaauacacgcaucuauacaggcauacacauauguguauguguauauccagucaugcaucacuuaacaauggagaucuggucuaagaaaugcaucauuaugcuauuucuugcucgugugaucagaguguacuuacacaaaacuaaaugguacagccuucuccacaccuaggcuagaugguacagccuacugcuucuaggcuacaaaccuguauagcaugugacuguccugaauacuguagguaacacaaugguauuuguuaucuaaaauagaaaagauacaguaaaaauacaagauuauaaucuuacgggaccacugugauauaugcagucuacuguuaacugaaacguccuuaugacuguauacgcauguguacauguauauuucccauacacuuccuaaauguguacuuuuguuuauauguacauguacacaugcauauacacuuauauguacauauacacacaucgacuuuggagugaagcagccccgcauuuucacugcacuucucaaacuuaaagccuuugugaucuugagcaaguuauucgguucccugugccuacacauuuacaaaaucaggugaacacuacauacgccucacaggauuauuuuaagaauaaaaacgccgggugcuguggcucacgccuguaaucccagcacuuugggaggccgaggcgggcagaucgccugagguggcgaguucgagaccagccugacuagcauggugaaacccugucucuacuaaaaauacaaaaauuagccgggugugguggcaggugccuguaaucccagcuacucgggaagcugaggcaggagaaucacuugaacccggaggcggaguuugcagugagccgaggucgcgccauugcacuccagccugggagccugggcaacagagcgagacuccaucucaaaaaaaaaaaaaaaaaaaaaaaaaaggaauaaaaagauacccugggcaucccccauccugcacauuaccaggcaaagagcuggugcagaacugagugucaccaauguccuauggagccauuugagaaauauuagcucuauuuuaaaauuuagaaaacauagaguguuuaagcaagcuaccuggagucacagcaaauuaaaaccacuuccaggacuugaucccuucauuuuuuaaaccauucauucaacgaucuauggaacuccuagucugcaccacagacugugugagaagcugggaauauauccucagaucaacacuggcccuugcccuaaaggagccuaggucuugguugggaauaaaaaaugucauuaacuauucacaggugcugugcccgcaacaccaagccccagauaaaacaguuccuuagagucaggaggucucauaauccuauaauggaaacaaauuggaaaggaggcuguggcacacugcagacauggggacaagacuggcccuuccuacaggcaucaagcccacaggaaggacugagcccuuuuggguucagccaagcuaucugcagagacagaugagccacugggcaugccuggugggcagcacaccacuaggaagaaggcagacaccucccuuccaggaaccaaagccaaaauauggcuaaaugggccacagcaaaccuucugagggaacgcaccauugcuaaaaggcuuguacugacuuggccauggcaauggagcauaugcuacccucaaaccaggcuucccagcuggcauuucuugggaaucacagcuugggacagguggagagcuuugcugaggagagaaaacucuccaggcaaagcuauagugcuguauggucuugguggauucaugaaacaccauugguguauucacauuuuugagaaacuugcagcagagaguguauucaacuaugcuuacccccagauuccccaagacaucugaccauggcaugcuacuaacaucagacacccccaucccgggacucggaaacucuggaauugcaaucauagaaauagugcagcagccuguguaagcaaauggguuugacaaaagggaccaaauggugcccuuaaggaaagcaaaccugggcaaggccaugacaaugcuucaggccaacagcaggcacagagcacauggagcgugauaccuacuuugcaaagcugcuaacguagcaaugacugguguaacagaggagacuagggagggccaacuccucaaggaagaacuugaaaguccuuggcuacaugaagcugacagaacucugaucucauccucucaugucgugauuccgcgcgaucgggaacaucuaaaggggggcacgugaccagcccgcucaaugcacagcucaaccuacaugucacuuccacuagaauuucuugucaaucacccagauucauauaggaaugaauuccccagugccucauaacacaucauggucaacuccuggcauacagucagugcuuguggaggcuaaagcaacuccaucuuggaugcuaaucugccacguuggcuucugauuaacccccuauccaagaaggccucuaagacuucccauuuaucuacuauuccuguguaagagcaggugcuuacaguaaauccugcccucagaucaaacaaccuugauguuaucuuacuucaauuguccuacguaucccuuuggaaccacuccucccuccccgcuauggcauagaagcccugggucugggggguaauggcguggggcucccccaucucgucuuaccgcugcccuagacacagaugcggcuucugcuuguaggucucuauuaaauguuucuuucuaagaaacgggauuugucaggcucuuccuucagccucucagcuuccucggacuuugggguaguuugcauagaccugccuuucgcaaaacaguguucaauauguacauucuggaaauggauauagcaaaucucugcacuacacaauucacaugcaugcauucuaaaaagaaugcuaucccacaguauagagcucacacuacauacaaacagaguugaccaaaaggagaaaagagagagaaaagagaaagucacuccuguuagggugccagcauuccacaggaguacaauguuuccuuccacauucauucuagagaacccacauguuauuuaaguaugucuucaaaccucauaaaccccaugaaugaccccacauaauucaaaccugggcuaaaaagagugaguguaaagugcuugaaguuucuggaagaacuaaguuaugccaaaucucuacuuuaaaugucuaccuacccagaauacaagcaagaaaguucagaauguauucugguucuaucgacaaacauuuacauucucucuuuacaaaggacauucauacguauuaacucauuuugaucccugaaacuaaagcagaaauagcagcauuaucuguuguauagcgaccaaaccuaaagacagaauuuguaaguugucccaaauugccaagcaauuaaaaauauaauguacauuuggugcguguuaccauaauucuccacuauuaaacgguauuuaaaauuuuccugagauaucaagaauaaaugaaauuaugaugugucauuugaauguuaaaaugugaggaacagcauuacuagucaugauauccagaaagcggaaacaacccaaaagucagcugacagauaaauggauauacaaaaugugcacauguacauauuacucagccuccaaaauggaauauuacucagccuucaaaaggcaauuccgacacacgcucuaacagggaugaaucuugaggacauuauguuaagugaaaugagccagucacaaaaggacaaauacuguaugauuccacuaauagaaguaucuagaguagucagauucggagacagaaaguagaauggugguugccaggagcugggagaguggggagugggaguuguguuuaaugggcacagagucucaguucugcaaguugaaagagcuccguggauguacgguggacauggcugcacaauaauaugaauguacuuaauaccacuuaccuguacacuuaaaaaugguuaaguugauaaauuaaagaucaugaaaaaaauaaggaaauauauuuggcucauuaaaaacugggaaccucaguaugauaaauauucuaucuccugagcaaaccgcucaguguuuuaacaaucuggauugacaguuuuauuaaaggguuuggcguguaauguuaugagggcaccgaugauacugggccugaauucugaaaugucaagcgacauuucucuuuuuugucaccgugcacccccucuucacaguuguagcuuuggacaguaacuuaguaugauccugauguucucccaacaaauuuaauaaggagagggaaucauuguguuugcuucuaaacaaaccauucagacagaaaugaaggaauuacucauucugcagaaucuauuuaccaucuguugcugaagggaagucuuuacugaaugagaggcuggguuggaggaccucugagugaauuaaacccuaaaagaaaaugcaccuucuaaguuucaagucacuuugauucuaugauuguauguauaauucagaccaaacuaauucuaucuuugagaagagauacauaaaagaauauuaagaaggugcaacauuggugguaguucccaaccugcugcccccaggcugccaaggaugggagcagggagggagguuggaagaaauuaauuaugaauugagaaagacugauggauuaacaacaaaaaaaaacuuucaaacaggaugauggugaugaaacacaaaccuuaaagaaauccuggugggacagaaagaagggagagaggggaaaggggaaggaaggcgggaggggagaacgagauggacgagggagacgcagacaccucuggccuccugcccucagccagcaugcucuaaccaugccacccccaugacucccuuugacgagauaugcauauuaacauauaucacauuuaaaucacguaagcaaaugacuaagcugcagugauaaagaaugcuuuaguuguaauuaccacagauaagcacauaauuaauaucuuugguucaguaacuagaaucgucuuaaaaggaaaaauuguccaccauggcucaaccucagcuggcaggugcuagcaagaggacaccaaaaugcaggcugagguaugcguccucucaaaaucaaaagggcccccaggugagccuggcccggcuggguuagaaaagucccugcagcagggcaaaucccuggcccagcaaauggcucacucccagcagccaggcccacagcccuggguucaugggaagcaggaguuccgggugccauuccugcacaaaagcccucccaaaacgucauggcuuaaacaaguucuuaugucccauggugagaccacaggugccucgcggcuggggcucucucaccugucugaggccuuggccucucccucccuccccuccaacaugucucacccuccaggcaaccccacacgguuucuuucuccagcagagcagccuggacgucuucuagcauggcaguugggccccaggggacccagguggggcuaccaggccccucaaggacagagccugcaccacgcccagugucacauccacagcagucuacugguucaaguuugacaccagacugaccagauucacgaggcagggaggugagaaguacaugcccuuggcuggagacugucuaccaccacaggacacuggagucaccaaccccucuacagccagccaacccagaaagacguuccacuucggaacucuucaaaccucaucuggagaguggaucccaauacuggggcucgucacagagcagcacacugggaugcuaagagcaggccuggcugaggagcccgcaggggugggucugaauucccacuucaccacuucuacaugugagacugccggcaacucaaccucucucccugacagcuucaucuguaaaauggggauaauaaaaacgccucauggaguuucuauaacggauaggugaauucacccauaaaagugcgugaaagcaggggguacauggucagcaugugggguuacuauuuuuacucugcuagaugggucacccugaaguccacccaagccacagaaaggacagugucacagccccgcgggucugcugccacugcccacauucugcacuagcucucccugcuuguuggggucagggucgacacucucccugauugcagcuacucugucuuaaccaacacaaccagagacagaaaggaaccguaugaggaccagcagacucggagcagaagggccaguuuguaacagcagugacaguccugugaccgugaacuacgacaucaucgcggcccgugcuuagagguccacuugcaucaucuccaauuaauccucacccucaguaggagcuacggcacaucuaacacagggaaggcgagguaucggaauccgcuuccugucucuacguggggagaucauccucuuugcagacgugugggaaggauuaggcaaaacaacacacaagggaccuaagaagauucaagguaagugcccccacaaccucucuguuuucucccuuccccaaacugucuggcucuguuucucuuguaauaguuuuaauucuacuacauacacccuuuuuuaauaucagcuguccagauguguugggaaagcauaugguguuuuuguuuuuguuugagacggaguuucauucuuguugcccaggcuggagugcagugaugcagucucagcucacugcaaccuccgccucccggguucaagugauucuccugccucagccucccaaguagcugggauuacaggugccugcuaccacgccuggcuaauuuuuuuguauuuuuaguagagagggggguuucacuauguuggccaggcuggucucaaacuccugagcucagguaauccacccgccucccacccgccucgaccucccaaagugcugggauuacaggcaugagcugccaccccggccgaaagcauauguucuuaaauauauaaaaauaaggccaggcaugguggcucaugccuguaaucccagcauuuuaagaggccaaggugggaggaucacuugaagccaggaguuugacaccacccugagcaacauagcaaaacccaaucucuaccaaaaaaaaaaaaaaaaaaaaaaaaaaauuagccagcaugguggcacacaccuguauucuuagcuacucaggaugcugaggcaggaggauugcuugagcccaggagaucgagguugcagugauguuugugccacugcauuccagccugggcaacagagcgagacccuaucucaaacacacacacacagguggacgaaacaguauuauuacccucauuuaagaagggaugaagcuaaggcuuagagagauuaaguacugucauguguugcuuaaugacagggauaccuucugagaaaugugcccuuaggugauuucauuauuguggcaacaugauagcaugcacuuacacaaaacgaggugguauagccuacuacacaccuaggcugcaaaccuggacugcuuguuacuguacugaauacuguaugcaacuauaacauaauaguauuuguguaucuaaacacagagguacaguaaaaauacaguauauaaucuuaugagaccaccauuggguauucgaucugucauuggcuaaaaugucaucaugcugagcuugaccguaccuugcccacaugugcaaggccaguaaacggcccaggguggauucacagcacuuaugaaaaccuuccccguaacaaccacucugugcugccucccaggagugaagcagcaggaagcccagggaacacagcccgcagccgaucuaguuuuacccuuggccaggucaggacugcagaaagcuagcuacaguccaucguuuucuccuagaauugccuuuacacaacugugaucuaaugcuccuccuucugcuucagguuugauuuaaauaaacggccacgugugcaucucugcuuuugguuucuguuauuucucccccugacggacacuauuaucauguucagugcccuuuaaguuaauauccacuagauucuuaucaagcuugaaggcuaagaaaauguuucucucucucaagaaaauguuucauuguauuaucaaaugagaacuaugcaacccaacaugcuuccuuucuugcuuuggcuaccaagauacaauugcacguucaacugaaggagcuccccuuggcuuagugucaguagacguaagcugaaauguauagggggacuagagcacaaucggccagcacuuuggguuucagguucuugaccuauagauggggguaacauaccugccacgcaggauuaugcugagcauuaaacuaaacacagauggcaaacaccuagccaggauccggcuccauggggguggguguucaguguuaauucuccuucauucuuuaauucuccauccacuucuuuuuuccuucaccuuuuuaucccucauccccucuacccccuaaauuugaccccagauuuuuaaacucuuauuuuaaugaaucugugcuuacacauaauauacuuucucuuauaagcggccucgaaucuuuuuagagauauauguugcuuaaacacguaauagccaugcucuacaaguuaaaggaauacugaauaauggacacagaauuuagagauaagguuuagaaaugucacccuuggccaggugcgguggcucacaccuguaaucccagcacuuugggaggccgaggcaggcagaucaccugaggucaggaguucgagaucagccuggccaacauggugaaaccccaucucuacuaaaaauacaaaaacuagccaggcuugguggcgcgugccuguaaucccagcuacuuaggaggcugaggcagaagaaucauuugaacccgggaggcagagguugcagugaggucaugcaagaccccagcucaaaaaaaaaaaccaaaaacaaaagaauugucacccucuacuauaaagccaaaagagccaacaaaaugaaugacauuagccaucuguggugaucuuuccaggaaagaacucaagucugaugauuuagaaaguagcuaaugagaggaguuaugucucaaauuacauagacgagccuaacgaaaaucagaaagaucagugcaaaaaaaaaaaaaaaaaaaacuaaaggaauauaaggugaacuguaauccaauuaaauauaauacgucuaucucaugaaaucauuuugcugacugauuacuaaagaauguugaaagucagauguauuagucaggauccaauuagaacgcagaaacuacauaagcuuuuugaacagaagggcuuuaauauaaauuguuaacuggguagaaagucaguaaccagguaacuggguagaaaaaggaaaauucuagauaucagggaaguagcaacgacaggaagcagccaccaccccuaggccugagggaaccgguuagacuuaaccuuagaagcguagccaaagggcccugagguagagacuuccuuggaggaguggugggaucugcagggaguguggacgaugaggcuggcuggccagugcugggauaacugaagacugaauucaacagcuacagcuggggcaacaggaagccaacaggaaggaccaaagccccaucuugcuggugcuucuaccgccuccugcugauggagguggcccggaagccacuggcaaagcagcugggaugugcgguccuagcuccaacacugcagaacagagcacagagucuggagcugaaacaauaauuucauaaauuacauguugggauuuuugaaaaaucaaucuccaucacuacccuaaggagaggguauugauucuauacacagaaagauccccagaacgagaaggccgaugcaucaagauuccucagacagauggaaauaggccaauagaaaagguggccgauagaaaauagauagaaauaggccgauagaaaagguuugcugaggaccgggcacaauggcucacaccuguaaucccagcacuuugggaggccaagguggccguaucacaaggucaggagaucaagaccauccuggccaacacggugaaacccugucucuacuaaaaaaaaaaaaaauacaaaaaauuaguauguggugacacacaccuguaaucccagcuacuugggaggcugaggcaggagaauagauugaacccaggaggcggaggcugcagugagcugagaucgugccacuguacuccagccugggcaacagagauuccgucucaaaaaaaaaaagaaagaaagaaacaaacaaaagaaaaggucugcggaguacacacaccccaggagugcuggcuuucucagcgaggcacaguucucaucaauuaaugaacugucauucuuagcaguaucuuacaauucugaugcauguaaaccccaaucccccauugauaacuccuagauggaacuaauaacauugaguuuccaaaccuauaaaaccaagagugaugccuuagacccaugaucauucucucucucaaagcuaagucugagauagcccaagggucucucucuuacuuuaacucauauuuaauuaccugugauuuacacacuagaaaauaagaucuuuugaagaaaauaauaagcuucaacuauuucugcaaacguguuacacauacacaaccgcacagaaaaacacagauagaaaccuucaacuucuuccuggaucaacuuaccacauuccuaaguucugaccagcuuauuugccaacagaaaauucgaguccaggaacuuugggaaccucagaagcaccagcccuccccaccccuccuucccuucccauucuucaccuccacacacacaaccguuauuucuccuaagaguuaacuacagagacagcaggacaccaguucugguagcagguccaccaccuucacacggcauuugcagaggcuguggaggggcagcaggcucugcugugugcaaugcuucauaucacccacccaccccacuucagacuggaagacacgguuauguuuauuuucccccagaagauaagugacucacaggcaguuugacaacaaaugucaagguccuucaaccacagaaaguucccagcauuuccaaucaguugggacauaauccagaagagguugccugggauuauuuuuccuuggaaauuacauucauucuaucuuggugacagacacccacauauggggucaaacuuucccucauccaaaaaaaagaugauaaucaaaaucacaagauaccacuucauauccauuaggauggcuacuaucaaacaacagaaaauaacaaguauuggugaggauguggagaaacuggaacccuuguguacaguuggugggaauguaaaauugguguagucacuguggaaagcaguauggagguuccucaguauauuaaaaaacagaacucccauaugauccagcaguuccaccagguguacucccaaaagaaugaaaagcagggucucgaagggaaaugugcacaccuguguucacaguaggaugaauagcaaauguguugcacguguuagcagcguaauguauaaacacaacguuguauguccauagaaugaacuauuacccagcuuuaaaaagaaaggaaauccugucacaugcuacauggauaaaccuuguagguauuaugcuaagugaaauaagccaauucaaaaggauaaauacugaaugacuccacuuacaugagcuaccuagaagagucaaauucacagagacagaagguagaacccuggccgccaguggcugcagggagggagaauggagaguuacuguuuuuuggguacagaguaucaguuuugcuagaugaaaagaguucuaaagacggauggugguaacaaugugaacacaaugucacugaacuguucacuuagaaaugguuaugggcacugcggcucacaccuguaaucccagcacuuugggaggccgaggugggcacaucacuugaggucaagaccagccuggccaacauggcgaaaccccaucuccacuaaaaacacacacacacacacgcaaaaaacagccgggcaugguggugugcaccuguagucccagcuacucaggaggcuaaggcagaagaaucgcuugaacccgggaggcggagguugcugugaggcgagaucacaccauugcacuccauccugggccacagagcgacuccaucucaaaaaaaaaaaaaaagaaagaaagaaaugguuaaaauggucaguuuuguuauauguauuuuaccauaauaaaaacugucgggggggaaaguugauacaugccacuaccugaaugaaccucaaaaacuauggcaaguggaagaacucagacacuaaaggacacacagugcuugagucaauuuauacgaaauaucuagaauggauaaauccacagacgcagaaaguacacuagugguugccagggacuggggagaugaggaaauggggaacaacugcuuaaugggcauaggguuuccauuuggaugaaaauguuuuaaaacuagacagaaguggccgggcgcgguggcucacaccuguaaucccagcacuuuggaaggcugaggcagguggaucaugaggucaggagaucaagaccagccuggccaacacaaugaaaccccgucuguacuaaaacuaugaaaaauuagccaggcaugguggcaggccccuauagucccagccacuugggaggcugaggcaggagaauggggugaaccuggguagcggagcuugcacugagccgagauagcgccacugcacuccagccugggugacagagcaagacucugucucaaagaaaaaaaaaaaaaaacuagacagaagugguagcuguacaacuguaguaaaugucacugaacuguauacuuuacaauggcuaauuuuauguuacaugaauuucaccucaauaaaaaugaauuaaaaaaaaaacccugucacacagaacaacagagaugaaucuugaagacaucaugcuagugaaaacaagccaaucagaaaaggacaaauauuacaagauuccacuuacaugaagcaccuagaggugucaagugcacagaggcagaaagcagaauggugggugccaggggcuggugagaaugggaguuacuguuuaauggauacagaguuccagaucugcaagaugacaaaguuucacaacaggacuacacuuaacacuacaaaacuguacacuuaaaaaugguuaagacaguaaacuuuauguuacaugguuuuuaccccaaaaauuguuaaauaaagcaaaaacauugggggcggggggagaugcaaauauggaaaaauagaauccaggauugcucaacuacugaauaccccaguccacccccauauucauuuagccaagagccuguaagaaaacuuguauuuuucuucuguucuaaacugucacuuaauaucugcuguucaucguuuuuauuauucucagagcuuccagaguaaguacucauagcuaaaagcaucguccaguaauccaguaggcauuucauuauaugcccaucaauauuuaacucugaauauuaaagcaaacacccaaguauuccaaaagagaagaccaagcucaagcucagagcccucaaaaaguccaaacagauauucaagggcuccaugaccaucagcaguuacucccaaaagauggagacucucagcgacgccuuccuaaccagcuguccccagaccugacugcgugagagucauucacacauggggagcuuuuucuaaaacacacuugggccccacagccagacauucugacugaaucagucuagggugggugauaggcaucuacagcucaaaguuuuccccagguguuccuaacguacagccagauugaaaaccgcugguuaacagugcgggcuggcaguuaugggggaguaaaggcaagaaagacagauggcaaggaaaaccaauuaagaugggggaaguggaggacagcagaaggaucuuaggcuccugcaguccuugaaauuuaauuuuacugcaguaauucgagugcaaucaacaggcauauuccuucacccugcacauauuucauuugugaaauucgguaauuaguaccggucaucagaugagggagcucuuaaaauacagaaacuaagcaugccccagcaggccaggccccuucccuauggggagagugugcacugguuuggaaagggcggugccagaugcuggcuuagagcccgcugcauaaagaagggguagaagacagcucccagccaggaccuucccaggugaaauaccucccucccugggauggaagaagaccccucccacacacacucuacugagcucuuucucccuacgugccugguguggguuaagugcucaccaggcaacaucuuguugaacccuugugacagcuucaugcaguaaacccugugauaaacuccaucucguagaggaguaacagagacauagaaagguacuugucuaagggcacacagguaaguggcagggcugacaccugagccacuccaugacuccaaagcucagcacugcccacaccaacuuucuagagcacucuuagugguccccaauagcacaaacagcaugacggacgcaccacugaguacaaagggcugugccccgaacacaugaauaacaaguuauuaauugcucuaagagauccaacccaggagauucaggcugcagcaaaauccucauuucugcaaaaguuauguccugagcaggggugagccaaggaggaacaaagaaugaaaaggaaaauaaauucccuuaacacacgggggaaaaaaaaacugcucacuuuacagcuguuuuccuccuuugccaguaagaacaucccccuaaaaacuguaaaauggagaaagcaucaaucuccaaagagugagcaaugcagacaguucucgcacaagggccaucucuuaucuugcccucccucuauucccuugacuuaggcauuuuuccucacuccaacucccuccuugcccuaccucaccagauaaagggccggcagaaugaccaggaggugcucugcugggucgucaggcugaacuaaccaccucucagcccagagcugagcaacgugcuguaucccuagucaccaucacccacccuuucuaaacccuugcugaaaugccuccagauuccagcccuccaggagcucguauuauucucuaccuacaaacucgccaaauaauugagagcaaaauuuucucaguuucaccucuggcacccuaggaauaccaagaccuggauuaaaaucuugucauuuguucugugaauuccaugaagguggacggaaaucucucagcacguuucugguggaacccgaguucguuccuuaaccaggcaggucagcaagcaguuuccaaucaccuuaggggcacugauagagcuguggacauacggugagcccacucuucugggcuccagguauugccucggguuuccccaacauuucacaaacauaaauccaucuccgucccaucugucaaacauccuucacccccaacgucuacaccagaagucaguggccuaucaaaacaguucuguaagugguuggcuaagguauagagcauuaaaauaaccagccaggaggagcuccagaagauccaaaaugcaaugaauaagagaaccucagaugccuaauccugcaucuugccuaaacagguagacugccccggacuucaaccuagacaaucacaaacauuaccgccuacauucagaaccauuuuccagugaugaacuggaucaugccagaccccuaaugaacuccuacagggacggcaccagguccaagaagcugaaggagacccagagccagcaaaugagacacaggggcuuacgagugggaaaccuguacacagggauggcccaguggcaguggacugggcaggaaaacugcaacugcuugaagccugugguuuauaaauagaguuuccaccuagcauccucuaacagccuccacggggcaaccuucauuuaacccaaaacaaagggccucgcucaucuguaugcccaguguuccacgggacaggauaggggcucagauguuccucauaaacaaggaaugaaucuccagguuggccacucccggauuccuuagcucaaaacuccaaacacacauucaggugugucugccccacagggucacugucaggguaugcuucaguuuugccgucagguaugucugccauccgcaguggugaaaggagaguuaauaauaaaaacuuuugcuaaagagagccagaagagaggagauugcuuacaaacaacugaucauucuauuccucaucagcucucuccuguaccucagcaucacugcacaaucuuucuccacuucucggagaugaaauggcaccuccaccuuuagggcacaggauuuaagggcuuaacuuacaaauacagcuggggucuguucagcugcaagagcaaggcagcaugucuggacgaaaaagcagacauucuugucuccccuaaucccauguucacccugcaccagggagaaaaagccagacuugcacccagaaaugaugucaacucccaagcaugcugccaaaccacagcauguuaccagucagagacucagcacgcagaucccagcagaaaagggcaaaaugacuugguagcccauagcugagucacccagcaggcaaacagcugaaggagaguaggagggagccaggggccagggaugccuugaaccugugaggcauggucccccauguggcagacccuccacaacccuggcucucagccauucucccccgagcccaccagucucagccucaucucccucaccuagcaacgucucggugcugagccagacacaggaagugccagggcagacaaaaucagauccuaaaugcucaccaucccccggcugucucucugaccucacgucccauucaccagcuugcccuccuccuuugguugcccagacaugccaaguucauucuggccccaggaucucugcacaggaucuucuccaagcccagacagccuucugccacacuggaucauucuggucaacaggccucgcccacagguccccuccucggcccuuccugaugaggacucaccucucauggagccccacuucacacucugauauuggcgugaccgucccccagccugcccuccuuccagaauauacaucccugggcccauguuagccuggcuccccacugucucccugcugugggaggggccaagccugugcuggccucaagacacucacaguccacugggacgcaggggaucaaauuaaaaauuacacagaggcuccaggcaaaucagggaaaucucggguguccaaagugacauacaaagggggagggcugcuggaagugcagacccucaccuucacaggcauguacgccaacauccgggugcugauggagaugagcucaggccuguccacggcuccagcuccuccaugugcagcaggcaccauuuccuucagcuugcaugcagguccaaggacacagacagugggcccccuccggcccccuucuauuggaagggcuaacagaggcccaccaggauuuccaacccuuucuuacagaguuuuacuugguccugaacaauccagauacuccaaguaaaaacagaguaacccccacugucauuccucugaagaaacuaaaugcucagugcugaccaucuccuuacucuccggacaccguuuaacagcaaggacagcuuucugaaggaaagaucaaugccuuaaaaugaggauucuaaauuuucaaacauuuuaacauaaugcaagcaucagggggcugcaggugaccuuucaaaguuguuucucagaucauuuccucuguucuaucagucuggcuucuuguuccaucauugggccccccagcuccaucaucccagcccccugcuccaucaucccaacugucugcuccaacaucccagcucccugcuccaucaucuuggcuccccgcuccaucaucccgcucccugcuccaucaucccacucccugcuccgucaucccagcugccugcucccucaucccggcuccccugcuccaucauccucgcuccccacuccaucauccuggcugccugcuccaacaucugggcuccccacuccaucauccuggcugccugcuccaucaucccagcuccccgcuccaucauccuggcccccccgcuccaucauccuggcucccugcuccaucauccugcuccccacucugucaucccagcugccagcuccaucaucuaggcucccugcuccaucauccuggcucccugcuccaucaucccggcuucccugcuccaucaucccggcuucccugcuccaucaucccagcuucccuccuccaucaucccaacugccgugcucuaucauuccagcucccugcuguuucaucccagcugcccugcuccaucaucccagcugcucugcuccaucaucccagcucccggcuccaucaucccagcucccuguccaucauccuggcugcuuguuccaucauccuggcuccaugcuccauuauccagucguccugcuccauccacagcuguccuuauccugcucuaucauccuggauccccuauucucucugcaaguuccccugauguaucagccuggauccccugcucuaucaucccagcugucuaacuagcacuccagugcguauguuccaugcauaugacuuccuaugagcaggggcaaugccuagguuucuaggcuuuguccacaauuuauaugugugccucccucuccuggcagccacuacacucccuucccgaaauaaauaaaugauacagaagugauaaaagguacucuccucuggcucagcacugaggaaguagggauaaggagagucggcugcaggaggaauggcacauuggagaucucuccaagguaggccaacuccagaggcccuaggaagagaugaccagccugaauggcuguggaacugcaaaggcaaggcagggcuuaaagccagacaccuaugaaaucaccaacccaucagcucacucaaucauguccauuaauccauuaagccugcuuuguucuacggugccccuggaaacuuacacagcacuuugaccgauuagagaaccuuaaaaauguaacccaaaugugacaccugcuucauucagcaccacagcuucaccuuacacaaagaaacagagaccuucccagauugaaggcaacuccacauugcccaaaggagggacacggacuagagaagaaggauggaaaagccugccucaccaggugccucugcaccccgacugacacuccuaguccaaaaauucacaccugaugucaccacugaccugcaggucugcucuaagcaagacccguccugggucagagaagucaagccagaccagccccagaaguaccugcaggaagggagagcaagcacaaauaaacguccucacuaagcucgucagcaucaucuucaucaacucacuaacucucuuuuccagacaaggaaacgcaagccaaugucccacagcuacuccguaguaacagcaggaucugaaccaggucuaacaugacaggccaggcucccaaccacugugccauccuuccucgucaugguuagcaugaccaaacguggguuuucacacaggucauuccuccuuaaaaucaucacagaguguaucuauugaucugcaauccaguugugaguugucuuaauuagagccaucagcaaagccacgugagcacuuuucuaauugacagaacuaguccucagcccucacaggggggcuuuguugcauugccacaauuauuaauuugucuuccacuugucacucaucugcaguuucaaaagcaagccagaaacugaacuaaugaaagaacauuuccuaauuaaaaccuugcagaaaaguuuucaaauuaacacgcuauauucagauaguaacagcucaagauguugaaaaauccaauugccaauaagaguauuaaaaaauuaaacagcacgcacuuaaaaccauaucucgguauaauuuuucaaagacaagcuggaaaagauuaaggguggaauugggaaauaaucuccuggccacugaacacuggauggggaaaggguucuggccugaagcuaccugcagaaccccaggggccacucgguccucacaccagcugggggggacccugaccagcuuccucaugcugucuggggcucagauuccccacccaaggaagaagcaaagggcugcaggagccccuucauccucacacuccuuccaaaacaacccaccuaccuaggaaugacaguuucaggcauggucugcggaggcuggaggcgcuuucgaggaaaguagguugguucacuucaaaccuggcagaggaggcuggcucuggcuggggaacaggagccucugggcucgugaaugccugcgacgugucacaugugaugugagagcacacugaugcagcuuccccaagaacccgugucaacaccuccccgccuucaaagugacaguugacauuagcaacagcaguuaacacuuuuaagcacuuacuauguauguaccaggcaccauucugagcauuuuacauaaacuaauuuauucaucauugaacaaccugaugauaggugaauggggaaacugaggcacugaaggguuaagugacuugccugaggccacagagcuaacuggauaagccagaaugcacacccagagucugcuccggagcccaggccaguggccccugugcuaugcauccucucugccaugucacagcagccccagaaagacacccagagcuagcuguccaccaagagcucccaugcacaagccuccugggcuucugcugucaaacgaggcuagggccagaaacaggcaaaacuguuuccaaagcccccaguauggauuuacagagucacccuggcaaccugcugaugcuagaccuucccgcuggcaccaggaccuaaauggcaaguggucagagcaccacugcuugggacaucacacugcuucaugcacggggccugaugucaaggccugcucccugggucaacaggacucgaauuucugcagaaagcuccgacucugaacacacaucaguccuccaccgaggccuccccuucuccacaguaaccuaaaauaaaaacuuacauagcugaugagagcuucgcuuccaaacaacuauggcacauuugauaaugaugucggcgcuuugcaacacuggaauaaaaaaauuagaucaccaaaaauauccuuccagggccaguacaaggaaaaugacuccacacacucuccacugccaguuagggagaaaaauccucuaaacuaaaaccuaugucuuaaguacaaacacuacugcaauuaugacauaugccaagucacauuuauuaccaggaagaggggaaacuuuaccucuaucccuuuucuuucuaaaacaaaggacgccaaauucacaucuuccuaggcaaaugcuuagugacccagauuacuucuugacccauaagaaugugugagcuccuaaguuacugaagugcagauggaggcugagccucagcaacccucuccauagggacauuccucaugagcccgucugccuccaugagcccaauuaugaggccuggacagccacaguuauguuccuuucaugacggccagccucaggccuggagcuuagaccauccaagaacccagacuugaauuacauucuccucccggcucucugcuucucgaucauccacaucagcaguuucaauaaaggguuaguagaucaccagccccaguaaucagcaccuuccaagccugaagcugcagcucugcgucagcaagagggaaaccugcuauuuguaaccugauguuucacgaacuauagcuuuacuaagaccaggacagccagggcugacuuucuccagagccguacuuuaggcagguggaggaacacugaaauucuagucccaacuuugcuacugcaugacccguggggcaggcuaguaaccuguggguccaucagaaacugugugugaaugugggaagaaaagcuguucuuucuccccagcuguucauucucccaggcaugcugaaaagcaagacaaaugagcaauggcucuaaagcauuucagacaucucagagacaaagcugacauaaauuugaaguaccaggaauuauaccuuacagaagauacgcaguaucauaauuugccaaaaucucuuauugacaaauaccacguaaaauagccuuuagcaucaauaucuuguugggagaaccaaaaggacuaacacauauuuauuaacggucucccacucagcuucccaagucauccacagcuccugauggauagcuuauaaccacaagcaaagcugccuagcaugagugaaaaaucuggcagaaagacugaacauaaagaggugccuggcaaaugagaaggguguagucaagauaauaaaacaucuggcuggacgcaguggcucaugccuguugucccagcuacuugggaggcugaaguggagaaucgccugagcccaggaguuugaggcugcagugagcuaugaucaugaucaugccacuauacuccagccugggugauagggugagacccugacucuaaaaauaaauaaauaaaauaaaauaaaacaucuacagugaacucugguggguaacagggucuuugguccaccgggcagucugcuuaggcagaaaugaccucacagaccgccugagcucauccucuaccaccagaaacugcaccaggauuagcaauuuccaaagaauguagauacuccucacagaagaaacagcaaccaauguaagaaugcuucccuggugauacagguacuaagucaggaucuaacgugaucucugaugcucccuaugaaaagaaucacuguggaauaucccaaacuacagaagagcugugaggcagaagcaccucuggacuaauacgaucacaaacccuuugagcugcuuuuuacaaaaauacuaguuuucagcugcuucuuuaauuuaugcugcauacaugaguaaauaucuuuuuaaauuuuuuaaaugaacuuuucaaaaguacacaaaaauaaaacaguagaaugaacuccaugaacccacuggucaacuucaacagcacaucuggcuucuuccaugauccccccccaaauacgacacauuguauccacaguuuguauuguucuucaaaaaauaaggauuuuuaauaauauaaccacuaauaaaguaggaauugccuuaauugcagaugugcaacccgcagauaugaaggcccaacugcaaugugacacacgagaaaaagaaaggcuguaauuggucaauucuaagaugcccuuuccuccaccacccccgacuggaaugcagcucacaaucaaugacgucggcaaugcuaugggcugggcaaggcccaugaugcauucuuaccagcccaugcucaaucauccacaucugcaggacauauacgucaauggcuuagaagaaaauccaagaaacgacaaugaagcaagcacucuuaaucccuaaaaaccaaaucauggugggauaggaauggauggugaauugaggaguuaggcaaaauucccagaagagucaaaggcuggcuaccucgacuucauugccaagcugucuucaaaguccagaaccaauggcucuuaguauuuuuauggauuuuuuuccuuaggaaaugcuacaucaccagcgcuuuugguggcacaguggaugacucuguuugaagaaaauaggcacuaacaucugagucaaaaagugacucagagugcuuggacucugaaaaacuuuuagaacacuuugcucaauguauuucacuuguauuuuccuuuguaucuaucuaugcccgagagugauauauggaaaaauugaugucucggucugaaagagcucuuucaauaaguagaaaauaagaaugccaacugauaagaacccguugugucacaggucaauggacaguguuuuuucuuuccuagugguccacaaaauaauggcauguuugacaaauaauggccucucggaauugaugaaaaaguuguauuccagacacaggggaaauuagugaugaucaaaagugagacaggaagacaacuaagugagcucccuggcacaggggauggggcaggacaagggcaggaggggaaggagagugcggcagggcaggccuuuugaaggucacagagcaaaagcucaacaucuaggucaaggggaaagccccagaggcagcaaggaggaaacaaugagacugggaggcaucccacacugggccaacccucucaucauccaggacagccauacaaaugccccuacccaacagucaucuacacuuacccaaauacugauaacagaguacuuaauucaugggcaucuccaaaacacaggccuuuaauuugcaccggcuccucaagcucucacagggcaauuuagcuaagaaagacccuucauuugaagugcgucauuuuucuagggcagcagccugucagaaagaaaagaguucacucccuggacuggucucugacgcagagaggaagaaaccuugauggccacucuugaaugugaaggccucucaaauuaccuguucuuuuucccgccauguaaaugcuccaguuguuuuauccagaaguacacuggacgcacggugccuaaccaucccaaugguuuuaugggauugguaccuaccaauccgauaaaauaucuaaugacccuucauaaaugagaauggccucuaugaaaagcaccugcaugcccucaccuugagaaccaggaccagccacaacuucccacaguuccgccucccugagauuggccaugaagucacaucuccauuuuacuguccccaaguacaauacuaucuaucacagaagcucaguguuacccacauugccaagaauaaccccccucuccaaagccuggguaucaggcaggcaucugaucucugguuuccugcaaauaugaaucaacaaaccccacucccacccgcagcaacucccaaagaucacaucacagcggaaauccugugcuggaaaaggugcacagggacccagggggauuucucguuaaacagcaauaugugcagaaagcacuuuaagaauguguacuguucuucaauggugcaccuaacaaugaaugacuuacccgaugcuuggugcuucacagaagucagcucaggaaucaagaaaugagauuguuccacaagcauaucccacgaagcugaucagcaaauuaaacugcuggagcagucuaaauuaaaacugccucgagcagcugcaggucuguaguaagggaagcgauuaugagaguacacacaaccuuuuaaccaggaugcauucaugccucaucgaggagaccagaacaagaacaggugaccaagaugucuacagcauggagggaaacuccaccacuagccaaccaaaggcaacauccuucgggaaagaaaacuggcucauuuguuuagcaaaagaaaccaaggaguagagagaucaccgaaaaagaggcuggacgaagaugaaaccaggggcuaccucugaagcagagggaaccacaauggcucccucuuagucucagcuccaauccugccuuccccaugagccuacgugaucaccacuuuaauacugcaacuauccuuccgcccucaucccuaauccccauacacugcucuauuuuuuccacagcacacagcaccuuucugcacacgacguaacugacuucaugucuacugucuggcuccccgcagccccccacuagaaugaaagcuccaagaccacaaggauuccgugucugcuacaacaacugguguacucccaaacacucaagcagugccuggcacauaggagggucucaagagauacucacugaaagaauaaaugaaaagaaccagagccaguuuucaucucugcuccuuccggaggggcagcugaggauugcggccuucaggacaggcagaggccuggaggguaggaacacaaauuccauggagcaaaagguaaaaaugaagaaaagagcagccgggcacgguggcucacgccuguaaucccagcacuuugggaggccgagguggguggaucacuugaggucaggaguuugagaccagccuggguggugaaacccugucucuauuaaaaauacaaaaaucagcugggcauggugguaggugccuguaauccuagccacucaggaggcugaggcacaagaaucgcuugaacccgggaggcggagguugcagugagccgagauugugccacugcacuccagccugggcgacagagugagacuuugucucaaaaaaaaaaaaaaaaaaaaaagcaaaacagaccagcacuacuaucaaagcauuaucaagugugcaucugcuccaagaugccuuccaggaacuuuccaaaugaggccgcaguaugagggcacugccaaugcaaggaaggggcaugggaggcccagggagcaggagcaagccagguucacugcuggcuggcagaaacccucggccaggaguugcagaaaaaccccacugccuccagaggcccugaggagaucucuuccaccagacaacccugggucugccaccugugagcucugugaccuugggaaagucacuuaaccuuucugugcuucaguuucaucaguacacuagaagaaauaaaagggcugagaugaaaugcagcccuuuuauuucuaugcacagugagugccaugaaaguguuuauuaaauuuugaaaauuaaaacguauuaauauauuagcccuccccacagugguucaccccagaccacacagaaaggcagucucauuacaagaaggucuaaccauaauggcucagacagaaggaaugaaaucaaaauuaacggacuaaggcagugguucucuaccaagggcaauucugcccaccucccacccucgccaggacacuuggcaaugucugcacauuuuugguuguuacaacuuggaagaucaggggugggagaacuacuggcaucuaguggggagaggcuggggaagcugcuacacaucauacaaugcagaggacagccuugcacaacaaagaaugauccagcccagugcagucgcucacaccuggaaucccaaugcuuugggaggccaaggcaggaggaccgcuugagcccagccugggcaacauagugaaacccugucccuacaaaaaauuuaaaaauuagccugcuguggugacacaugccuauagucuuagcuacucgguagggugaggugaaaggaucaccugagcccaggaguuugaggcuacaguuagcucugguuguaccacugagcucuaaccuggguggcagaguacaacugucuuaaaaaaaaaaaaaagccagccaaaaaugucaauggugccagaguuaagaaacugaaccagagcaaccacagucccgaaaguacccuugucccugcccaaaugcauguccugaccugaacucuggaaauucaguaacucuacccccaacccuccuggccauuccucuucccuaagaguuagggacagaaaacugccagccaugggcaggaggagguggucagcagaguggccuaggagagacucucuguuccauggggagcuccuggaaggcugcggcagaagggacaguugaccagggcaagcagccagcaagggcaggcugagccaugagggaucggcccauuucccagcccccaggcagccagcccuuaacugcuucuuugugacagcccgccucagugagacaaggggcucauauaacucccauagccugggaaagcuuuuuaaauguaagccuaugagugagacucuaugugacaguuuuuguuuaucuccaaauccggcccugaugaaucacugucaucuacauuucagcaugcuaagaaaccuaauccauauaaaacaccccaugcuucuggggcccauacuaguagacaugacuaagugcaaaaaugccaguguuucacccugugcugcaggaggcaagagccaggcaggagcacagugccaccugcuuagagcagggaacccuagaaaggugggggcccaucagggaagauggauuagugucuugagccccuuuuauuuccaugguuuacaauagagaaaggugggagaggcuuucuggacugggcagguaaucugaagacagcuuuccugccaacuccauacuggguucaucaugaagaucaagcacagggccaagguaaaggaaucuucacacuguuaagagaacaaggucaaguuccacucuaaggacaggagugaucacuggugagcacacaucaaugaauucaauguaauucuccauagaggagaguuccccgccaggcccagccuaucccagacccauucagggggguuugcauauggaaguaccaagacaucccuccuccuuaaaaacaccucacccauaaggcagucuagaggcaaggccacaagauuacaaugguggaaccagaacucucaacaguaacagugaaucaagacuuacucagagggaaaagggauuguucccaucauggaaguggggcuaggccuccuucuauccaaguggcacauuugcaggggugacaaucagcauguucacuauggcacaggcacagaaguggguccaagaggccccucaagugucaggauucaacccuuugauugcugaacaugggaaagagaucccaaggaaagaccagggcagcuaggaaccggagggcacucagggggucucaaggcagagcauauuuaacaaccagcauggaagugccccacuguuacaugugaguggcauggcuaagccaguguguuuccaucuggauauccacugacuuguacggcucagcaucacccaugcagagcuuccagaagaggcuucacaaggacaaaagcacaaaaaccaacagggagcauagacuuggccagguuuguguguuuucucaucacgugaauucugcugggcacuccaggagacuucacaggcuuuucccaggaauaccuagcuucccuuccugggaucucagccagagccucacagucgacuccugcuuacaccugugucucugucccaggcagccucaccgcaccccccgccacccccgccccaccacaccugcuuucacuaagcccacugccucuggacuugcuagaaguuaggcaggacaguggccuugccugcuuugacacuaaaaucaguaucuucccaaacugacuucccucuccccaaagcccuaagaaacaugagcaguagcaagaagaaauuaugucuuccccaacccaaucucccccacccccucucccaucauuuuucugaccaccucuuccucuguuccaaacaggagaccaaccacucacccaucauucauccaaacaggagcuaggguggggaaacugacagcgggucugaagacucauaaaaccuucaccagccucccaggugucccccaccccaagguccaacagagccugggcaagcugaccccacucagugcuggguaaagcaguugcuuuuucauuuuugcucaagggucuagggaagagcucguuacuuuugcacuguucagcagucacacaaucuguuuccauuauguuugcugacccagaggcagccacagcuucacuccagaauugggaaacuuuauuuucuuuaaagagagaaguuuauguuacagugccacugucggauuaucuggcuauacagugguuuucccugcuacuguccucccugugucaacuucaaacucucauuugaaguggacuuucuuuaaacuccaaacugaugauagguggcaaggagugguauggguguuccccuccgcauccaccaagaugcucacagauuuuuggcacccauuaaaccacgugagggccccaugcuccaccucaagucaugcaugcuuccagggaucacagcgaccugcccuucuaacaagaggggcagggcuacagagggagagcaguggagcucagaaccugggaucccaccacaggaaccccucguucagggacacgucuguccacuguuggacacuacaacugccuaaccgccaaggcaagcugcacccuccacccacauucccgauggcugcccacuacugggauccccauucugacaccacaauuggguacaagagagcuggcauggugucuggacaacuucccaaaaaguccgucucuaacagcauuuaagauucauagcccaaaccccaaaugaaccagucagaucaaucucagagguggggguaacggauaaaaaaaagaaagacgacuauuuuccagaaaucaagaauuguaucaggaauaccgugaacuuaagauuccugguucacuacacuuucaaggggauauuuaggcuuuuauuuuuucauuuuccucuuuuagagauagcaguuauucagcacccacuaacaguauuuaacucuccgaacaaggccaugagguaagaaugauuacucccacugcaaagaugaggaaacugagggucagagagguucaaugcaucagugaaggucacuaagcacaaagagguaaacagcuaggucucacucaaugccaauaaguggauuugugccauuucccuuuaaugucuacuacuagcucaaaaacauuacuaguucccaaaugguucagcuuggcauuugaagcccguuacaauuuaguucugaauuucuccaacuuuacacccuaacguuccccuccauguguaccauggucuagcccggcaagguccuucacuguuccaagaaauaaccugcccgccuccccgcaugauuccuagaagaucccacccaaagucccccacccuuggacucucgggcaagggccacaggacucgugccagcucagggaauaagggugaugcuacugugcaaaguggacaggcucccagggcuccggaucaugucccucaacuaacaccgucccuuaccucccagcaugcaggcacacaggcaaggggucucaggcuccacacacucuuacagcagagagaaaacccuucccuuuccacccuaaacagccacacuucacccacaggcagcuucauuuccagagaaaucccuuccucucuucugcggcuccauccacugccaacguaccaaagcccaggggagacuuaacaugguuaaaauuuuaaagcauuuaagaagcucaaaggaaaggcacgcuugaagugcaaaucaucaauuuagggggaaagagcaaaauauggggggaaaggguauggacacaaauguaaaugaaacauaauuuuaaacaauauuuugaauaaacugcuuuaacauacauguccugagccuggguguugagucccgaguugugcggcagugccugagauuggucuucagcacucccuccugcuuaguuuacuaaaccugcaaucugaggugagcuggcucucuggguuuugccaaguggagaauaacaguucugugaugaguuacuuaacaggcagggcacacaaugacaagccugggcugggcugcugaagcagcagaaauccuaguuggacuccccucagacgaucccuaaagcccaauacugcagccuaguacccuaugaaaaacgucaggaugugcagaaacuggcuaaauauggaauaaaagcccugacuugaacaguaugaggcaagagaaaaaauauagguccacuuaucucuaaaaaaacuauagcuagcuuuuaaauucugccuuucugugcauggcccgcuaucuuuuuuuauguccauacuuuacaagccaaacaaaccacauuuuuuuuuugguaugagaaugaaauaaauuuagagacacuucuagugucuaaauccauggaaacaauuggggaagaaagaagacuacacgauuuuccuauacaucaggcauucgugacagcagggcucuauuuaccuccuucagaaaccaucuuaaggcuucucuuuaacccuggguccaccacacgaaguuaaugagucuuccacugcaauuucaaaagcuauugcauuuacacaccucuuccucaaccgacaaaucacuaaagcauccuaagggguagcauuaaauuuuaugguucguugacagaaagaauagaaucccaaaucaccaauccauguguaauuaauuguucauuucccccacuuuuucuaccuggucuccguaccugucuauauugccaccaggaauucuuuaaaaaaaacaaaacaaaacaaaacaaaacaaaaaaaaacaaacuaagaaucacacacuucaggagugucugaagacuucugcauggaagaccccucacaccauccaggaacugaagcccaccagagugaggaaucagccuccgggaggcgaacgagcacgcuugcucuuucuaaucacguguacuaaugaaaguggcagacuaaggaaagagaaacgccaaggguggcuuauguguuugguuuucuuugcaugaaaggcagaaagcuuugccaggucucaccagcacaccaggcuaugcagaguggccaaggcacaguuuaccgggaagcaaaguuuuaaaaaucauuccaguuuuacacgauuauaucucugaauggacugcacggcuuuugcugccugcaugcucuuugcuguucaagaauaaaccaagucuucgcguacauauacuaccuauaccauuuuuuacaaaaacaacgcuaagaguacaaugucagcucagaagcuaggccgauucagcacguggaaagagggcuuuauuucugcccuucuagauaaaacaaauccacguaauuuaccagaaaccacauaaggcacccauuccaccuaacaucuucggcuaugaaugaaugaaugaagcaaagaaaaaaccucugaagcagccaaaccccggcguggacauuuaggggucugacuucagaacugaagucuguucaucuaguuaguucccucuggcuuguuucaggauaccacucucuuguuccaacccaaccacccguaguccaucuccauuaacucagaauuuucuggguuugcggugacacuaaaugucacaguaacgaggguuacaggaauucggaaaagauaacgcugcuuucaaagccgaggagccaguaaaacacuacaaacguccccugccggcaugcuccagcacacagcccgacgcccugcucucccggccggcgcucggccgcaggaccgcgcugucccggcuccucucggcgcucaccauccucccgaaugcccagggcccggccguccggagcggcggcacgaggacgcggaaccgcagagcggcucacacgguccccacagccagaucacucggccccuggagcauguuaaaaacacagccacagaagagggauucucccugaagcggggaguggggauggaaaaugcaagcgcaggaggccacguccggcucgcgcgggagggccgggggccggguugggcagaggguaacgcuggggccgcaagggaacggccgggacuggccucgcucggggcgcaggggcgcacuggccccuggcucgcacgggcccuggggcuuuacuuggcacgggagcggccgccccugccccccaaagguaaagggcaaagaagguggcagaaacacggaacccacgccccgcggagugacagggggaaagggacgaggauuugcagccgcugguaucaaagggcugaaaagaaacuuggacuccucucuccugcuguacaugacgcguuggaaaagcggucgccucucucuccucuccuccccacccccuuuguguuucccaacacccccaucccuaaacuuccaaccgcaggggauggggcucccggcggccggacaagacucgaauuacgacgagcagagagaggggcgacguccacgagagggggcagagaaaggcugcgggggccgcccuuucggagcccggcgugcgcagaggggccgggugcaccccugcccugggcacucggcgcggaggcccgggacgagggcgggcgacgcgagcggagguccgggcggaggagcgcaggggcggcgcggagagggcaggggacaggggcgcaggguggggggugggcgcaggggcccggccgcggcagggcgcuccacucaccuuccugccggcgccgccgcccgcgcccccggccagcgcagagccgccccccgaguacauguaguaggcgaugcccagcacccacaggaaggcgaagcagagcagcauccgcgagcgccgccgcauucucccaacucggccgccggcggggccgccgcugcucgcgagugcugccugggccggccgcgggcgcggugg

SEQ ID NO: 192003 - RNA, 21657 nt, Homo sapiens
cggaaguucuggacugcaguugaguggaaaugggcaacggcgggcggagcggccugcagcaggggaaggggaacguggaugggguggcagcgacuccuacugcugccucggccuccugccaguacaggugcaucgaaugcaaccaggaggccaaagaguuguaccgagacuauaaccacggugugcugaagauaaccaucugugugaguugucagguguggggugcccuugagaagaaaauggcgcggcgggauuuggggaccgcgaggagcaggguccucugauacagucuuuaguucgguaguugacauucccgcccgggaucuuugcaugaauaucuguacugauagagaacucagcuacccgacagcgcuuuucucauacuggggcauauuugggugauaugaccuaagccggcgaacggaccggaccgacagacagagguagaugugggcauuuugcagagaaauuuaaagaucaauuagguugacauuuugguucaugccaaagcuacuuccuucuagcucuucucccuuugacagagagaugguaccauccuuacccuccacaacccauguugaauucaccuacgaugcuuuuuaaagguuucaucaauugucguuauuggaugucuacgguguacaaagcacuaugcuagacguuggugguacaaaacccaaaagugaggaaguaaaaauucucauuucaagguguucguagaauaccuugaacuuucugaugauuuuccaucucagaguuaaggcccgaaucccugaacuggcuuauaaggcccuauggagucuccugcuacucuuucccuucuuuauuuuacggcagagagaauaaucuuauguuuaaagagucuacaaaguuggagguucuuuggggguauuaauuagcaaagaaccugucacagaauagacaguacauuuuugucccauuucagaucuugugauuuucuaaucucuuuaguaaauuauggucuguaguaauauacaagagaauugacaaacugaguguauaccuguauaaucugccaaccacauaacguucugaugcauacaaccucaauuuccuguuccucucucaaguacuuucccucuuuugucaaaaugucaacccuuguuaaauccaacauauugccuggucuugucccuguacccaugcagcaguacguugcuggggaaaaacaaauuugugacgauuaaccucauauaggccuuucaugauuucuggcaaucuuauuucgguuuuuuuuuucuuucuuucuuucuuuuugagauagaguuucccucugucacccaggcuggagugcaguggggcacucucagcucacuaaaaccucugccucccaaguucaagcaauucuccugccucagccucccaaguagcugggauuacaggccugcaccaccacgccgggcuaauuuuuguauuuuuaguagagaccagguuucaccauguugaccaggcuggucuugaacugaccucaaaugauccacccaccucggccucccaaagugcugggguuacaggcaugagccacugcgaaaacagaagagaacuuccaccagguuugcaacaacauaaacccaauacuagcauuuguuauuucuuuacuguacugucuucuucugccuucugcuggaucauucccaccagcaugcauacuguuacuucuuccaucaaaaaaaaaaaaaaaaccaacaccaccaacaaaauacacuugcugccacuucccccuuuagcuucugcucuuuuucuucuuaauuagaaagcagaccuucuaagauauguuuguacugucuauuuccuuuccuaguuucucuugaaccugcuuuagucacauucccacccgcauuucauuagaaacuguucuuguuaagaucaccacuuccacuuugcuaaauccaguagucgauucucaguuaaugaucagcagcauuuuaccucauuacuuccuccuccuugaaaugcugugugcgcuucccaggauucagugcucuucuuauugucuucuuacuucacuggcuguuaccccucaaucuccuuucugcuuuugcuucaccucccuuaccucuuaaucaugguguauuccaacgcauagucaucgugccucuuucugucugcaugcuuucccuugaagagcucauucugucucauggcuuuaaauaccgucaaaauuuugacaauuuccaaauuuauauuucuacccugaaccucuucccugaacuccagacuuaaauguccaacuaccuacuugacuucuccacuuggauuucaauagacagcucaaauauacccaucacaguuaauggcaacuuuaccauuuuaacuccuaagaccaagaaaccuuggugucaucccuauuucuacucuuccucucacaucccauauucagguauucagcaaauccuguucugucuucaaauuauguucagaauccacuacuucucacuacuccugcugcuacaauccucauccaagccaccaugaugucuaccugaacuauuguuguaacuccuaucuggucucccuacaucauccuuguaccucuucagucuucucuccacacaguagccagggacugauccuuuaaaaauguaauuuagaucauaucaucucuuugaccaaaacuuucugaugauuuuccaucucagaguuaaggccugaaucccugaacuggcuuauaaggcccuauggagucuccugcuacucuuucccuucuuuauuuuaccggcagucccgcuggcauccugguguuucucagaccaggcagguuccuuccucaaggccuuugcacaaugccuggagcacucuucuaucagguaucugcgugacuaauucccuuaccuccuucaaacaucucagagagucuacucugacuacccuauugaaaaguaugauaugcuucccagcuuuaucuuucucuauagcaccuaucuucuuguaaucuuguauauaauugacuuaauguugugugucuucuccuacuggaaaguaagcuacacaaggacagacauucucucuguuuuauucauuaauguagcuguaucacccagaacagcgacugacauuuaguagccacucaguaaaugucuguugaauaaauguaucacuuccagguuuuuagauuagcauaugcuuggccauccagguaggaggaagagaacaagaucuuauauguggucuaaacuuaauaacuuuuggacugguccaauuaaauggucaguuuggaagaugauaaccacauaacugaauauggucugaagaaaagcugguauuuguauaugcauuuuaguuaguagucuucaauaauacaaaaaaucucuuuuuguuggcauuaagcuaacaaaaucccuuugcuaaacagcagguguuuauuuuguuuauggaaaggcaaaauaauuauuggauagcuguuuaggucaacauucacuuacccccuccccuuuguucccuaacaugauacucuuucucccaagagauggacuuuggaguuauauuuggaauauugaaugguggcacaguacuuuauggauucguuauuguccacagucauuccauaaugagacagagugucuaauggccuugucgcuaucaugcuaaugcauacuaaacuuuaggccauaauagcacgacucagggaaaaucauuuuguugaugccagacuaaaaaauuaaaccaugaagcaaugaauuauuuuaaaggcccuccaaccucugagauacaaaaaguaagaaguuuuuaaacauuagaccauguguugugacauaaucuccagaguuucuaagugguuacucauauauacuuuggucucuucccugccgaacuuggagucagcaagauccucagccugaucgcccacguguauuuuucaucccaaucuccuuuccuuuugcucugcuuguuucuucacugccauuccucccagcuugccuuucuguguuucucugacuuuccucuaauauaucaugugucccuugcuuuuaaccaauccugcugcuucagcucuucacaauuuauuauaaguacgcuuaaagauacaguacuuucggccuagcacgguggcucaugccuguaaucccaguacuuugggaggccaaggcaggcggagcacgaggucaggaguucaagaccagccugaccaacacggugaaaccccaucucucuaaaaauacaaaaauuagccaggcgugguggcgcacucuuguaaucccagcuacucgggaggcugaggcaggagaaucucuugaacccgggaggcagagguugcagugaagcugagauugcgccacugcacuccagccuggaugacagagugagacuccgucucaaaaaaaaaaaaaaaaaguacuuuuuauuugcuauagggcuuggcuuauuuuaagugcacagauauuuaacaaauucauuauuauguuaacaaaacaaaacuccuauaagagucuccuaaguuuccauuuccuucagcacuacagcauucggcucccacccuugggauccuagaugcaaagaugaauaagacacagcccuacccuugaggagcuuaaagacuuaaagaagggaagggaaugcuccuagagaugacaggaaggaaacagcaggaauauuuaugaaaaaaauugguuuggccgauuuauauucuaaaagagaucugauucauuaggcauuggagaacacagcaggacagaggaagucauauccauguuuagacaggugauggaagcagccugaauucccagaguaugcuugguccuugcguuguagggauucuuuagaggaagauuuuucucuuuucaggauacuugccuauaaaguaguaaaugaaacaauuuugccaaaauaagaaacauaggaaacauaguugcuaaaucugggcaggcgugaugauucacaccuauaaucccagcacugugggaggcuaaaucgcagaucacuugaggucaguaguucaagaccagccugggcaacauggugagaccacccccugucccccacccaucuauacuaaacuacaaaaaucagcugggcaugguggcacgcgccuguagccccaacuacucaggagguugaggugggaggaucacuugagccagggaagcagaggcuguagugggacaagauccugccacugcacuccaggccuaggcgacagagugagaccuugucucaaaaaggaaagaaaagaaaagaaacauauauacuaaauugaauaaauacaacucccaguggucugcuuugggaugucuacauuuguuuguuucgugugugugugugugugugcguguguguguguguguguguguguguguguguguguguaguuuuccucuucacauucaaggugaaggcagagggaaaggaaguugcaagcagcacuuaagggaaaagcaaauaauagagggagaacaaggaaagugagguguaaacuuguugugcccagggguguuagagagaacgccacacuuugagacgaauuaagaguccuuuauuaagccggcggccaaagagacaacuaaugcucaaaauucucucggaaggggcuugauuaacuuuuauaucuagguuuaggaaggggagggggacucaaaugcaauaauucuacagaaguaaaaacaugcaagaaucaaaagaagcaaaaugguuacagagagauaaacaacuuaaaagacaaaugguuacaagaagagcaacgguaccaggugcaagguucuaaauccuucauuauaauuagauauagggucuaugccggacacgaacucaagguuuuauguuguuaucucuuugagaaaaauccugggaacuucauacauuguugguguuaguaccuuaucaguuaauugggcuuuuuugaaaugcugauuaucuguuuacccaggccaacuccuuacggaaggggguuggguaaugagcccuuagugucuuguaaauuaagaggucaauuggaguuuguccggccuucccagcuagagagagucuuacuuacaugagaagcaaagcuaggugauuaaagagacaagcaggacaaaauucaaaguaacgaguuagaguaaaaacaagguuaggcguuucaaacugacugagagggaaccagcaaacuuuaaugacuucucagcauuuauaaaacaugccgaaugcuaagaagggaaaugggcaaagcacacagcauaucacauacuaccagaagcugccuccucuguuugauuucauaucacccugugcuuaucccauuguagccguuggauguuacauagucugaugacuguggucaugagaccauaucauagaggcauguuugucuucugcuucuaaacuguuagauccuugaggauagaaacuguggcugaaggugaauaucuagcaccuuggaaguuccugguccauaaaauggccaagaaaagagaacgauuguuauacauguaauagccacuccaaagacauuugucaaacaaaugaaugcaaaaggaauaacagcugcugugucuccuggugcugguuucugccuaccuccuuccaaguauuguccagauccccagccuuagacuugugaugcuguccaaaaacggguuuuagagaauauuuaaaggacagagagaggaccccugacuuuuuaggguuuccauuuuaacaugaagcagccucucuggugucccagucuugcauguagaaaggaaggagauguguuccaugugaguagccaagggagaccuaucaaacagcuguuugucauggacauggaauuucugauucuggggcuucuguuuagauucuggcuuacucccugcucagguaaagaacugcaaaaauauuaacuccuuaugcgucaguuugauuaagcagaauuuuuuuuuuuuugagacggaaucuugcuguguugcccaggcuggagugcaguggcgugaacucagcucacuguaagcuccgccuccuggguucacgccccauucuccugccucauccuguaguugcugggacuacaggcaccugccaccacgcccuccuaaucuuuuuguauuuuuuuuuuaguagagaugggguuucaccauguuagccaggauggucucgauuuccugaccucgugauccaccugccucggacucccaaaagugcugggauuacaggcaugagccaccaugccuggcccugauuaagcacauuuaaguuugagguaacagcacgucucccuucauuggaucacucgguaacuggaaaacauaccuauucuuguaaugacacaaaugaaguggagaagcuauuuaaauugggaacacauccaauguuuuauuacauuugaauugcagggucgguauucuucagugcccuucauuuuucuuccagcacuuuaauguaauuaaaaggccagccuagaagguuuuuacacucgcaacucuucuauuuuaucuucucagaguuuccaaauguuaugcguuugaauuguagccauuccaguaguccccguucucuuugggguauauguuccaggacccacagugagugccugaaaccacagauaguauggaacccaauuaccauccaucggaacacguuucuguucgugccuuccacccacaaauguaauacuuuuccuauuuuuuuuuuuuuuuuuuuuuuuuuuuuuuuuuuuuuugagagagagagaccgagacagggucuugcuuuguugcccaggaugggcucgaacuucuggcuucaagcgauccucucaccucggacucccaaagugcugguaucacagaugugaaccauggcaccuggcccugccuuuuccaucuuagcacuucucacauacuguggccuuaauuuuugcaguuugaaaugccacagcaaaacuagcacaauuucuuuucuuuacaguugcacagguagaagauucauucuuacuguagaucuuaaccucagcauaagauugguuuuuuccuuauuaguugagaacuuucaccuuuucacuuaaaggauuuuacagcuucucuuuggcuguaaaauugccagcaucacuacucucaugcuuuggggcuauuauuaagucaaagaagggugacuugaaccacaagcacugcaguacugcaauccucaauccuguuaaccuggacagcgacuagaugacuaacaggcggggagcaucugcaacguggacacgcuagacaaagggaugauucacaucccggacaguggagcaggacagcaugcaauuuaaaacuuaugcuuauuucuggauuuuuccauuucauauuuucagaaugcuguugaccucggguuacaaacugcagaaagcaaaacuguggcuacgggaggacugcuguaguuuuauaaagugaaugguagcauugaugcauuuuugugaauaguacugcuuuagaggucacauuucuaaugagcuuguuuguguauaccugcguuuuuuauguucuagugauguuggaauuugguaacauuguaaucacaugugucuagagaaucugaacucaaaauuggugacccuucaggggggaauaaagccauuuaaugugaacugcuaagagccaagggagccuugauucuggaaccuagagcuaggcugcacagccuaguuccuugcacagcccagcacucuccagacuguacagacaguagagucugucucuacucuagcagagaaagaccauuuucuuuccauauccuugauguuacuggagaaaaacccaggcuuccccuguuaccggccaccucaggaucauucggaucaugccccauucuuuaccuacuugcagcucucaguaguucuggggacaagguaacugcugaguacuuuucuccaaaucaugugccaagaaccauaaagucaggggcaucuagccaagaggcaacaauuuaucaaugaaagugcauuauaaauauauuuauuuuguaauaauugcuacaaauugaaaguggaauuggacauagagucucuguagauugaaaguaaaaucuucuggaauacuuuccugccuaaacucagucuuuaaauuagauauauuuuuagcuucuugaauaugacguuaaaauauuaauauuccuagccuagaagauuauauuuaguccuuucugaaacccuuucuuauauagaugaacauuuuguaucugaauggaaguuuauauaaauaauugcuaauauggccauauugcuaucuguguccaaaauagacucugcuguuuugaaauccuugaggauuucagaaaguauacauuugcuuguucuaauauuaucuuguauuauuucagaaauccugccagaaaccuguagacaaauauaucgaguaugauccuguuaucaucuugauuaaugcuauauugugcaaagcucaggccuacagacauauucuuuucaauacucaaauaaauguaaguugugauaauuucauuuuuuaauuuuauuugaugcuguuacauuuuaaaagaauaauaagaauuuuaaacagaaguaaagaauauuauaaaagaggaaaagaaauucuaaugugagagugggucuuuuauugcaacauaucuggaaguuucuagaaauaauagauguugauuuugaaaggugcacaaugcuuagugaguguuuaagaauauggucacuggcaggaaacugacaagccaugaucugaauuaccugcuaguaaauugaaacaaucaucacugguuuuuaacagaauacaauuagacauauccagguagggagagaauuauaccuaaaugaguuaagcaaacauuaaaagaaaaauguuuuuuuaaaacauaauuuauugcauuuuauacuuugcuauuaaaggaauguauaagguaaauaacauucaguuuaaucaaaguccugauuuauaaaguugaauuuuucaaaauaaacuuuuaguuuauugaauugugagcucuuuaauaguuuggguagaguugacagauaacauacaggacagucaauuaaauuugaauuucauauauaccaugaauuaauuuuuuaguauaagaaugucccaaauauugcauggaacauacuuauacaauaaaaauggauucauggugugugugaaacucaaauuuaacuggcgguccuguuauuuuauuuauuuauuuauuuuugagacggagucuugcucugucacccaggcugaagugcaguggcgugaucucggcucacugcagccucuaccuccuggguucaaguguucuacugccucagccucccaaguagcugggauuacaggcacgcaucaccaagcccagcuaauuuuuguauuucuaguagagaugagguucgccauguugaccaggcuagucuggaauuccugaccucaagugauccucccaccucagccucccaaaguauugggauuacaggcaugagcuacugugcccagcucuuccucacuuuauauugauggagaaaguucaaccugaaggaggaauacauagaaaaaagccaauuuuuguugccuaguauuuuuuauuuuagccaaaauuucagacuuuuaagaauuagguuuuaauuguucucuuuuaacauauugagucauacucauccagcuggagauauuuuuaaaaaacugauguucagacuaauaguuucuuauucaauaucauggaaucuucagauuaagucuauucucuuauugcuguucccacauauacaugaaucacauaaguuuuuugcuugauucuguauaaaggacagaaaucaaaaauguauaaugaaaggugaacuauuauuuaaagcagugauucuuaacuaggggugcacauuagaauccccccagaacuguuucaaaguaugaugucuauguuguacuaugaagauucucaaucaggaccugggcucagacauuuaaauuuugaaaaaaaucuccccaugugcuucugauggacauugcugauuaaaacucacugauuacaaaaugacuacaauuagccacuuaauugggcaguccugaauuugaaaagugacuaggugggaugccacaaauacucuguaccuguugauacuagugcaacuggguuuccuuaccuaauugaauggcaaugucuuugacuaucagauccauggaaaacucugcauauuuuguuugcuuugugaagcauaccugaggugguggcagcuucaagauuccaaccagaauacugccccugaugacuugaucagauaugcuaaggaaugggauuucuauagaauguuugcgauugcugcuuuagguaaggagaugccaugcuuuccauucuuaguuaacuauucuuacuuaacuaaucugguuaaaacuaagacauguagucuuaauuguugguaagaagagcuaguuaauaugggacuuaagaugaaauuuucagcucuaccacuacuaaccuacgaggugaguguguuugaaucaccugcuuuuuaaaaauuuguuaccacguauaugguauggaaguaguuaugcuuaucggauuagaaaguuucauaaaauauuucgaagcacaauauuguugauaaaauucuuuuauuuuuauuauuauauauuuuuuaagacagggucucacucuguugccuaggcuggagugcaguggcacagucacagcucacugcagcccugaacuccugggcucaagcaauccuccugccucggcccccccagguagcuggaaccacagguaugcaccaccacaccaugcaccaccuccagcuaauuuuuguauuuuuuuguugagauggggggucuuuccguguugcccaggcuggucuugaacuccugaacucaagcaguccucccaccucagccucccaaagugcugggauuacaggugugagccacugugccuggccaauaaaauucuuaauguuuaaguuuugauuauccaaucugaaaguuagcuaaguccuaucuuuauuaauagagauaauugccagacauuacccaauguauuguacuaauugcauuauacuaaugcaguguauuuaauaggguuugguauuuuuuguuacuuguuacuuaucugagugcaugcagggaauuuggcuacuccucaaaauuccuuaaguucaggaagugcuuuucagaauuucacuucauaaguuauuguuuuccuagugucagaauuguguugagcuaauuucugugacuauuuuauugcuaguuccaugcuucucugcuucucaacucuuugauuauaaugaaaucuuacuuuaguaauacuaagucuccaguccacuccaauaucacauuucugggcugugugucuucuuuuguccucuuuuuuucucugucugcucucgcucucuuggucauguaaccugucugcugagaacucucaaauguccaucuagaccuuucuccagaccuccagacucugcaucccucugccuucucaacaucaccacuuggauaucuaauaaaucaccauacccauaauugagcuccucaucucucugccucuaccacagccuucuccuucucaguuguaacuccauucuuuuaguugcauucaccagaaaaccuugcagucaucccugaugccucuuucuuugauaccccauagucaggucaucaggaaaucccauuggcuccaccuucaaaguacuucuacuuuuuuuuuuuuuuuuuugagacggagucucacucugucgcccaggcuggagugcaguggcgcggucuugacucacugcaaccucugccuccuggguucaagcaguucuccugccuuagccucccgaguagcugggauuacaggcacgugccaccaugcuuagcuaauuuuuguauuuuuaguagagacggcuucaccauguuggucaggcuggucucgaacuucugaccucgugauccguccgccucugccucccaaagugcugggauuacaggcaugagccacugcgcccagccacacuucuacuauuauacuacugcuacccuccauucccuccacggcugccacacuguugcaggccacucucauccuucaccugcaugacuacaguagccuccuuguuugcuagcccaguucuccaacuguguauuugcacgcaacacagaguaguccuuuucaaccaaaucagaucaugucacuguugugcuagaacacaguagcuccccguuucacucagagugcaagcugaagucuuuacagugggccuuguacuggaaucugccccucccacugcgucucucauuuuauccacagcugucaucucccaugucuacucugacccuccccaucuaguuaacuugcuucagaaacacuggaugagcuuccaccuuaaggccuuugaaguggcucuuccugugcccggaaugccugucccccugaugcccagaugucugacuccugcauaccccucaagaguuggcuaaaaugacacuuucuaaaugaaguguaccucugacacuccugaucuccuguuccggcucuacuuuguuuuucuuaugguacuuacuauuuaacauaucacagaaguuauuaucuuuuguuagugccuuuccccacuaacaugucaacugaaugaggucagggcucuuuguguuagucacgguuguagcucaagcacuuaggugccuggcccaggugcuuaauaaauauuugcucagcugauugaaugaaugauugcauacauucauccacgcacucuuaacuugagcaagucaccaucaguuacacucggugauuauucauucacuauucauuauuauucauucccuuaagaaauauuuuuaaauacuuauuaggugccaguuacuacuuuagguacuuuagguacuagagauauauccauggaaaauacauagaaaaaucuccgccuccauuauuauguaauuacuaaggcuuaugacagcuuaaccgccaugauguccagucuaucgauaauuuuguauacaauuuggacuuugcaacaauuuaaaauauuugaaauauacaaaagaauauguuaaccuuuuuaucuuaugaaacauaauacuacugaaaacauccuugagcacaucaucuagcccaagaacuagaaccuaauaugauuuuaaaccuuaaagcaaagccucuuaaaaauuuuuuuuaauuuuuauuuuuuuaagagugaaggucuugcucugucaccgaggcuagggugcaguggcacagucauagcucacugcagccuggagcuccugggcucaagggaucccccugccuccgucuccugaguagcuggaacuacagguacaugcuacugugccuggcuaauuuaaaaaaaaaaauuuauguaaaggcaguaucuuacucuguuguccagguuggucuugaacuccugggcucaaacaguccucccauaugggccucccaaagugcugagacugcaggcaucagccacuguuccuggcccuucuuaaaauuucuaaagauaaacuguuauauguccauauuuuguauauacuauuaaaaaccaggcuuguuuuuaaauggguuggaauucuuauagcaacuacucuguaguagauauuuugaugcuuaaucagaaguuucuuucuacuauuacuuaacuuuuuuaugugucuuagucuaaucccuaauuagacuguauaguccaaaagaauaucuuggccgggcgugguaccucacaccuguaaucccagcacuuugggaggccaagacagguggauuacuugagcucggaaguuggaaaccagccugggcaacauggcaauauucugucucuacaaaaaauacaaaaauuagcugggcaugguggcaugugccuguaguccuagcuacuugaggggcagagacaggaggaucgcuugagcccaggaggucaaagcugcagugagucauguucaugccacugcacuuuugccuggaugaccaagacagacucugucucaaaaaacuaaaagaauaucuuacauaaauaaagcauuuuauaauuuaaaaacugcuuuuacaggaauuauuuaauuuucacaaucauccucugagguagguagguuagggguucccccaucuauagcugcagaaacauagaugcauagauuuucccgaagucucacagugggucacuagugcugaaacugaggaaagucucccgacccccuucaguguuuuccacacuggaguauucuauacguagguagcagcuccuucugaacugaccugauugaugagagccugagggcugguguaguuccauaaaucucguaaauccuaaauuuaaaagauguggagguuaucuagucuagccuguguggcgcaagaaaucuuucugucuagacuccugagagaugcuguagcuuugagugucuccagugacaggagucaacccaccauuguuagaugguucuuguuauucgcuauucuuucacuauuuauucauucaaggaauuauuuauuguuauuuuuauccaaaauccaagcuuuacaaucuaccugaguacauucuuguagcugacaagucuuuuaguuauuuugaagggagauagcaugucucccuugaagaauacaucauauuucauggagguuaaccauccuaauuuuuuuuuuuuuuuuuuugagacggagucucgcucugucgcccagacuggagugcaguggcacaaucucggcucacugcaagcuccgccucccggguucacgccauucuccugcgucagccucccgaguagcugggacuacaggcgccugccaccacucccggcuaauuguuuuuuguauuuuuaguagagacgggguuucaccguguuagccaggaugaucucaaucuccugaccuugugauccgccugccucggccucccaaagugcugggauuacaggcaugagccaccaugcccagccccuaaauuauuuuuauugauccuaauuaccuacauuuggaaccucuuuaguuuggcuuuauuaaguuuaaaaaagaggauaguuguuucugcuguaauauaauacauguguccagagaaaccugauucugcagaaaccuaaacugcuaauaacauagcuuauaugggaaaaaauaaaauaagggacuggccacucagaauggauacaguuggguaaucggaugacuaacaauccuaauaaaaauuacagcacaguuaaaagagauguuaaauuccuaguuaauagaagcugaacagauugugcuguguucugaccauaggacacaguggaacuauugcugcuguuaaucuggacucuguccuaugaauacuuucuggaaguguaaggaauugcauuuuaaaauguuguuaaaaugaguaaaggaagucucaguuaacaauauuaaaaaaucauguggauaauaggcacuuaaauaguggaagaaugcacagagaaaaaugucuuccuguguuaucccauucuuacgauaggucccaucuuucagacugaaaagccugcauucuccuguuuuauucuuuggagaucucuuacacugaagauguuuaagcagaaucuuacuuccuucaaggaacuucagaaaguugaugauuacaauucuaauggaguuacuuuuucuucaguggauaauguuucugaaauuauaccagcaggaucuaauacaaaagccagggguuuauuuaaaaaaaaaaaacaacacacaaacaaaaagaagaagaaaaagagauugugaucuugagaaaguauuucuuaugaagucagcugauaagcuguauuuuagaauggugguuuauuuguuuuuaaggggauauauuuuggauggggacauucauacuuuuauuuuccauuucuucuuuagaacaaacugccuauuuuauuggcauuuuuaccuuccuguggguagaacggcccaugacggcaaaaaaaaagcccaacuucauuuugcugcugaaagcauuauuauuaucuagcuacggaaaacucuugcugauuccagcugucauuugggaacaugacuacacaucugugugccucaaacucauuaaaguauuuguucuuacaucaaauuuucaggcaauuagagguauguuuauguguuuauucugccuucucaguuuucaacccauaaaaagcuuaaagccuuguuucuggggugcaguuuuuauauaaccuguugaacacuggaauucuucaucgcauaguaauaauaccuaacacuucuauagcaccuuauacauagcagguacucaguguuuguuacauuuaaccauauaguacuuuauaguuuucaaaaugcucucauaugcaucaucucuguccugugagguuaguagaacugccauuauuugauuuuaugaaugagcuccuggggcucugaggguuaaguggcuuguccgacguuacauggcugggcaguuaucaagucaggagagaaugcugaguaucugccucucaauccaggacaauuucuacuauaucaggaagagcagcccugugugucuucauuuuucccauauauuuuacauagugcuauuuuauuuauuuuuauuuuauuuauuuuuuugagauagggugucacuuggucacccaggcuagagugcagugaugugaucagaacucacuacagccucuacuuccugaggucaagugauccucccaacucagccuccugaaaagcuggccacagguauaugccaccacacccugcuaaauuuuuguagagacaggguuucgacauguugccagccuggucuugaacuccugggcucgagcagucuguccaccuuggcaucccaaagugcugggaacaagcaugagccgcugugccuggccgaaguccuauuuuaaaugaacuuauuaccugauacuuuuuaucagaaugcuugucaucuugcaaacugugacacugaaaguaucauuuuguuguuguugucguuauucucuuauagcguuagaauuuuuuguuuucuccuuugauauucacgggaaucugccgcuugauaugaggagaaggggcucaguguuuuguuguaaguagaggcuuugguucucuaaaaauguguagauggaaaagugggagaagguaacagcauagauuaauaagaacaaacauugauuuuuccaaaaacagcuuuacaaaacaauucauacuacccgaaaauuuacaugucaauaucguuucauuaauucugaacuuauuggcugccuucuccuuuccagugacccuaaacaucaaccguaagcucuccuucuuggccguguugaguggcuuacugcuggaaagcaucauggucuacuucuuccagaguauggaaugggauguuggaagugauuaugccaucuuuaaaucucaggacuucugaagagguacugaaagcauguaguguucaugcauucagacauguagccuucucaaauaagacagaugucauuguaaaagaagucggugcccuuacauaacccauucucuagcgucuaacugccucuaggucacccucaucuuccucaaggacuuuacuacauggcccccaggggucuucacuuuaguuccuuuugucacccucugggacaucaacauccauguuuuuguugcuucuaggguccuauccucacaauuuuucuaacaccuccacucccacccauucuacuaggauugcagacucuaaaacugucuccuacccuucccaaccauucuccacccucccuucccccaugccagguuuuugcugccuuucucaccucuuagucucuugaccucucauuuucgcuacuucugaccugccuugccucuuuuuuaaccacaccuggaaccuauaggcuguguugugcucuucucuguuaguaccuugacauccaucagccuuuugccuuccaucauacgugcuuugcuaaggcuguuugggugagucuugccaccugucuccuagagagccucgcaguguuuccugagcagccaccucugccagugcacagaaccucagaagaugucaugcugcuccugugccuucauagucaccuccagugacccucccaucagagggccauaccucgauuguucuguucuggucguccccuuugucugcucugacuuugcugagaauugagaccuucacaaguuccuuaagcuucccucuucacgucaguucgucuucggucuuccucauucuuuccuccuucucuccuuccuaucucauguugugcucagcuuccucucuggggcuguuucugaccuguggguguuccccucccuccagucacagccagacuguggauggcagccucuguguuaggaagcaggaccuuaggcaggauccuggaaggcugggccagagagugaggaaaacacuggagcagagggacacagacccccgucagggagaguugaggcugcgcuuuggucucucccuccucgcuguuacauccuccuugcaaguagcggcuguaaagcuucucugccucuccuaacaugccauccuccacuccuguugccucaaucucucuucaugcccagcuaauccaccuuuuugggucuucagacauaucgcugcuucauugauccucucuccuguauagcagcucucuccccucugccuaugcacagcucuucauuccagaacaguugauguaagccugcuuccccuguuucuucacugccuuuccucuuuguaaaacauacuuucacccagagucucuugaaccuaugcuccuaaaauucacaaggagagcagggcacaguggcucauuucuguaaucccagcacuuugggaggccgagucaggaagauggcuugagcccaggagaucaagaccagccugggcaacauagugagaccccaucuuuacaggaaaaaaaaaaaaaacaauagcugggcaugguggcguacaccuguacucccaacuacucaggaagcugagguaggaugauugcuugagcccaugaaguuaaggcugcagugagcugugauugugccacugcacuccagccugggugacagaacaagauccugucucaaaaacaaaaaaauacacaaggaagccaauuccuccuuguuuucugaguccuccuccucccuuagcucugcuccagaaaccucuggcuuuuggcuccugcugaaacaggccacccagucccuucccauuagaucuuucuucacugacuucuuugccugugccaggauucuguccucagcccucuuccuucccuucacugugcacguaacuguguacuuuccuuccaggccucauaccuccagcuuccccucucugccagguccccugccuccuaccaggacgguccugccauuaccucaaguguccacaggucugauguggaauucggugucaccugcacucuccuguugaagcagaguccuuuucugauaacguuucucuugaaaugcuccucagcucuuuucacccacaccucacccucuccugccuaaagguucuaacaccuccaaaccagccugcaacccauacugcugccauguaagucuucauggagcaccauuccugggggccuucucaauuuuuccauaauuucugauugcugacauaggaguuucuugugucuuucugaagaaugucuuuaguuuucucugagcauuaguguggcccucuguaaugucaucauccuaauucuucuccccaggcauguuccuacuuaaguuccacauccaccacagguccucucuucuccaaacuugccuuaugcucuccuuagguccugcagugcccuugucuccaccuaaccagauacggucagcuuugccucuccauggaauaagugaagacuuuccaaaaacuccaguuugcagugcuuacuuuuuccguugaccuccgagugcucagcuuaacaccuacagcagucacgugcccaagaacuucugacauugccccagggucagaucuuuuguuucuacuuuucauaagugcaucugcuugucugacaaucaauuauaauuuauaguuaggaaaauaaggucacauaucuugaaucacuugaaagccauuacccuguuuuuuauuaucucauguuuuauacuuaucuaugucugucugguauuaaaauuucauguguuuaugccucacucucccagccuguucagaagucuggugcugggagaggcaugccuuggguuccuuuguauccaccuuaacucagggccugcccuagugucugucaguuugauuuucagcagaauguggcauucuaaauacauccuuuauuuuucacaguuuuauucuucuucacuaucuguggcaugaccagcuguaucugaaagagaaaagacaugaaauauaaaccaaccuccucauuucuguugaguaaaaugaagcaaagauuggaaacacuuucugaaaaagaaagcaaugauaauagcgguggauacccacccccacaaaugcacccaagagacaagccauuuacauacagauauucacagucacacauagaaacacccacauggacacaaggaauguugcugcagagacugaaugacaugcaacaggugaagguuuauacguuauacacaaggccagguaagcgcucauaauucacacauaauaaaacaucuagguuucauuccuuugacauguuuauaucuuuuuaauuuaaauguuguuacuggcuuaaaauauuuuguguucuuacaauagaaacgcuuuuaauaaagucuuucagaauaaaccaaguuuuuguaaauuuucaauucaauaauuaagguaaucuuuaaaauuggaugauccaaaaauaagugauaaugaaaaccacugaguuauauacuuugcaaggguaaauuacaucugaauaaagcuguaauuaaaaacaa

SEQ ID NO: 192004 - RNA, 117532 nt, Homo sapiens
guauucugaggauguuguuugcuuugggcuaagaaaagaaaaaauacaacuacagacaaagccuuuauaucugcaaguauuauggcguggucgguagcaauguaauuagauuuacaucagucuuccuggugagacuuggaggcucuuccucgguagacaugagugacccaaggcagucacaagaagagaagcacaagcuaggcagagccucuucaaaguucaaggaucccccuagaaucaugcagucagaugauuauuuugcucggaaauuuaaagccauuaauggcaacaugggacccacuacuucuuuaaaugccucgaauuccaaugagacuggcgguggugguccggcuaaugguaccccagcugugcccaagaugggugugagagcaagggugucugaauggccuccuaaaaaggacuguuccaaggagcuaacaugcaaggcacugugggaaagccggucucagaccaguuaugaaagcaucacuucuguccugcagaaugggcagagugaccagagugaaggucagcaagaugaacagcucgaucuggacuucguggaggccaaguacacaaucggagacaucuuuguccauuccccccaaagaggacuucaccccauaagacagaggagcaauagugaugucacuaucagugacauugaugccgaagaugucuuagaccaaaaugcagucaaccccaacaccggggcugcccugcacagggaguauggaaguacuucauccaucgacaggcaaggcuuaucuggugaaaacuuuuuugcuaugcucagaggguaccgaguagaaaauuaugaccacaaagcaauggucccuuuuggguucccugaauuuuuccgcugugacccugcaaucucuccgagccuucaugcagcagcacagauuucuaggggagaauuuguccgcaucucaggauuagauuauguggacagugcccuccugauggggagagacagggacaagccuuucaaacggagguugaaaucagagucgguggaaacaucucucuuccgaaagcuucgaacuguuaaaagugagcacgaaacuuucaaguucacgucugagcuggaggagagccgacuggagaggggcauucgcccuuggaauugucagcgauguuuugcacauuaugauguccagagcauuuuguuuaauaucaacgaagccauggcuacgagggcuaauguggggaaaaggaaaaacauaaccacuggggcaucugcagcaucccagacucagaugccuacgggccagacaggcaacugugaguccccuuuagggagcaaggaggaccucaacuccaaagagaaccuggaugccgaugagggugaugggaaaaguaacgaccucguccuuaguuguccuuacuuuagaaaugagacuggaggggaaggcgacaggcggauugcgcucucucgagccaacucauccucuuucaguucuggggaaagcugcucuuucgaaucgucacucagcucucacugcacaaaugcaggugucuccgucuuggaagugcccagagaaaaccagccuauucacagggagaaagugaagcgcuacaucauagaacacauugaccuuggggccuauuauuaccgcaaauucuucuaugggaaagguaaggaagagccaugggcguuugcaugugucucgggaguaguuuuuuaagaaccagucacaauguuuugcuuuguguuggagcaccuuccucagaguguccaaggccauaguccacugggccugaccuuguucuccaucauggucccuccauagcuuccaggcuaauuuuuucuuuagaaaacugcaauuccaugccuuuguuuauggguaguccuuaauguguaaaugcccuuuugguuucucuuucugucauucuuugucugccaauuugugaucaucacaaauucagacuugauuuagauuucaucccuuguaagaagucuucccugauuaauucuguccuccuccuauuccucugaauaaucucuuaugcugcuuacaguggaaaauucuguguuucccucaccucucuaaucuuucuguacuuugcuucuccagcauugcuguauguguuggacauguuaaaucuuuguugaaagaaugccugaauuaccacaacagacaaauuuuguuuucauguaguucuauagaugggcuuaaauguuaagacacaagugauaaauuauuuaauucuaugucaaauaaaugguuuuugcuuuacguauaucuucaggcuugaaggaugcauucuucagaggucauguaguugaauccucaaccuuuaaauaagugucccuaauuaucccagggcuaggagaaucuucucugauuuaaagaccuacagagaaacagguuccacaugugucaguaacacaugccgaggaaaacacuccggcaccucucaccaccuucuuauugggugcagcugguguccuucacgccuucauuauagugcagcuuacuuuucagagcuauauuuuucugucuucaguuucacccgucagcccucuuccugcucccagggauccagggauaaccucacagagugccugaggaggcagagggugggccccgcuacucuccuccuccuuuuucucagugcauaaacuauucugcuucuagcacagauagcugggagcucacuguacuuuuauuuauuuauuuuuuuuuuuacuuuaaguucugggauacauguucugaacaugcagguuuuuuacauaguuauacuugugcuauggugguuugcugcaccugucaacccaucaucuggguuuuaagcccugaaugcauuagguguuuguccuaaagcucucccuccugcuuaugagugagaacaugcagcguuugguuuucuguuccuguguuaguuugcugagaaugaugguuuccagcuucauccaugucccugcaaaggacaugagcucauucuuuuuuauggcuacauaguauccaugguguauauguaugguaguuucuuuaucuagucuaucauugaugggcauugggguugguuccaagucuuugguauuguaaauagugcugcaauaaacauaugugugcaugugccuuuauaguagaaugauuuauaauccuuuggguauauacccaguaaugacauugcugggucaaaugguauuucugguucuagauccuugaggaaucgccacacugucuuccacaauagcugaacuaauuuacacucccaccaacaguguaaaaauguuccuauuuguccacauccucuccagcaucuguuguuuccugacuuuaaugaucgccauucuaauuggcgugagaugguaucucauugagguuuugauuugcauuucuuuaaugaccagugaugaugagcuuuuuucauauguuuguuggccgcauaaaugucuucuuuugagaagugucuguucauauccuuugcccacuuuuugaugggguuguuuuguucuuguaaauuuguuucaguuccuuguagauucuggauauuagcccuuugucagauggacagauugcaaaaauuuucucccauucuguagguugccuguugccucugaugauaguuucuuuugcuguguagaagcucuuuaguuuaauuagaucccauuugucauuuuuggcuucuguugucauugcuuuugcuguuuuagucaugaagucuuugcccaugccuauguccugaaugguauugcccagguuuucuucuaggguuuuuaugguuuuagauuuuaauuucaucaguauugguuucugucuugagaauauuuguguaauuuuugacuguaguuuguuuuauuggaguggguuggggaggguggguaacacagaccuuaggaggucacucuguccacuucagucccuuauaacguuaaaccacugugaagccuguuuauuacuuuuucucauggaguauagacuuaaaagaauuugucugccagauaaauugugauuauuaauaauucccccuccuguuuuugcaucaauccagacuuagcaugucuuuuguaaucacauuaugacaacaugaaucagagaaaugaucugaugcaauaaagcuaaauaaacagauauuuacacugcaucuggucacuuagugugaauugucucucuguccucauacugaugacauaauaggacugaaauaguuuugucaacagaucuugguccccuguugugucuccuuuccucuccuccacccugaauuucggucuuggcuucaggugugccucaguguuaacaccauaguuacuuccuuccagccaguggaaucaaagaauccuggaccugcuuuuuugucucugcugugaaaauaacucauaacccucaugcccguguucaugcagagguaucacauuauaucacacugcucaaggaugcucucuagguggaaguuaguuauuuuuggaaagggagauggagagauaggcuuccuaauuaagguuauuuuuauugaugaagccauggcugccaauucuuaauaaaauaaagucuguuggauuuauuaugcccugaaauccccagguaauuagucauucuggcuagcugaguuuuguaaauaguuugugauucagacuuugaaauacuagaacauaaaauuauauauauguucauauuuaugccaaaacuuagugccagcgucucauucauaugcuguugcacaugucugaguguaaguggaaugaaaaacuguuguuuugugcaccccggucaccaccauuugauucauuaauguccccagggucuguuccccgagaugauuuuagguugcuagauucuguuaguuuucuugacugcuacuuguaguuuuucucuugaauucucaacugucacuucuugguaguuuuaaagacuccucugcaagugauuuauuuccuccaccuuuucugaugagcuacuuaguuuuucaagagcauugcaaaugacaucaucaaacugcuuagguuugaaugugaaauaaauaagcuccaaagaagaaucugaguguagacacccugucagugaauuguggguggauguacgcuuaucguuuggcauuuuggugcuguugggcacacucucugguucugagcuuugcaguggauuuauaaacgagucagaaagcagaauucuagacuauagucacgcaucaguuaacaacagggauauggucugagaaauguguuauuaggcaauuucgucauugcgugaacaucauagaguauacuuacacaauccuagauauauaucuuuauucauauauauauauauauuuucauauugaaaaccaaaugucccagcaccauuacugaauaucagacauuuccccuuauucaucugcacugccaauaucaagugccaugcaucagauuucuguauaugcuccaucaugauuuuaugggaccaccgucauguaugugguccauuguugaccgaaauaucccuaugcgguacaugacugugcuuugcaaagcccacaaaaugagggaguggggaggcaauccgugaggucacuuugucuucaguguucugugauucugugcuguggaaggugcuguugugccugcagaugggcucgggcuggggaaggagcggccaccaggagcgagaagaaggccgagccccggcugcucuguucucucuccagcgcagcugugaacuguguccugccuccuccuauauuuagcucuuccccugugguccagugugacuucaaagugaaauugguuacaauggcaucugcuccugcucuugcuggucucuuguugagccauuaaggacuccaggcagaggcagcagcccagauucuuaagugaaaaguacagugagguggaggccuccuauggugugggaguagauucccauucccgcuucagccacuggacacaguugugcaagacccuucugucugcaaacaucaugaguugggugagcuucauuguauuuaaaaacagagggccugggcagacuggcacagauaacgauguuuuugagauagcuuuuuucuuucccuuuuuugcuuuucccuucucucaaggauuuucucuuuggaaacugacuuucagggaucuaucuuucaauacuuuccagagugcuuuuauuuuguucugugcuucaggguucuguguaaaacuucauuuucaagagaauuaacuggcucccaaucauggcaaauguuuaaagugcgauacuuuaauaaugugauuucuucuuuauuggguaguuaaugugaaaugucugcuuuugaugcugagguguauuucugugacacaucaucacugaaaggcuguugaauaacuuugugaaaggauuucugcaggggaguggcaggacacaggaaacugugugacaacaucgcuugcccaggcaaauccaucuguagcuuucagugaaauagcuuuucuuuuuucuugaagacagagucucgcucuguugcccaggcuggcgugcaguggcgcaaucuuggcucacugcaaccucugccucccggguucaagcaauucuccugccucagccucccaaguagcugggauuacagacaugugccaccacgcccggcuaauuuuuguauuuuuaguagagaugggguuucgccguguuggccaggcuggucucgaacgccugucuucaggugauccacccaccucagccucccagagugcugggauuacaggcgugagccaccgcacccagccaaaacagcuuuuuuaaaagcagugaggauaguagcaaguagagugaaugcccaauaagucccuuccuuucacgggcgauaaccaugaagacacauuggugccguuugucacauuacuguuucucugaugggacucauugugaaugugccauuugcugcugcuuugagcuuugcauuugugaaacaggcugugacaaagggucccuuagauagggauucuaguugugcuugaccacggucagucaugugagcaucagugagucugguuuccauuguagcagagcagcaggcuuugccuccuucuggaccugcuuggcacugcacacugccaccaacaguggggccagugcuggaacuguguggcagagcccagacacuguguguugacacgugaggucucccccgcuuggugacgaaauccuuaacuuguuaagaaguugugcaccuaguggguuacucaggaguucuaaaacgguucugugcccuacuuuaugccacccagaccagaauaguucuaggaggcaaagugaguaauauuuggguaaagagagguuaaaaccagaugggaggaugaagcugggccuccguggugacucaggagugaagugaaaaguggcuaaaucauugucugagccuucgggaacguuguuuugcuagagccauucugcuggcacaggagcgcguguuccucugaauguagugggggaaaaugcggaaucagauugacgaaucuauaucuuuuuuucauuuagaauuuuuaaaugguauauaaaugucauaugaugguuaugggaaaauaagaaaauguagaaaagcaagaaauaaagucuccccaaauucaucagcuauaaucaccauuaacauuucgucauuauccuugaaggcuuuucugaugcaaauaaauuuauguaaauggagcuuacuccugcuauuacuguggaacuugcuuuugaugaucacccuuccaugucauuauguauagaacugcaucugcauuuuaagagccauuaucaauuaucguuaucugcacugaaugcaugaggagaugccagguauuuaccagccaugaucugggcagauaaguuaaugacuguguuugcuuuacuugagagagaaacuuaccagcuugauagaagcacaguaauaggggaagaugcauaauuuccuguccccuuguagaugcaauaccucuacaaaacaacuuaccaaauacauuagugaauguccauuuuuguaaagaaaucuuuacuugaaaaaguaauuuaucuuuauaagaguuuaagucagugucccaccaccuuccuacuuggaugugggcugcauuuagugacucacuugcaaaagguaucuuauggaaagacagggacaaauaauuuuacaauggaguagccuggcaaacacuaccucccuaggucaccaaggucaccaucaacagugguaaguccuguggguagcuuguaccccggcuaugaaugacucuucugcaggcuuccucuccaaaucuauaaccccaguacaauuaggggaaaacauuagaaaaauuccaaaugaaggacauucugcaaaaucccugacugguacccaaagcuguccaggucaucaaaagcagggaaagucggagaaaaaaaaaaaaaucacagaccguaagagccuuaggggacaugacaacuaaauggaaugugguacccuggguggaauccuguacagaaaaaggacauuccauuaaaaacuaaggaaaucugaauaaaguauggacauuaguuaauaacauaacaguauugauucguucaucauaacaaauguaccaaaauaauguaagauguuaacaacugggaaacugggagauggguauaagggaacucugcuauuuacagcuuuucuagaaaucuaaaagaauucugaaauaaaaaguuaaaaauuuuacaaauguaagucauaagugcucauauauuuaaaauuaugaucuauuucuuuaagacaagaagaaagaauuuguaaguaguuccuauaaauaacaaagcuuuauguugcuuuauugaacgaccauagaauucuuguaagcagccaacuucacuguuucugguaacugcucucuuaccuagcucuuuguaaacccacccuuuccuccagugcuaauuuuuaucauuaguauuuuaacugaagaauaauauguuguauguaaauccugcuaaaugaacaaauugauucuucuagaauuuguguaauaacccucuuaccucucuugauaccaauuuaaccguuuuuuggcuggggaauuaucuuucugccauuagguaaaaguguccauccauuuuaauuauaguuggaggucaacucuugguaaauagaggucugugaauggcgggcaaaugacaucacuuaaggcagagugcacacugagguucacaucccaacucaauuuggggcaaauccuugaacuacuuugugcccuagucaaucaucuguaaaaugggaugauaauaauacaaauccccccuguaaagggcuuagagcagugcuugucaauagcaugccccccugcuucccaggguuacuuaaauaaauguguaagacuuuucccucuaaaaagaaacuauuguucacaccacugcuacaggcuuuagagggcaauacuuucuuuuagugguucaaagaugaagagagaaacaaguagaaccauauggcagagagggcuggggaaaggugucuggugaaguccaucaccccauuccaaacacacucacuuaagugucacuaaugugacaguuguaggcgggccuacaccuuuacauaucaaaugaacuucacugcugagugaugcauggcugcauuugcuuugaauuucaugccugguagcuguuuuuuccuucugauuuuauacagucauugacgaaaauuaauagggaguuggacacuauuaaauucauacgggugaacagagugccaucuaacaauaguacuauucuaagauacacauuccucccucugaagacauaaucggcugaguucuucaccucucucccuggccaguauugccuccccaaacggaggucccgucaagucccacaggcgcccuuaauggggaggaauugcccagauacacaugagauucagcaccaagggcuguggucgcacgggcuccauguggccgucgguggaaaacaccggggcuuucucucuugcagaggugccguaucuggacagucacaguucccauacaccacaguguugcaggaacccacaaagggcugucuguaugcuauuucaaaaccuacugacucucuggccccaaaaagucuucagucaguuacuggggaagaagaacgaaugcccuauuauuucccugggaaaaggaauaagacuuaauauuucuuuacaguuugacucacauggcguuuaacugacaacacuuguuggcauuuugcugcugguacaguaaguuggaaguaaaggucuuuggagcauuaguucuuaaagaauguagaaacuuaguuuaaacacuuuguauuuguuuagacccaaaauuuauuucacuauuugucccacuuaauuaaaauaaaagcuggacagccaucccguuaucagugggcuccaccucucuucuuugaaguggugaggccuuucauacuuuccuaguguuuucuucuuccuuuugagcaaauacuaaccauacagguuaugaaaagaagccuuuaauaaucugccuuccuuccuucuucagucuuuucauuuuucacucuagcuuuccuugaaaucauguuuuucaagauaccguuuuuaugucaaggauacauuuguugucucaucuuuaaguuguguucacuuuccuguauuaauuaauuuuuguaauuuaaaccuuugcaugaauuuuuuuagccucaagcugcuuuccgugagagaacacuagagccggacugucuggguuugcauccucacugucccaccagauugugacuuugagcgagucacuuaaccuuucugccucaguguuguuuguaagaauaguugugccuccucauaaguagacaggaugaacugaguuuauuuuugugaaagauacuuaauauuauugucuucacuguaaugccuuggauuuuucaagcuuagcaaauaccuugguuaaauuugggucaaaagagcaaaaauuuacaugacaaaaaucuauguuuuucaaaacuuccugguaaauucgguaauuuaauccaggaaacacuaacaaagguguuugauacuucuugagguuguugaguuacuuuuuuuuuuuugucuuucugagauggagucucgcucuguugcccaggcuggagugcaguggcacgaucucggcucacugcaaccucaaccucccagguucaugcacuucucgugccucagccucccgaguagcuggaacuacaggcaugcgccaccaugccuggcuaguucguuuauuuuuaguagagaugggguucgccauguuggccaggcuggucuugagcuccuaaccucaagugauccaccugccucggccuuccaaagugcugggauugcaggugugagccacugcucccggccuguugaauuacucuugugguuuuuuguuguuguuguuguuguuauuuuuuguuuugagauggagucucacuccaucucauaggcuggagugcaguggcacaaucuuggcucacugcaaccucugccuccuggguucaagcgauucuccugccucagccuccugaguagcugggauuacagacaugcaccaccacacucagcuuauuuauuaguauuuuuuagguuuauuguagagacugggccuugcagugaugcccagacugaucucaaacuccuggccucaagcaauccuucuccuucugccucccaaagugcugggauuauaggccggagccacuaugcccugcccucauuuacuuacuuauuguccccuuuucacuuuuuaaaaaauaacucuagaguguucgaaaaaagggaagugauuuaaaauacacauaauuguuuggagagaaaggugaaagaagauacaucauagauaggaauugaaagagcauuuaacugccuauguaacccagaucagcagagaguaggcaauuaaaugaucaacuagugguugagagaacaaagaaccuuuaaaaugcauuuuauggcaaaauagcaagcuagcuucugcugugcauauuaacaaaguaaaggacuggaagguacaggugcacaguuguuuguggccuugguguacuuauaaauggugcuguggucacuggaugcuaacagcuuugauaaauccuguaaggcagagcagugagugaaugucuuuuacguaccuggccucaggaggcccugcagaguugugauccuuaacuggucaauucauuagugaguuaccacuuaaaccucucuucuaagauaucaccguaucuagaaacagcuuuugggcuaggguccaauguaccaccccugcccccauuuuuuuucccugugagcuaaaauuauuauuuauuucuuuacugaacaguuacaaugcaccacagaaaugcacuaaaucucaucuucauuuccugcacugcgaucuuguuagcugauuuuuuuuaucuugcccuguuguauuugcaugauagguggauuuucauucagcuucucaacagucuuuucauaccuucuguucugccaaggaaggauuucauuugauucacccuugaagcaauuuuauggaaaucuucugcccggaauaagaacagacucugggugggugagggucugaaugcacacaacccugggaagccuugcucguuguccucugcccaagaugggaagggccucuugccaugcagauaaacaaggaggucuuuccugaaagggggaugcaggauaucauuugaaaagggcaacuauuucccuccuggugguuaugggagggggcacagucucuguauguccuaaugguauguggagaugcccuuuauaaaagcuaggcagcgucuuacauuauugaauagaagauuuugauuucuuuggaaacacauccagguaaccuacuguauucuuuggugaaaccaaaagcauugugagcccuuagaagaugguuaggaggcauaaaagcugugagucugcaggugugaugcuuguaaacagcaggaacuucaucucuguguucgcaauaagaaaguggaugucugugugagacagaaagaggaaaaugggucugugacauagauuggcaagguaggcaugaagggaauuuuuuuuuuaauucaccugccaucuuugauaaaaaggggaauauacaaauuuuagauucccaaacuuuuaaaaguauaauuuaugauagaaauuacucagugaaguauauacaccacuucuuaaaaaagacuucugugagugcaguguaaccucucaggugauucugggucagcauuuugagauuaaaagugggaaucaccuucaggcugacccaugaacugugccggaguuuugggcucaaaaucaaaauacucgaugaugcaguuuauuuuaugugcgcucuuuuguuuugauuucuuuuuuuugccaguaacaugccugcugucaacuauaauaccccucccaggucaaugaugguguuauauggauuagauacauuaggagccgggaggauucugagguuaagaaagggucuguaacuaacccaagguuaagcacgugauaaguaucaaagcccagauuaggcaaccaguaaguaagcuuuuuauaauuauaacauugcacaguaaauggguuugagacugcugguuaaauaaggcaaauugaaaacauguuaucucuuccccuuccagaauaccaauaaaaaugacagugaaggaauuuaaaaaaugggcauaaugccacaaaguaaaaaagcuccagggagaagcagccgaaggaaggcaggguauaugaaagcagguagaagagcaagaccacuccuaguagauugagagagccggccuccugcgucccccaucauggguggucacgggaagaggguagaggccaucaagaagugagucaggccaugccacagagccaggcacccuuggauaagggcuuaggggagugaaaacagggcugguuacaugcuuuauaaaaggccagauucucucuccucccccuguagccaguuuacuauuugccccucucucaggugggaaauaagauuuauucuggagaaauggaacaacaggcccagcaaagggcaggacuaaggcacuuaacuaaaguggguacuuagugaaagucaacacaaugaggugcucagccccaccccauuauuugggcucaauauuucuagacaggagacuggaggugccuucccugggacacucacuggcccaagaagaagaugcaccugucuuauggcuggacccugccugaccagccuaacaaggcacagcucagagaugcgguagggucagugucagaccacaucaauaugaugaauauuguaauaaagugagucgcacaauguuuuugguuucacggugcauauaaaaguuguuuauacuguagucuacuaugcagauagugcuauaucuaaaagaacaguguacauaucuuaauguaaaugcuucauugcauuagccgggugugguggugggugccuguagucccagcuacucaggaggcugaggcaggagaacgucgugaaccugggaggcagagcuugcagugagccaagauugcgccacugcacuccagcccgggcgacagagcgagacucugucucacaaaaaaaaaaaaaaaaaaaaaaauacuucauugcuaaaaagugcuaacaaucaccgagccuucagcaagucaaccuuucuucugauggaggaucuugccuccacauugauggcuguuggcugaucaggaugguggguguugaagguuagggcggcugugacaauuuauuaaaacaacagugaaguuugccacauugauugaaucuuuuuuaggaaagauuuuuccguaacauacgaugcuauuugauagcauuugacccacaguagaacgucuuucaaaauuggaaacucugccacuguugaaucuaccaaguuuaugcaauauucuaaauucuuuguuguuauuucaacaacguucacagcaucuucaccaggaguggauuccaucaaaagaaaccacuuucuuugcucauccauaaaaagcaacuccucuucuguauaaguuugaucaugagauuauagcaauucaaucagaucuucaggcucaauuucuaauucuaguucucuugcuauuucuaccauaucugcaauacuuccuccagugaacucuugaaucccucagagucauccacgaggguuggagccaccuucuaaauuucuguuaaguuuauauuuuaacauccucucaugaaucauaaacguucuuaauggcaucuggaaugaugaaucccuuccaggcuuccaauuuuaucugcccaaauccaucagaugaaucucuauguauggcggcuauagccuuacaaaauguauuucuuaaauaauaagacuuaaaagccagaaauacucugauucaugggcuacagaaugaaugugguguuagcaggcaugaaaacaacaguaaucuccuuauauauuucugucagagcucuugggugaugagaugcguugucaauaagcaguaauauuuugaaaggaauguuuuuugucucagaacuaguacucaacagugggcuuaaaacagucaguaaaccagggaggcugaggcaggagaauggcgucagcccgggagguggaguuugcagugagccaagaucgugccacuguacuccagccugggcaacagagcgagacuccgucucaaaaaaaaaaaaagucaguaaaccauacuguaaacagaugugcugucaucuaggcuuuguucugcuguuagagcacagggagaguaguuuggcauaauuuuuaagggcccuaggguuuuccaaaugaucaauaagcauuggcuucaacuuaaagccaccagcuguguuagccacuagcaagagucaagccuauccuuugaagcuuugaaacuaggcauugacauccucucucuagcuaugaaaauucuggauggcaucuucuuuuauuagaaggcuguuucaucuguauugaaaguguguuguuuaucguagccacugucaucuguugucuuaccuaaauaacuugcuggcuaacuugguauagcuucacuccaucagcacuugcuacuucaccuugcacuuaccgcguggagauagcuucuuaccuuaaaccucaugaaccagccucugcuagcuuccaguuuuucuucugcaccuuccucaccucugucagccuucauagaauugaagagagauagggccuugcucuggauuaggcuuuugcuuaagggaguguuguaacugcuuuugucuucuauccagaccacucugacuuucuucauaucagcaguaaggcuguuuugcuucuuaaucguguguucucugaaguggcacuuuuacuuucuuucaagaacuuuuucuuugcauucacuacuugguucacuguuugguucaagaggccuagcuuucagccugucucggcuauugacaugccuuccucacuaagcguaaucguuuuuagcuuuucauuuagagugaaacaggugugacucuucuuucauuuuaacucuuaggggccauuguaggguuauuaucuggccuaauuucaauguuacugugucuccagggaaaguagggcaauugaugaguguaauuuuugucucuuuccuauauuauuacccccacggcacuaaaacauuuugaagcaggcuauguuuguauccccaguauuuaucaguuucuggcacacaguugagacauccacuguucaacauuugaauaagugaauuaaaguggauuaaguauauuuggaaggcuaaauaauggacuccagagguguccagguccuaaucccuggaauuuguguacacucccucauggcaaaagagacuuugcaguugugguuaaguuagggaucuugagauagggagauauccuggauuauccaggcgggaccuggcugggaccuaaaugcaaucacagguguccuuauaaggaggaaaacagagggaaauuugacuacagaagagaaaggcaaugugaccacugaaacaagaugcuaggcugcuugcugugaagauggaggaagggccaugagccaagaaacguaacgaauguaggucuagaagcuggagaaggcaaggaaauggauuuuuccucuagagcugcccaggggaaugcagucacuccagaaccuugauuuuugcuuauugaaacugacuucugagcuccagagcugugugcaguaaauggaguuguuuuaagccagaaguuuuuagaaauuuggaaauuuguuacagcgguaggacaugauaggucucuugccauguaaguuccaauagauauauaaguucucaguuuuauaaauacuucaagaaauuguauugcuccggucacugagagaaaugccugcugcagccuccaagaugcuucacacugucuuaucacuuccuggcaugaaaugagcuaccuccuuguuuuuauuucgauauuccugcuugaggucagauauaaccauuacuuuuggacaauaccagaggagucuacuuuuaggucagugauucaagaacaguuuauuacgcaccugucauuuauuaggcacuacaacacuagggccuugggaugcaaaauuggaaggauuuggccuuuuuggaggugaggggaguauuuccaguggaaaugauguuuggauugagucuugaaucaugaguaagaagaaugucaagugaagaaaaguggaagacauuccaggcagagggagcaggauugguuccaugaacgguggagugugcuucccuagaccuuugugagucaggggauuugugagagaagagccuggaggaagcuugggaugauaucacugaggaauguaaaggagaagauggguaaguaguuggaaagauagaagauagacauucauauaaguauaaagacagagacagaaucaagcuggagucuugagaaacacucaugcuguaaggagaggccagaggaggagccaugccagacacccagaaugaaagaccagaaagcaaucucaccuggaagggagaugccauaguaguggaggaguagagggccccagccaagaagugaguggccacuagugucauauagcagacagcucuggcaggaggagaccuggaagauaguugaauuuggcaacaagaccuugaguggagcuauagcauggcagaaaguuugaugcagauugaggauuaaauaguaauuaaggaaacaguaaugagagagaaggaugaugacuugaggaauagguacuguccccacugacaggcugugggggagugaaauggucauggcgucugucugugcagaaggccccgguccauuugcaaggaccacuggcccuuccccccaucgacucugccucccuccaguuuuuaaaacugaagguauauuuuauguacaguaaaauugacuuuucuaaaaugugcacuucugagaguuuugagaaguaaauaugguguuaccauugccacaaucaguguagaauagcuuugugaccucagaacguucucccaugccuccucuguaguuggcccuuugcucucccuuccagccccuggcagccauggcucuguuuucuguccuuguggcaccugcugaguaugagagcaguacacauaugaucauuuuauguugucauguauuagaauuagugauuugauuuucuuaaucuggggcucucuaucuuaccauaaaagguaguuuuauguauuuacuuuuguacucccuacaauaauuugaaauucuuuuggaucuuguuauggggcucaucaaauaccaaauauagaauugaguauuuuugcaaguaacuuuuugaaauguguuauaagaaggaagcuuuugucuuaugacuguuguauuuuugugugcuuuguuaauauuuuucuuaaugcauuuggcuuaugaugcauuuggcccauugagggaaaaacgaaaguuauugucagcaugguuaacuaacugcaacugagaguauuccaaaaugauuuaguuuuaaguuuaaaaaugcauuuuccauuggaucuacugccauggguccaguaaucacuaaugccagcuuaauauagugacaguauacuacuuaguuuaguagucugaaguagacaauuaacuuuuagucuuucauugaauaucuuuuuuuuuuuuuuugccugcuucuggaucagcucuucuuaaaaccagaucuuuguuuauguaugcuuaaugucacuggagcuuuuuauguuuguaauaguuaccuuagccauuaucaguacacaauacagccaugcaucgcuuaagaacagagauauguucugagaaauguauccuuaggcaauuucaucauugugcaaaugcuguagagugugcuuacagaaaccuagaugggauagccuguacgucugugguauugcauauuacuccuaggcuacaaaccugcacagcauguuacuguacugaauacuguaggcaguuguaacacagugguaaguauuuuuguaucuaaacauagaaaagguauaguaaaaauacuguaugaaagaucaaaagugguacaccuguauagggcacuuaccaugaauggagcuugcaggacugacuaaaauccgcucugcgugagucagugauugaguagugaguuaauguaggacauuaugcuacugcagacuuuauaaacacuuuacauuaggcaacacuacguuuauaaaaaaauuuacuuaauaauuaaccuuagcuuacaguaacuuuucuacuuuauaacuuuauuuuuuuaacuuuuuuacucuuuuguaauaacauuuagcuuaaugcacacauuguacaauuguacaaaaaugcuuucuuuguaucuauuauuucucauucuguaagcuuuuuucuacuuaaaagaauuuacuuuucugaacuuuuuuuuggcuuugaguaauauguuggauucccauguaaugacaucuguaacaucacuagacaauaguaguuuuucagccucaugauaaucucaugggaccaccauugguauauguguugcgucgcugaccaaagcagcauuaugcagcauaagggauuuauuacccacuaaaacaaauaggcuaguuuccuuuugugcaagucuaggacuauauaccauaucaauaauucaccuuucaucuuuuuuuuuuuuuuuuugagacggagucuugcucugucacccaggcuggagugcaguggggugaucucggcucgaugcaagcuccaccucccagguucacgccauucuccugccucagccucccgaguagcugggacuauaggcaccugccaccacaccuggcuaauuuuuuuuguauuuuuaguagagccgggauuucaccauguuagccagaauggucucgaucuccuaaccucgugauccgcccgccucggccucccaaagugcugggauuacaggcgugagccaccgugcccggcccccaccuuucaucuuuuaaaauaguuuacuugcugcuucuaccccugacucuaaagggaaauaaugucaguacuaaucccauuugguugcaaacagcaaauagguaaaugauuugccuuuugaaggucuagccaguauucauuaguggcuuuggauaguguguguucugagugauucaggugcuguuuuccuuugcugaucucuuucuguuuucuacuuucucagcaacguuucuuauuccuucagaaaucauuguggcaagcauuggcauaaccaaaagccuuuggaauaccuauagguuuccuucaaguuugcagauguucccuguauuauguuucuuuguagccaaaaccuuaagucagggugaaaaaaaaucgauuuuuugaggcuacaccugggagaauggaccuggcagcaguucauuaagaaauaaaugaauaacaccuggagguuugcguuuaccaccugcucacaugaaugauuggugugauggggcugcuaaaaauagauaaauuuuuaagcugcauuaauaagcauuuggguaauuguucccacuauuuuguguauuggaccauaucuugaauguuguguuaaguucgggucauuucagaggaaacauuuaaaaaguuugaaaguugcaaugagauacuuuggcugcuuuuaacagagcucacagacaagaaaccagcagucuaaagggaguugcucacagagcaguaagcuucaugucauuugaaggguucagaauagaguauuugcuucauaaguagcggcuauuuucuggaauguucuccccauguucccauggcugaaacaaugcccacacauagugauugcacauacgaggaagagacaaaugugaccaucucuuaggaaagauguccuggagggauccguguguuagauggacaguauggccucaggugccacccuuuccauguagauggaccagugauuuuaugugaaagcaaugauuagcugaugacauuuuaaaccaaguuauaggauuuguggauaaaauuugacuuuagaaacuaacugaccuuuuguguauuuucuguugcuaaauugugcccuggacuuuaugaacauuauaagcuuuauaaacauuaugcuguuuuagcgacauuguaaugaaaaggcgaucuuagcuacaccacugaucaccaagauuaaucuggcuggcuuguguggcuacuuaggucaucucuggugcccucauucgguaaaagaugaugacuuucccagacggagggaaacuguuuucaauauugauucuacaaguagccauguuccucuuuugacaguuucuaagaaugacaauaccucuuucugaugaugcuauucacaugaucacaaaauaacaauuuuggguuagggaggcuuuugcuguucaugaacuagugaaaagcagaaugagaggaggaaguaauugaaaaugagauguaggcgugcauccgaacuggaaaccagaagacuugaugaaacagauacaaggaaaucacuguguaugagcuaugugguauuucuucagagauuugauacacaaacugagagauauccauccugcucuuuguuccuuuuucauucuuuugaugccacccucucucuuccauuauagagcaccaaaacuacuuuggaauagaugaaaaccuugguccaguagcagucagcauccggagagagaagguggaagaugccaaggagaaagaaggaucccaguucaacuacaggguggcuuucaggacaagugagguaauggggcugcuugccguaguuauugggcuaaagucuaaaccuccuuugguguuacugcuucaguuuguuuuagauaggguacugaauuuauuuuuuuuuaauguuaaugauugcaacauuuaagauaauuaaaaagggcauugcaguauuuuauucuaaaugaaaaauuuggaaacaugccauggauauuaaguggcuguauuaguucauucucacacuacuauaaagaaccaccugagacuggguaauuuaugaagaaaagguuuaauugacucacaguuccgcaggcuuaacaagaaaccugacugggaggccucaagaaacuuacaaucaugacggaaggugaaguggaagcaagcacaucuuaucaugguggaccaggacagagagagaguaaagggggaagggccacacacuuuuaaaccaucagaucuugugagaacucacucacugucaugagaacagcaaggggaaaauucaaccucugugauccaaucaccccuacgaggccucuucuccaauuugacaugagauuugggcagggacacaaaucuaacccauaucauuuugcccccggccccucccaaauuuuauuuccuucucacauugcaacaauuauuccuucucagcaguccccuagucuuaacucacuccagcauuaacucagaaguccacagaacaaagucucaucugagacaaagcaagucccuuccguugaugagccuguaaaaucaacaacagguuaguuacuuccaagaugcaguggggguacagggauggguaaauguuccuguuccaaaugggagaaauuggccaaaacgaagaggcuacaggccccaugcaaguccaaaacucagcaggacagucauuacuacccacgcuuuguuacauugaggacccagguuagauucuugcuugucuugcuuuuaguggaaagugagauucuuguauaaauuauacaacauguauagcuaaauagguagauauugauuuauauaaagaauuaagucugaagcugggcauggugacacaugccuauugucccagcuacucaggaggcuggggugagagcauggcuugagcucaggaguugaggcuguagggcaguaugguuacaccugugaauaggcccugcacuccagccugggcaauauagcaagacccuaucucuuaaaaaagaaaagaauuagaucuguccagcacuuuagguuuuauccuuuuagcucauuuuaauuagagggauauauauuugggagauauuccagaauauguauuuugguuaacugcuucuagaucagagaaaacacagagcccuuuucuaguuuccagcugcaugaacauguguaccccuguucaucuuaucuaguacguaggugucccagugaccuaggcucuauucuagguauaagugagauaaagccccucuccuaaagugacauauuuuaaguuauagaccuaugcuguucaguucaguagucacuagccacagguggcuacuuaaauuaaauuuaaauacuuaauuuaauuuaaauguuaaauuuaaaauaacugaacaaaauuagaaauccuuuuccuuagugacauuagugauuucgaguguuuaauaguugauguggcuaggggcuccuguauuaguauagauagagaacauuguccucguugcagauaguucuguuguccaguguuauggaacauuaugcaaacguuagguauccuuaugacugccaucaccccagcuccugguguuaguagucuaaggacucuuaccagagucagagagagguuggauuagaaccaguucucuugauuuaugguucugggguuuucucucucaucauauuagaucuuaggcacgugcuccaaauauucauugcauguuucuguggugaauuugaggacaucuaaaaagucaugagacaaaauuuaguggcaauuuucucagcccugaaucacccugcccauggauaccacuggcugcugcuccccuguucagccucgggaauggucauuauggaaaauuaaauguaagauaagaaagggaguggaagaaaagaagauggagagaugggagaaagggaggauggaagaagggugaucauggucagguccaggaucaucaugucugguuuccucucugugugaaccuucucauguggguucagaguuguaggaauguccuaauuuucauagcauugcucugccuugcuucuucucauucuuaggcauacaucugcucauuuccauuccgccuggcuuguuccugaucuuuguauacuguuacuguuuaaagacuccuugaguguugauuuuguuuccuuaaauggaacacugucgccccuuucacuacacucagaaagagccuugcuucucuuuuuccugucuuaaggcagccaaacaguuaggcugugaguagguaauugagaaucaauauuaaccgaagucuuauguuuugucacugcagcuuacaacacugagaggagcaauuuuagaagaugcuauacccucuacugcuaggcaugguaccgcacgaggacuaccucucaaagaaguuuuggaauacgucauuccagagcugagcauucaguguuugcgacaggcuuccaacucacccaaggucucagagcagcugcucaagcuugaugaacaagggguguguauaaugugagauuguauguuugugugugaauuugugucuguuucugaaaguuuuggaguuuucccauccaucuuucuuguaagaucauuuauuuuaaaugccuuagaacauuuucucuuuaguuuuucccaaauauguuuuuauacuaguuuggaaacaugaugccauuauaguauaacacaccuccugcugaguugugauuuuuuuuuguuauuaccaagguuuuggugugucccagcuugcaagagugcaucugauugcaugauuaauagaagucaauaguaguuuuuuuccaggguuuaaaaaucucuuauggcccuuuuccugaaccaacauuuauucuugucuacuauguggaaggcaucaugcugacagaugggugugaacagcaagcguuaggaagauugaagcugacuaagaccuagucccuggccuaugaggacaguaagacuaagagcagaaaggccucuccaaggcagaaucugguaagagaucuuggagagguguaaauguagugaguaccuuggggaaagaagaaauaacaucuggcugggcaacucuccugaagagguggcauuuuaacuaggccuuuggacuuggauagaauucuaagagggagacaugaguaguugcuguuuuaggaacuaugacuaguuucuuuacaaagagaagagagguggugagguggggugggguaggggaaguaagacgagacuagaacaaaugagaccugguaugcuaggccaaggagauugcccuugauucaggaggcaguggggagccauugaagguuuuccauuaggaugugacgugaucagagcuguauuuuaggaagauuauucugguagaagggaauuguacaggccgccgaagauagagacugauggcuauguggagaucaauuaugugauuauugacauuguccaggagagaguuaaugaugaacaggauugagauggugguucagaauauggaaaaaaggucuuuaaguuucaggugcaaaauaacucauagaggaaacugagcaguacaugcucaagugcaugcaacuuauuuuaaaccaguggauuuguuuguaaagccaugauuuuaaaaagacagugacaauguauauuuuuagaauuucccaaguaggauucuucugcauguuuuagagggaauaugagguauuucuugguugaccaaauaauacugugguuaaaguugaauauuuggcaccgcagauggcuagaauucuaaaagugaugaaacuaauuggucuaacaaguuaacacugcauuauuagcaaaaagaagcagauauuguaacacucagaaugaauaaucuugagaucugucucaggaaugaaagcugacauauuaaaaaaaaaaaaccauacucuaaacuugagcaggugacuuuuaaauugcguaauacacagaauagguuuaccauuaugacugguaaaguauguggaauauaugaaauguucaugaaacauauauaugaacaauauaugaaguguucaugaaacaguugaugaaaacauguuauggcgggauagagaggauacaucgggguggguugaaagugcuuaaaguucaggcaggcuugaugagaagaauagcauucauuugcauguuguaagagaguuggugaaaagaacuugccacccaugugguagguaguucuugaucccuuuguaggauaugucaguucucccuuuaaaauauaucacuguacuacagagcaggugccugguggaugaagcucucauuuggucccccgaggcugcucuagaaaguuuuacagaugguucauguuccccagaagcccucagggcucugccacugccaccauuuagggcuucuuuuaccgagcagugaaaagagacaucauggcagcuacaaguugacugauguaaccaucagucucuauccucaucagccuauuuuaggcaucagugaauguggcuaccuuucuucuacuagaagaaucuuccuaaaauauagcucugaucugccacauccuaauggaaaacuuuugauggcccccuauugucuucugaaucaagugcaagcuccuuucgaaugucuuuguagucagauagaucuagaagcuauccgaggcaguucuaaaaaccaggcauuuuaaguauuuuugcugaacaccuauuuacagucugaugucaaugaauguauuuagaaaaugggauucugcuuugauaaaaccacgcauuucguaucucuaguaguaguucaugggcuuuucuuuagauuuuauauuuguuugacuuugguauacuuucuuaacgauguucaaacuuaagcacacugugccauuuuaacucccuaaaacucuuaaugguaucagauucccauuguacaugaggaaaacauacuguuuauguucaucuuuaaaagagauugggcaacuuuuuuaacaucccaguuuccaaagaauccuuacaaaucgccacuaaccuguuagggugguggagaguuuauuccaagcggugcuguuucuuuauucauuuuccuaauaguaaaucuucccaggaagggauggggcaauuuuguuauuggucuaaggguuuguuaaucuugaaauuauauuuaaaauacaaccuaauaaugggcugggcgcgguagcucaugccuguaaucucagcacuuuggaaggccaagguggguggaucauuugaggucaagaguucaagaccagccuggccagcauggugaaaacccaucucuacuaaguauacaaaaauuagccaggugugauggugggcaccuguaaucucagcuacuagggaggcugaggcaggagaaucacuugaaccgggaggcagagguugcagugagccaagaucgcaccacugcacuccagccugggcgacagagugagacucugucucaaaaaaauaugugugcguguguguguguguguguguguguguguguguguguaaccuaauuacauauauuguuaguuuccgcucuuuuguaguuugcaguccauccugguuugucauguaaccacugaguauauguacucuguacaagacacuuuucagaaguaggagauacuguggguguuuagaucauuccuucuguuccuucaguuugguuagauguuuugagaaggaagagucaaacacuguggagaauuuucaggaaaguaauuauuaaacaagacguuuugcuacuuuaucuacauaauuucacgucugcaguucuaaaaucccauuuuuccuuuuuaaaaaggcuaucccaauguauuuaauagguaaacucauaaaauuauagaggaugacuguaaacaaaguguuauuuagacgaauuaugacagcucacuaucuuagaauauuaugaaauccuuaacagaguuauucauugguucuuaaggccaacugccccauuccccucuuguccucucaccccagauauauauguuuacucaaauaucagauuuguuucaaccgaagucaagcaggucuaaauaaaugagauuacaugcuuagaacaaguagucugagucaggagaauggaggggaagggauuuauugcacacucaaagauaugcucgagacaauucugaggcuuuguuuucuucucaccuucauuugaauguaaauuuucuugucaauaauaacaaagcuucuggccuuggaaauagagcagccaguuuuuauccugucucagaaagaaaaugggacguggguuggauccucugcugucugggcaguauguauguguguccagcugucagcacugaagccauagggaauuuugacaaguggauauuuuuaguuugcagcagugcuuauguccaaaugcaagccuaguucuaucccaggacugugggacuggcacagcucuuaucaaacaguuaaauaaagguugcugcaauagacuuaaauguuaggcuuagcuugagauuuaaugaagccuuggucugagagaaugaggaauguuaaguguauggaaucuggagucccuccuuuacuuuauauuaugauggagcugaagaaguauguugcuagccuucugauauaccccgggaguauuuaguugauaccacauuucaguuguuuuccagguuucugaaagagacucuggugagagagauaucuuuacugaacauuucauucuguuucauuauucauuucauucuuguuuuacuggaaucagcccuuguuguaaacaagccacaauucuuuacucugagucacuggagagauuucugucuccuaaguuucaccuggcaaacugaucaaaaguaggcaugacuggcaaauaccugugagugguaaacuugugucacuccauguguguagcaagguguuuucuuuggagccagaguauggcagcuguccuaagacaucugagggccuugaaaucugcuuuagucacauccacugauucccaugggcccaggagcuucuuagauggaaaugcaaauccuguucuagauccuguuaggaucuagacacaggcugguguguccgauggcugggaagagaggggugugaaguugacaguacaacagucagcaaugaggucucaugaaauuucaguuguccaguuguuuggccuuugccugaaugagaguucacaagaaauagcaagcccacaaggcucuccgagucagagaggaagugagccaggcuggugacggcucugcuugacauaccaugcacacccucggcucccaaacagcucuacuccaggacuccucauuuaagagcuggaugggaggagaggaagggguuuccucuugcagaugccagagcagacugaggcaagcugccuuugcgugcuggggcaauggagacaaagauggccuucagaugauguggcacauggcacuggcaauggucucaggugagcaggagguaaaggaauagaggaugggcgaacagggacagcagccaccagagcagagugaccuccgaggaugaggaugauggugcagcaauucuacugggugcagaggaagcaguggacacugagaugcacaggcacuggagugaguuaguauucuucgguauuaacgguggacucuaauuacagccagggccaaauaaccagggagcugaaauccucuucucacagugaaagagaagucaacuaacaucguuguccaugaugggaaguggucauuuucaggccacauuuuaguauucauauagauuccaacaaucacagaugucacgaacaucuguguaauaauuggugaucauaauaguuucucuaaugcacuuuaagacccugaaaugucuucugagucacucaggagcaaauaauguuuacaauaaaaugagguuaggcauuuuuauuguacuuaauauuuuuuugaagaugauugucuauucucaguaaaugugguaucucauugacuuagauaauugaguugaucagaaacauugauuccucaaucucugggugaauacaaauuuuucuucuugacccuacuaaaguaguagcucaauaaauucauaauguuagguauugaguaguguaugcacaccaucucauauccccacacucaagguacagaucauuuuucucgcuaugcaguuggggaucuccuggccuugacagggucccaaggcccaugaacugcaaugccauagcauccaucgguauagguagcugauucagucagauuguaaacaggugauauuuccuuuuauagccuucucauagcacuuagucaagaucggaaugcauucagaauauauggguaguugacucuaccugcucaacucuaaguuuauccagcaugugguaaauguuuccugaugucugcugaggucacccaggcagacguugcaugccuuucuugcauaguauguugucauuagguaauaauauggaugagacugcugucaucacuuugcugcucaagggaaaugaguaucauuuugccuuauuuuacuaagauagcuaugaauuuugauuaaagguucuguuuuacagcuugauaauaaaagugaacaguguuguggauugaugucuuuagagaauuggcgaugucugauaaucugucagccuuucaggcucagauugcugguaguaagauuaagagcucugauugcaugaguuagaagcaguuccucuuugggggacauaagaaaggugugaaaaugccuccaguuucuuacuggccuugggaggaagucccauggcuuccaacaugaaccuggcauugacuguaagauaggauuacagcaggagcuccucaauugcuauuggauucuuugugguacacuguauauuuagcagauguuuucaagauaguaaaaaauguaacaaaugaauguaaucguaagccagaguuacuuuuuuauggcaacaaaacauuuuaauguuuguauacauauaucauaauuuccauuggaauccuacccuuaccagaccuuaauuugauuuguuuuuuccuuauagucuuacauauuuacaagaaauauauaaaauucagauaaagaaauaaaagguauuacuacagagaaaaacuuaaagguuuguagccuuuuuuucuuuccgacuuagaagauuacccuaauuacuauaugaaguguguaagaugaaguauuuccacaguucuauuuuuaaguagauacuugaaccuugacuuccuauccuuuuuggaaaccuggcaaaucccaaauggccacagccauacauuuaauuuguuaggguuucugacaugucuccagcuguauucugggguuucuggguuauuauuuguagcaucuuucacaguggcaguugccuacucuuuugcuuauucacuuaugggaauuguucuggcaugcuuuccuagaacaauucucagcuucuguaguuuuaauuuuacuggaaguuagcuugucugauaugcuuugccaaguaauuauauuucucccccauuucagcugagcuuucagcacaagaucgggauccuuuauugcaaagcaggccagagcacagaggaagagauguauaacaaugagacggcgggaccagcuuuugaagaauuccuugaucuucugggccagagaguccgacugaaaggauuuaguaaauaucgagcucagcuagacaauaagaguaaguuuaauguuugugugugugcacauuuuuaauucuccaaagguaggcaugcuucauaaauccaaguaagugaucacaugcccuccuguucccggccccagaagcagccuagaaagcuuauuuggaauagaguuuagauuuccucagaugaacaaaggaaacacauuucucaagagguaugugcuucaccuuguaagcucaaagggucaauucuuuuuccuuuguaacaccagcagagagauuccccaguguuucaugaagaauuguuuaauauuuucuucuuucuuuuacccuaaccucuucuauuacacccuuguuucaguauaccaaggacaagcacugcauuuauuucuaagagacaaaauauuaacacauccauucaugcuguguuauugggcuuauuuuguucauuuccagauucaugauguuaaccagggagguggaacagugauuaaaaagcgaaugcaucuucacacaauauccccuuauaacagacuugcacauguacccccuggaucuaaaauuaaaaaaaaaaaaaagcugaugcaucuuauuuuucaaggauuuuauuuagauccccuugagugggacaccuacuagcuguacaguggcggauugacugaccaauccaaaacaugggcuuuaugcccuccuaggaugcaugaauuugucuaauaucuacacauagauaaucauguuucucaugaugucuguaaguucuauauauuuuaucuuugugcuguuauuuaguugcuaugaguaucugaaauagcaggcagaguaauuugaugcauauuggaaaauucugcuuauuaucaaacaacuaagugcuugcucuuugaacgaaaagagaugaacagauagucuaaacuuggaggaucugaaggagcuucuugccccaacucccaguaggaauggugaaguggaaguuuucugugugggagcgucaggguguggccgagcugggauuggaacugagguggccugaugccgugucuuccugccuucuauucuccuuggucaccaagcccuguccccaagucugcucaacuugggacugucacugauacuccaucuggaugaggguggugccuauagucaguucuguuuuuagaccuguuuuugaaaguagcaguuacaggauaguucacaagccucugcgaugguguaaacucacacaugggcccccuaguuguccacuacacacgccagggcuggaguuugacuguuacauuauauguauaaugcccaugccucagacauaauucaugguacccaaaauaugaauaucuauauauuuuaagaaagacgaaugagaccuuuucugauuuucuuuuuuuuuuuucaaacuccucuuuucugcaaacaaccauucacccccuagagaugcugauauucuguccuuaaggaugucccuccaggaaaaccacugcugaugugaacucuuauuacugugauuguguguugucucucuucagugaauuggacugagaaaacauuuaaagaauuucugaucugugucaccuguaaaacuacaacguagauaauccaaguauuuuccuacauguagaauucacauuggcuuugcauuuugaugacagaggccuuauccuugauacauugcagauguaguauuaagcaccuuagcucaaggagaugagaacguaacaacuagaguuugauauguugacuuuaauaauaaaucuguaaguuauuuuuaugagcaaggcauucugugagauggcaaggaagucugacauucuuuuaguagagaggagauauguaagaauuagguaugggagaauggucagauaaaaauuaugucuuucgaggaacagacaaaaaucuuccuucuagaauuugggggacuuuaguucugguuagaagacuuaggucaaaucugggccucagauuccucacaaggaaaguucaggauguugggcuagaauaucugggauuucccuuucagcucugaaauggguuuucucucuugaacacaaaaugaaaugggauaggaacauaggggauuugagccacuaaggugcucuguuaacuagagcagaguacagaaucccagccaugaaaagccuuuauugagcuaggugcagagaaugauaaaauugauagccuguaucccuuuuugaauagaaauauuuauagcaaaccccagaacaacaagccuuguuagucuacauucuccauuaccuugcugauguuugacauaaaaacuuucagaauauuuaauuuuagaaauuccucuuuuaguauggcuugagaaagacauauuauuaucacauuuuaagaaguacuuuucccccccgcaaugcaucuuucuuucuuccuugcaauuuccuaaaucugaaaccuaauaucagucagcauuucucuuuccgaauuugaaccacccugacagcaguguugugaugggugucauugaacauaccaggccuucucaucauccagccuuugguuuugucaucagugaguccauuauucauugaaggagcauccauccugcccugagacuguaaacugugcuugcucacauccagagccacguucacugucaagguuccgagccaagagaauuaaaauggaauguuacuuucuaagaaguccuuugaaaauaacauauauguguuuaauaaauaguuaaaaggaauuuuuuuuuggcggggcugauuuauauauaacuuuuuggaugaauauucucuccaucuguaaauuaauuuauugguaacuauauguaaacacuaaguauucgccuuauucaugaaaaugccuuuuaugaaugucuuuuggagcaucuaagaacucuauaggauauuuuuucuaaagaguuuucaggucuguuucugaauuggauaugaauauuagaaagacauacuacaggguucagaaagaauauaauaaguccgugaagguugaauguuuucguguuuuuaaaguaaaaauuuagauuuuuagauuaaaaaaagauuaacuuaaaaugacuacuuagagguuuccccaacaaacacaauggaauaaaugauguuaacaacacuguuucuuguugcuuaaaaaguagagaaauaagacuguauagaucaagaauugacaaagaaauugaauuccauuuacauuuuccuuuuuguauaucuuuuugucuucauuauccaugugcaaaaagucauucagaacuuuacuccaaaauuacuuaacuauuuuauagucagcagguuaguuucaaugugugaaacucaaucugagauacucuuauugauaauacagauggaguuugaauuuacaaagaaucauucuccuuuucaaaagaugaacaguuuuaugauuaauagggguucaaaugucauaguuuuuuaacauauaugucacuggauaauauucuguaagugaucacauucauucuccauauucuucauucaugggauguaucaauguacuuccuguugaaagaaaaaaauuaauuacauucagggaaagacauauucaaaauaacauuuuuuguucucauuuccauauucaaucaauccuauuucauuuuucuggguucuggaagaucaagugccaagaauaacuaagaauuaacuguaaaaacacacacacacacacacacacacacacacacacacacgcacacacacacacagaugcggccaggccaucugccaguuugucacgcccuucagauaauugcacccagaccuggaccagcuucucuucuccacugcucaccugugcacuugguggcaaaaacacuucgcuuucaguggaucaccuaaauccacacugugagggcaagaacagagaagaaaagcgaggaaacuaaaggugcaguagaaagcgguggggaaggaaaggagccucucaguccacaguccuggagcgggagugguagaaacagugcuugaugaaagcuggaugggcagcauccagauacugguuggguagagcuugguguuuuuuguuuuuuguuuuugcaacaguaaccuuuuaaauaucgaagcacuaauuuuguagcagcuuaccuugcuucuguaauucaucuuuguuuucagcugauuccacgggcacgcacucucucuauaccacauacaaagacuacgaacucauguuccacgugucaacccugcuucccuacaugcccaacaacagacaacagguauguccuccccagccuggagcuuuuuacgcugaguaugaaaucugaggugggcccacugaugauauugaugcauguagaacuugcaaagaaucagugaggguuuuucuugaauagcauuaaucaucuuugacucuuugaucauuuggaaguauuugggcuuuaaagggcguauuguugcacuuuuuucguauaaaacuuagaaacucuucugcacucagaucuauugcuugcuaagcaaaaucuuuucucaggagaaacuugucucaacuauauguuaauuacgaaaaggccaaccguguugaccugacuucgguuuuuguguguggguaaauagcuuauuuauagagaauacuguuugcaguuguuacuggugcuauuuucagcuguuccucuccauuucguuuuuguuguuuuaaauggauuuauuggccaaaauuucuugaccuuuuuaaagagaaaaaaaucagagugcaucaugcuuugacuacagccacucaguaagaauuaagaaccuuugaaaacuugaaugaugcauaaaucauuguaaaauaauuuacuuuuugguauaacuuugagucaagcaaguuuuuuuugcaaagauuacuagaaauuauggccauuuuuaucuuacgcuagaaauaguugaaaugcuuugucuacugugagcuugagaagacuuggaggaucacuugagauaggaaaggaccuacguuugggauagacgaucuaugggauagcuaaggcuccauuucacaucuuguuuagaaucuucugggcucugcccauguuaagcugaagauuuuuugaagaauguuacugcuugaguuucugaauauuuguuuacagaaagguuugugaauuacuaggaucuuauaacugauucauugacauaauuuaauuuuagggauuugauuguauuuagguuaaauccagaguuaaaguuuguuuucacauuuaggagacaguucucugaaugucacuuaacugauacuccuuugcucuaaauauauuaaagcaccaaggacuacauaggaauagcucaauagguauuugucaaaugagugaaauuuaauugucacagagaauuuuuccuuuuuaaaaaagacucauaaaaguauauaaauuuagucuaauucugcauuuuuucccaaagaggaaaccagccaacuaccuccccuucucccaucacuaguuggaagaagccccuuagccucagauccuccagcuaggaugagaaagcaggccucugacccccagucucuucucaugguaacugcuagcuggauuuucuugccauuuuccaucucauacuuaucucaaucccuuguccuuucugaauuuucuaguguuuucuaauaaucauaguucuuccuaccaccuucaaaaaaucuaucucuguauuacacaucuguguauuuuuaagcauagacuuaaaaucacuagaucacauguauguauuuauguauauuuuaaccuaagggauuuuagcucucaagaauuuauuugcaauaaugccgagcagauucacuggaucuuaagaggcuuaauuuagaccaggacaguuguccagcaaauacuugugaaucauucaguaauuaaacucugugggaguuguugcucagaaaacugauagggguuacucaagccaagaaaaucugucaguacguuagcagaaauagagccagugacuuuugacccccgucaucgaguauucaaaccacaaagccuuuccaguucccugauuacuugagucauuggacuucaggcugaauuggcccuggcauuucacauguggcaaccuccagagauuugaagucuuugcuuuuaccacaacucaaaacuggcuuucccacccccuuucauugaagcguaaucaaaaucuguaggcauucgaguuuuauguaccugacuucauuucacugaaacuagccuugaaaaaauuguaugcgcaaaaaucaggacagcaaagcagugaaaauguagaugcaacugggggauagaggaggauguguguguguuaaacuuccccaacuggaaaguaaaagaaaagucccuguaaguugaggcuauacauuccaaacucgagaaagcugggauuuguaucuguuuuguucccugaagugucccugugugcccagaacaguauccagaacaugguaagaagucaacaaacauuuguugaaugaauaaugaaugaaugagugaaccuuucuuaggagauagagaauuaggcaaauuaaugcauguaaagcacuuaaaauaguuccaggcauggaacuaaguuuuaguuguuacuguuuuauaauucauuagauauagagccagucauauuuuggaugaccuaauuugcauuuuauuuuccugucuccaguccuaaagaucuauuaugaaaaacuaagacucugaaugguuaagaaagugagagacuaaauuuaucaauuauuucagaaaauuauuuuuugacauuuaauauuuugcaaucacagguugucaucagaauguucuguuuguggauaaauaaugccacuugcaaucuggggacauguguuuuccaaauuuguuaaugaguuguauugacuccauuucucucacccucaccauccaugcccacaaauuauguuaauaccaaagguagaaaugucugaaaugaccagcuggguucaugagugcaauuugaagccacaggacuuagcaaaguuaacuggccccuacaugaauugugccuguaaccuuggcuucuuacacuacaguuggugaccauuuaacugguccagacucguccacaucagaucuaauuucuuguguuccuucuuguaauaaaucaagcuggaugccaauuccaagauguauuaaaagucuucagagaguuuaccacaguugcaaaagagcuuuaaucuuuggaauggucucugacucuugcguagaaaaacucaccagaccaaaagaaugauaagaaacccugcucuuggaguuauuuucucucuucaaaaguuaaguccugcaagucucucugcaucugucuggcaguccauccacuuuuuccagggcugucuuccccugugugcuuuccuucugcuugcccuggagacaagucaugguuaagccaucgugggaugucaucagugggaagagcuucacaaauuagcuuuaaacuucacuuuggcaacgaaauucuuucuucaaaguagucauauaaaguagaggugccucagugccuggcacacaguaaccuauuuuuuaauguaugcguaacauuuuagcugcuguguugggaagggguaccugacgccucguggagguaucuaaugaguaagaccaagccccuagguuucugagaugcuaauuaaaggauacuggucuuccucuaguaaugggcuugacaccaaagagguaaugauguuguauuugggcuaagccuggagcccuuuucuccauaguggauagacugauuguaagcuccugccuuaaagaguuuguguacuuccuuaagucccuaguugguguugcuaaggacucauguaaauacuggaacaaccuaccucacuaagugcgaugagccuuggguccugccuauacuuggguucaccuauacauaauacuauagaauauuuuggaaggauaaaaugcuuacuuagcuuuccaugaguagcuuuauucccagacccuaaguaggagcauauacuuauacuauaucacaaagauuguuacuuagagugaggguugguauugccuagugacagaaagaagaaagagacauuuauaucuucauaauccuguuaucaucuuuacuuuguuaugaagucauuaaagaucugcauucuuagauuauuuuguuucuuccuuugcaaaguguucaauauuucuuaauucguuuguacauuugcucuuguuauugguaaaauaucauaauuauaugaaaugauaaaucagugagaaauccuucaaacauuaauuaaauguaauauccuguucuugcccaucagaaaugagaacaguucacuaacauucacuuuuuugcaggaggugggugagacuuuucuuucuuuuguauuuaugugguaagguguauauguugcccuuccuuaguuauuauuuagaaugcuuuucuacauuaacuuuuuccguaggaaacucuauacgccucuuaaaaaucaaggcauaauucuaacuacuggugcaaacucuugaguauaguuuauaugaggggauauguguguuuauguacaugcauauguauguauaagugcaaaauuagggccaucucccuaaaagaggaaaagccaacccucugggugaaggggaggagcuuuccaggcaagagauuaggaacugcaaaguuccuugggugggaaccaguuguucuguaggagggacaagacgcugucuauaugguaaggagcaggugaugaggucggagagguaggaagggaucagucaugucagaggagucuuugucagcccccuuuuuaguaacaggauuuagauucaaacucaaggaccaggacugagaacuugugugcguuuagagaauauggauuugcuucuuucuaaagaccuucucuggagaccugcagaugaccuuccucuucucugacucuuaugagcuucugaaucauaucccggcuguucucuuucauguuguacagccugcuuucccccagcauugggugcaaaacaguuuguuucugucuuacuggguuuaaaauaauaauuuaacaaaugaacccauauacauagaggcuagcagauacugucuaauucagcuuucauuuuucacccaagugugcugucugauacuuauuuucacuuccuggcuuuuuucuucucaguuugcuuuuugaguuuuuuccucucguuaaaauuuuuuuuuuuacugauauauaauaguuguacauauuuugggguuacacgcuguauuuugauaccugcauacaauguguauugaucacaucagaguaauuggcauaucuguuaccacaaacacuuaucuuuguguugagaacauuucaaauuuuuuugcagcugcuuugaaauacacaauaaauugcugcuaaugacaguuucccuacuguacugucgaauaauuagaacauacuccuucuaucuuacuguauuuuugcacuaaguuaaaacuggucuugugagauacugguuuguuuaaggaacugaggcuaaaccuacggccauauaugguauuucuguagcaucuauaugcuuuugccauggaauugggugaagacucacauuuucucuuuccuugucauaacaagagcuuauuccuguuucacagcuggaaucgaguguuagaaauuuaguagaaaugacuauguaaaucuaucuaauacaauauuuauuaacucacuguugcaguugaagacacuaauaaguugguucucuugacaucacugaaaauugucauuagcuuuacauaccuagaaagaaguucgccccagaagaugucauuccuacaauucccucaaacaaauaguaccgucagguuuugccagccugcguucguuugugguuugccaucccuuuuccccauucacagacucugauuguauagaauuucauugaccaguuagaaaaaagcauaaacuaaauacuaaagaaaacauuugccuuuaagaaguucaagaaauuacuuauuucauguuugacaaaguccuaaaacagaaaaaugaauaauauuucuguuaauuuuccagauauuuucuuuagucucugaagcaaauucaagcauucuauuaauggauaguguucauuuuucuuauuauauucuccuucaaagagcuuuagauuuuacccuuccuaaugaaucuucuuguucccgccuccaaucguuuauuuuuuucuacaaagugcauuauguggccaugguuaaauuaacuagacuuuugaaaacauuuuuuggcccauuuuacaaagcaaaagaaugugucuagaaagggacaacagugguuuggcauguugucaagguaaccagacuuuaacuugugcuuuaacuugugcuuuaaauaguccuguggugaaguauagaaucagacccaucauguuccuucaggaggaaaagaaauuggauaggaauaacugugcaauuugcuguugcagucucaacagccaugaagcacugacuaacaaggcccucccugcacccuguguuuaauggagagggcuggccaacaugaagccacaccggcaaucacucaggaaguaggaggcgcugaacucacugccuggccuuggccaaagugagcuccaucuuuugacagucugagaauuccuguguuucaagggcacugaauaaacuagaguaugaacugcuguguuuuguagucuacagauacauugaacacaaugaugggcauauuuuuaaaaacuauuccugauuuuuccuugucucauuacaaugccuaugaaucauguauuucaauuuuuggagaaaagaguaaagaauguccuugccaaagauaguuuucacugauuauuuacaugcauuugaaauggcacauuuuaaauaucuagcaaacuuuuuaaaaacuacauauuuaaaugagguggcucauugggucuguauuaugauguacuaauguauguuuccagacuucacucagacaguaagaugauuuuuguguguuuauaacuuugaccauggggauuuaaguaggaauuucucagcauaugaaucagcaguuuaacuggccuguagaaaacucugaaagaaugaacauuucauucccacuuuuccaggccuuuuaucaugcuaaaucacaagucagggaccugacaaugaaauccuuuuuguaucugaguuuaaaaggcuuuaaaaguugaacuuaauggucuuuacuuggaauaugcgcuguaggugccaaauaaauuuaaggguaaggucguggucuuucauauugcuaguaaaaagagauuuacuaucugagauugucacauuccagcaaugacaucaccaaguuguguaaggauuguuguauguauuaaaacugaagaucacaaacuuuugagagcacaaaucuaugccuucacuugcauaagcuuaccgagugccuuuauguggauuuauuggcauguguucauaggaaagaaguggucacaauuuuaaugcauaaugugaugugucaguaaguguauauuuggauuauuuauuuguuaaacaaauguguauuggguaccuccuuugccuggcacaccauuagaaacuaggaaacugaaagucaguaugacacuucugugcccucaugaagguuaugaccugaugcagaagaaguaaaccaaccauuaggagacaguacaacaaccaguguaauagaaauaggcccgggaaauaggaaguuucuuucagaugaaaugggaucuacagagacaacugcauugucugggagaaaccuggagggaagggggcauucuuggcagaaggaacaucaaaaguaaaggcguuggucaaguguuacugcucugagcaucauucccccugccagauuugugauuuauaaaauuacaaaugauugggcuucugguuauuaauccaguugaauucuguguuucugaauugcauuuuaaacggccaggguucaguuaauugguuuguauuauugcucaccagaaugacaguguucuguauuuuuguugcagaaaugcacguuacuuuacugugggagcacaggauacaagcugaagcccgccggugugauaguguaggacuuuucagcaaaccuguacccucucuuggacuuugucgucuagagcuuaaacuacaacauuucucaaaguguugugagcucuaacaugcuauuauuuuagggguuuaaaaagaggaacuggauaaagaccaaaaggagagagaguacaaauugaauuuuaaaauaaaagagauaaacuuaaauauuuaggcuuuucuuuccacgggucuuuuggaugaagcccauuuugcuuuuucuaugccaaauuuaggagcacugacuuccaaagaaugacugugcuuuuuaaaaaucacuccuucaaauugaaagaugagugaauuauauauauauuuuguuuuaaagaaaaacuuauuuguaacucuucacuuucuugaccacagcuacugaggaaaaggcacauaggaaaugacaucgucaccaucgucuuccaggagccuggggcacuuccuuuuacuccaaaaagcauccggucucacuuucagcaugucuuugucauagucaaagugcauaauccauguaccgaaaauguguguuauaggugagucagucaucccugaucuaucauucucccagguuuauuucaacagggcgucuuuucccaaaaauaucuuuguuugccaauuauuauuugcaacuuugugauuuucuaauuacucagacacuuucuguaagaaauaauugccuucuucccauuuuauccccuugaaaaagugaaaugccuagcacuuuaaaaugguggauuacacauuuccucuguuuuucuccuaaaaacuugagccagaaucaauagcuuaauugguauccuccucugaguuggaugaaguggcugguuaagugcuuaucuaggagaaguaaguauaguggcaguaaaacauuucuuuucaucaaagaucuuggaucuuugcagggcugcugaaacaagagguuaacacuuguugggugacuucaaaaggccacaugcgugccuuggaaucccaagacuggcucugacaaggccugcuuuuauacuuaaccacuacucucagacucugucuuaggaaaucuuagggaauaacugcagccaaaugaucauaucaugugggguauugguaaaacaaugggucuuugaccagaguuugaaaccagcuuuaccacuuaucauagggcuuuguguggcuuacuuuauuuuucuuaacauuugauuccucaucuuaaaauugaagauaaugguaaugauaguaccuacuucaguauguuguuaugaugaauaaauagcuuaaauuauguaaaacaccuauuggaguuccugacauucauccaagauuauuuucauuuaucaucuuaaagcaguaguugccaauucagcugcccacugggccuaguucagagacacgacuauuccuuguaagaaagugaagacuacagagcuugcuuccuaaaggcacaagagaaauuagucuguauuugagaaguugccauuuuacaucccacccuacagaugcccaagccaucuuagaacaaagucugaaaaccaucaguucuuacccugaauuuuacuucccagucgccuuauuaaacauagcccuagucuauggcucuacugugcuguguucuaaugcaguacaccugucaucucuauacuucccuccauagucauucuuacgcacaucuggguuucagaccacuggccuaaaugcucagaacuacuuuuuaaaagugauauuugaaagaauauaguaucuacucuauacaaaugauaggcuuaaaauagauaauauugguacaaaccuggugaguuggccuuuuuuuccugggagcucauccagcgaaugguaauucugaagaauaaaaugaaccuuccuaauuggauugggaaaacugaaguauaaggcuuuaucguauuguauuugguguuauuuuauggguggcuauuuuuaggucaaauggaguacuuuaaauuacuugcuaucuuuaugcuuauaucaugagguaauucauuagcacaaaaaauuguaaagauaggcaauaccuguucaauuuauuucuuuuagguuuuccgguuuuaauuaaacaacucuguuuaauuaaaaaacugaguuguuuaauuaaaaccagaaaaccuaaaagaaauaaauguuuuugaaucuaauuaaauguuuugaauguauuuaauuaauguuuuugaaaacaccacagagaucucuuacauauaacaaaguacauugccuuauuuuuucugugauaaagauaccauaugccaaucauucagagauggagucauugguuuuuaagaaaccacauuguuauuacuaaauuaaccuuuacuaaugagauucaaaugcaacaucaguucaagugccuaacauuuuuggaagugccucaucagcuucguugaucuugcuuaaaaacaucacuaguauuucuugaagaaucaauaauaaucuugaguaauccuguagucacaugaauuccauaacauuuuaugaagcuguccuuacucuaucucaugaaauaagguuggcaugcccacauuuucuaaaaacaccuuauuggucuguuucaugugauacuccucuaaauauuccaauggagaaauaaauucauuaaaauaauuuccaaggaaaugguauaguccagcucuacaguuuucuuaaauuuugcuauguccuaauccagaguggcaagcucccgugaaagcuguuuuucuccugagcuuuuuucggguguugaguggcagcguauucuugcugacgcggacccacgguaccaaugccaauucauaggccuuacagcugucagaaggggcugugcgguugagaucaccuucucuaaugaaaaucgugcagccugucagguguaccugccugagcagaagaccacacucccacccuacagagggagucaggccucccccaugagcgcagcagaaugcucgagcaguuaugcuggguccacuggaacuaggagaaaugaggcaacacccccagagccccacgaaacaucucacuuucagccugaaaauauuuaaaaagcagacauaacaaauugccuauuucuuuauaaaagacucuuuaauuuguagcuaauguuaagcugucagggauuuauguuuuuauguacuuuccaagauaaacucucugcaaaaugcucaguaacggaaugagagaagucuugguagcuaagagugaauuaaaaguggagagauaccuauagaaaaugaugacugccauuuuuuagaaaaucuaauauguaacaucuucugacaaaaauuaggugacaggguuaaaucauuuauuaacacaacaacuaugauaguaauagugacaguaacagcaacaauuuggguaauaaaagcuuuacaugcauuauuuucuaucauccuuacaaugggcuuuuggguaugauacuauuuuaccguccauuuuacagaugagggcagggaggcacugaaggauuaguguaguuagcucagucacucaggaggugguagagcuggacucccugacuccgggaguuaccugacuccaguuugcuccucacaccuuucuuuauuguccuuuggccagcaggccuuguuaaaacccuuucaugugcauauuaaggaaugcuuaucuuucuguuugcuuuugcuggaggggccuuaaauaucuaaggccccuaaaucauuaauaaaugcuaucgaguuauuugggugaaauaaggagcucugauguaaguucucguuuccacacaaugggaauuaucugaaucuggcaaaagaauauuucuucugaacuugacucuacuugaaauguuaaggauccuaugagcuuuuguaaccaagggucucuaauugauucccauacccagaauaucauaacaaucauggaauagccaugcuuacauucugcugguuuucuuguacaacuuugagaugugcaagaauacaguuuauugaacaagaauauggcauacauuguacagagaaucugcaauuagauauuagggucuauaauuggauacacaaaaaauuucccuacuauauaauggagucaccaugucucucuuauuuacuaugugacaccacaguggagcauauuuagauaacaagaaauuuccccugacauuguagcuuaagugcaugcaagcugcacucagaggguagcaugagaucuacagaguuaaugcaaagaaguaaugcacuggagugccagaugacauuuggccgccucagcguuccauggguaaaauacugcuagaaaucuguacucacuguugaaagagagaaccaaauuuaggagcggugauacauugguuuaucguacccaauauuugcagggcagguugcagugcacagagagacccuuugagcucauugacagcguagagaagagaagccacaggaugugguuagacuaaucacaaguccaaacagguagcuuuaagaccacucucccagaguuaacaugggggauugugggggauaaauuaauucccagucuagaauggccauccugaggaugguggugaggggaaaaugggccacaccugauguagaucccuggcagugucaaccucugugauguuuuuaaggaccuuuccuucauuuaagcccguaagucaaguucccacacacacauacccucugguaugguauauauacuaccauaaagcaccacuaggugcuauugaugaguucgguguaucugucccaaagcaaagcagucauugcuucccuuucauaucagugaaggacccaucuagccaccugucugucuugccgcuacaggugauuaacucugcugaagagguugcagauuaaagcacaaguuagccugcgauuuuucuaaagucuaaccaaccacauuucagaagaggaguuugcaucugacagaacaaauuuggauggaauguuuuuauuccuuaauuuaccuuuuuuagaauuuuccacaaugaugaaaacaaaacaaagauugcuuccuuucuuuacuccaacaucagccugggcagaugugggauuaauacagauucuuggucugugguagcuacucaguaauuggggugcucucaaugcugccagugauacagaauccauucauucacuuacucgucuuaaucuuuccuuuguuuuuuuguuuuuguuucuguuuuuguuuuuuugagacggagucuugcuuugucgcccaggcuggagugcaguggcgugaucucggcucacugcaagcuccgccuccgagguucacaccauucuccuuccucagccuccugaguagcugggacuacaggcgcccgccaccacgcccggcuaauuuuuuuguauuuuuaauagagacgggguuucaccgugcuagcuaggauggucucaaucuccugaccucaugauccacccgcuucgaccucccaaagugcugggauuacaggcaugagccaccgcaccuggccaguccuuccuuuguuaauucauuaguccacuguauaauuuaucuuaugcagaaaaggauaugagauaacuaaagcaacucucugauguaggggagcguuauugguuuuaauagauuacaaugcucguuauuaacacuaugcauuugaucucuucagucccugagaucccuuaaaacuuugcucccauaaaaccuucauuuagauuuucaaaaugugaucaaguaaagugagcauuuccuuuaaaaaagugacacuuaaaacuuuuggcucuuguaaguaugaucacucugucccacgucacugaaucccaugcagcuaacgugggcuaaacccacuuuggucagaagagcuacuguuucucccagugauaaccagccccacagaguuauagagugccagccugcuuauuccacaugcuguggauguguuacccccuguauuaguuugguagcacugccguacuaaugccacaggcuagguggcuuaaacggcagacuuuuauuuucucagaguucuagaggcuggaagucuaagaucaaggugucagcaaggauugguuucuccugagaccucuccccuuggcuuauggauggccgucuucuccuugugucuucacauggucuucuuucugugugcauacaucccuggugucucuuuguaagcccaaauuuucuccucuuauaaggacaccagucaguuggauuagggcccacccgaaugguuucacuuagccaccuccuuaaggguccuuucuccagauugcgucacauucccaggaacuauggguuaucuugucaacguguggauuuugagagggacauaauucagcccauuacaccuccugucuacuaaguuuaaagcauuuugcuuaaacaacaauaacaacaaacccuggguaugcagcaauuaggagaacaagaacuugcagaauaaaccaguuaaguugaaaguguguguguauguguguauguauauguguguguguguguguauguauauguguguguguguguauauauaugucaaauucggaaagauacauauuaugguaucauagcucaucucauuuuguuucuguuuuuacuuccucaguguuggaguuuccagaucaaaagaugugccaccauuuggcccaccgauucccaaagguguaacuuuuccaaagucagccguguuccgggacuuccuuuuagccaaaguaaucaaugcagaaaaugcagcccauaaaucagaaaaguuucgagcaauggccacucgaacgaggcaggaguacuugaaagaucuggcggagaacuuugucacaaccgccaccguggauaccucugugaaguucagcuucauuacgcugggugcgaagaaaaaggagaagguaaagccaaggaaggaugcccacuuguuuagcauuggggccaucauguggcacgugauagcccgggacuucggccagucugcugacauugaaugucuucucgggaucuccaaugaguucaucauguugauugaaaaggauuccaagaauguuguauucaacuguuccugcagggaugugauuggguggacaucuggauuagugaguaucaaaguguuuuacgaaagaggagaauguguccuccuguccucgguagacaacugugcugaagacaucagggaaauuguucagcgauuaguaguaaguacauguuuucuauuuucccgccauccuuauguuuucaauuccagauucaaaauaacuuucacuggggaacugcuaccaugauuauaccaauuagggaaugcauuacuauuuguuacagauacagagcuuaauuuuaaaugcuggguccuuuuggggaguuguugaauacaugaaugguggagaagcaaccaucauaaaucaauuggaaaagaaaaguuaagccaaccugcaaaagagaacauuaagauguauuuuaguagcauuugaaggaaaaacagaagugucuggguagaaugucuguuuauggaggcugacauaacauaccuucccaguggguaauuaacaacagaauugcuguugacuguaugaaugacgaguccuaucugcaguuucaccccugcauguuuauacagcagcuauuuuuguuuaaugugccagauuaaauauauuauuaaucuuagagccacaguuucuuaagggaguuuuucagaauuacacauuaauuuagaaaggcuuuugaaaaguuagacuuaagaaagauuuucauguaugugauuuuuagugcaaaacccuuauauuuuauccaugguguucaguagucauauuucugcucccaauuuuaacaaaguaagaaucagauuuuaguuugagcauauaaaauaaaguaguaagaauaaaucaaacuacuucuaguuuuuauuuuugguaauauaagaaaaaaacaugcuuugacaauagaauuucuuguguguaaaucuucccccaagagggauguaauuuuuuuuuuaauuagaaaagguuuaguucacuauggaucaugagaaaaggagaaauuauauccauuucuugcccccuuuccucccaccaaaaauauuuccucccuuuuguuauuagagaccauguauaagagaagguaaaaucagggcagugucugcuagccuuggaaaaguaauuucauuauuuguggacucuguuuacaguaaagggccucaguguguucaacaguauuaucagguauacgugagcaagccuagauaagaguuuggggugauuaaguaaaugauuaguuuauauaccuagagaauugacuugaauuauacuggugagucucuggaugcauucugcuuuugcuaauugcaaauacuucuuuuuagcauauccaccaaaucauuauaaucugugcuucugaaaauacaacacaaauaccacuucaccaaccacaaaaauguacuuucccuggauauuuacacaugggcuuuuauacauuugcuauucgauggacuccauccuauuuuccuagaaaaguguauugucagugugaccaagaugcacaauauuacaaauauauuuuaggaauuauauucugugucuaggaugacuugcaacaugagcuguuggaaacaagccagaccaaagacuguugaagggauuagaucguaaggguugaugcagagugguaguaacagaaaugggaagaaagagaagaaugcagucuuaguggagauguugggaaugccugcccguuuggcagaugguuaacucaguauccauucucaggugguggaaaguggaacuaaagggucugucuugcagguaacaguacaggagcagaaugagaguuuguuccuagagggccaggcagggcucacuucacggaugugcaacccaugcaguugcacagggacccgcucucagaagaguucgugcuugguugaaugcucugccauugccaucuugaaauacuuacuaauuuuuucauaaggagccucgcauuuugauuuuucuuguggccccacaaauuacauagccaguccuggcuuggagacuacaauuuucgugugauaauuggguccauggaagaaguccaaauacauggagaacaccuuacuucagacuuuggggauguuaggaagcaauaaacagaggggauaaagaaauagcaaaaagacaaaguaggggagguggcaggugauuggaggaaaugagcagaagagccagagcuggaggacucuggaaaggcucagccaauaacucuucagccugauacauggaugauaaacuucaccugauaaucgcauugauauuugaaagaaggcuggguacaucuuaugugucgucuuuugauaggauugcuuagaacaaaguugaaaaagaagugaccaaaauuuauuuguguugugccuauuacagaacuacuucuucaaguuuuaguuacuucaguucaugacuuuagaaacgucaauauucuaaaacaucaucacuaacuaaaaccagcaguccccuuuccgcauuuugcugagucgugaacugucaugccugucugggaaaagcugauuggcauugugugcacuugugguaaccauggaaacaucagacacaguggugauacaugaaccagccccagucccacagcuguacuuacugucauaggucuuauuaaauagguaucuauguagucagagcauguuucauagaaauggaguguucauuaaacugaaacuucauacauugccucugggcuuuuggggauaggaguaugauaccucccaacuugaaauucccacagauaggugaggucauagucaucgggugauacuuaaugagcccauguuuuucuuucauuggauguaaacuaugcucggugagugcuuuugagggcugcauuaguggugcuuuaauguaccaagugggaugcaauccaccauucuucuuucauguuccuuuuuguggaacugcuguugacucucucucacucuugaguaagguacauacacugaggcuuccauugcuuggggcugcccucagccccuaggagacaggccuaguggaggagaggcagcccauaagcacagagggucugucugcugccugccagagcaccauccuacacacuugccuugugaacagauggccaaggagucuggcuggccugcccccaccauggaucugagugguccucaccacucaggcaagcauaggcaguugucuguccucaagagaaggacccuaggggacagaacacuccacaguaugucccuagggcuggugcguagagaacauuuagaguuuuccuaaagcucugacuuucugccacugcccuuccugaaccucagagugggcucuuaagcguuagcuuucaagugcuuugggguguuuuucuuugcuugggaugaauaaauugucucaugguuuuuagugcuugcugguugaaacuuguaaugguccacaaagucuuuacagguuuuccauugcaaaaauccaucuagaacgaugggauuuauaugcuuaaaagucaagucaauuuaccuaauaaaggaaaaacgggaauuaucugagcccaucugaagcucucaagcucugggucagugacaucuaagaaagcaggacaccuguaucaagaacagauaugacuuagaaugaagaaugaaaccauugcuuugcuucuguuauuuucuuugcacuugaugcaaauguuaauugugaucagcucugaacuuaaauguguccuuguccugucacuuggacaguuugaggaaaaggcagagagagacaggcugggcugcgagggcccaagggagagggcuggcauggaggcccauacgugcaccuuuggcagagccccauggcagcuugggcaggaagggcaucucuaacagucuccuucccccuuagauagugacgagaggcugcgagacuguggaaaugacccugaggaggaacgggcugggccagcuuggcuuccaugugaauuuugaaggaauugucgcagauguggaaccuuuuggcuuugccuggaaggcuggccuucgccaagggagccgccucguggagaucugcaaaguagccguggccacucugacccacgagcagaugaucgaccugcuccguacuucugugacugugaagguggucaucauccagccccaugaugacggcucgccccgaagguaaggcgugggaggcccaaguaaugcucacuccuccuuugccucuguagcagguggcuguccucagugcuccugcaagguccucagaaaaugcagucaagugugucuuuguacaguguucugggaugucacucauuuguacaauguuguugggaugucacucguucgaggaauugaaaaggagcuuuaaaauauguaauagaugauaaaaaauaauuugcuaagcauuuuaauggaacauugacuacauuaaagcugagcuauucugaacuaaggggaagagcaccugccugguuccccuggaccucuuauaucuaagaggaaauaauucuguaucacagcucagccuugagcacauuaaauacuuaacuauucaguuagaauuucuucccauaacaugaagccauugauuauuuaaaaaauauuuaacagaccaauaguuguagguaugaaagaauguuggaacagcacagguacucucugugguaaauacuccauucucaauugaagcuugagagauguugaacugguucagggcguuaucauaaacugucaggagaaauagaugaaaaggaacggcuagacuuggaagguucagaggcggauagguggagggcugggauaagaacgggguuagaaagcaauacuauuacauuacuaauagaaaauaaucaugcccaacauaaaauauuaggccaaaaggagaaagaaugcuaauuaagaaggagccguuuauugaggcuguggcccacuacuuguguuaaugcaugacuggugguaguaucuagagcaccuucccucuaucuucauucccaaauggaguucguacaggcagccuuaagagcucuggcuuuugagagacaaaguaugcuuggaauccaggaauuugcuguguggccuggggcaacucacacacucucucuaagucucacuuacucucuguaagaugggauuauuauaucgccuaccuccuaugauuucaaugaagaugaaauaaaguaacacauguaaagcacuuagaaccuucuagcauaauugccccacacauuuaauuuagaaaaauaaaacuuuaggggcugggcgcuauggcucacaccuguaaucccagcacuuugggaggucgaggugggcagaucgcuugagcccaggaguuugagagcagccuggacaacauggcaaaaccccaucucuucaaaaaauacaaaaauuagccaggugcaguagugugcaccuguagucccagcuacucagaaggggaagguaggaggaucccuugagccugggaggucgaggcugcacugagcugagaucgugccucuguacgccagcauggguggcagagugagacugcaucucaaauaauaauaauaaauaaaacuuuagcauauucauuuuaauuucuuucauaugaaaaaauaaauucugauuauccaaagauaguaggauuguugggucuacuuucuggacuuacuaaccuaggucauacucucuccuuucucuguuuccuuucuuccuccuuuaagccagcacucuccauuagcacuuucuacagugaucugugucuguaccguucagagcaguagccacaaaccacauguggcuauuacguacaugaacuguagugcaacuuaggaaacgaauuuuuccuuuuaauuaauuuacauuuaauuggccacguguugcuaguggcugccauauuggauagaucagcuaaaccaugaucuccuuuuaggaaaaaaagccacuuacacugucuuccucuaugguuaaugugcaaaaucuugcaaaaaucuuucucuauuaguuaucuuagcauuugccuccagccucacuuucuguggccuuguuuccuguauuugcccaguguguuuauaaaauaaggauuuaagaaacuaaguuuucucuguagaguaucagucccguguuaagauguuucuuauugccuugccugauucugccuaguugaaucugucugcuuuuccagagucccaugaaucacauguacugcuaugaguccaaagaaaauaaaaaauuaauuuauuaaaaaugagucuuggaaauaacaaaaggcaaauccuuuaggccuuaaaagcuaaaguacuguauauguaaaauucuuuuauaguacauuuuccagcauuuguuagaaauuuuuucauacaguaagauuucugucuuccuuaguagaaauacagguuuuuaauuauuaagauaagaaucagucuuuuaucugccuuuguaucaagucuuuuaucuguccuagcagccgauuacuauagaauuggacaaaaauguuaccuugcgcuuccuuuggguuaaaaaauaacauuucuugccuauuuuuaguuuugguuuacuguuaguaagaaauuuuuaaagcuuucaagagaucuguuuaauaaaaaugguaaaguugucgugauauuugguauuuagaaauacaauuuaggaggauagaauuuucuacgaaauauugaauuguuuuucagcuaaaacaaacaaaaacuacaauuuaaaaguuccagcagcuguuaucuuuuuauccaaggacauguuuuuccucuaaggaaucaguuaucugccuuggucuacacauaauuaauucuuuguuuuaaaugcaaauucucuuaauggagcuaggcaagauauuuauuuaaagauuuugcccuugccuccuaggagucucauuaaugucauucccuaaacauacaggguuuuuuuucccaauuaaucuguaauaacugucuuuuaaccuuagccagaaggauuagaauuagcuauuugccuaguagcaacguuccaaaauuggcacacccaucacccacauuucugcaggucaugaaggcuuuaagccuagccuguaucauuuaaaacucuuucaauucaguuuuccaauuuucuaggaaucugaauuuguaaauuuuuaaauccauauuuuuguuaguuuugauuuguuuucugccugcaacugucugggugcccugauaaaaguauuugguguugugagacaaccucucauaaccagauaccacccuugcaauaccagcccuuugcuuuagaccgcaaguguaaguaugaagugucauuuucaguuucacccucgcgcucagcauguuuagccuucugcauuauuagauuuguuaagaaacuguagaggaggggcuaaggggaaauggguagcacuucacuccuuuuaaaauuuaaaauacaaacccuuuaaaucaaacauccuuuaguacuguuaaccauauagcaacacauaacaggaugugccucaagcuaaagcuauacauuugacuugcagcauggaaaaugaccuccaacuuucucagauggacucuucgugcuugugagggaggagaaauauuauuuaaauggacauguauaugcauguguguguuucuguguguauguguguauauauacauauacauuuuuacaguaguuuuuaacauaaacacuaugaagacuacaaaaauggccaaauuaaggaauuaugagauauuuuagucucauaaauguugugaaaaaugcuucaguucauuuuugccauuuaucaacucccguuuuagaaaaucauuugacaugggagcccagcuccuccugugggcagcaugaguggccugucauuuaauagacaguuuuucuuguccucaggucaaaagguguuugguuuugacucagaagcugcuggaauaaaugcagucuuuaguaggaaaaguauuuauuaaucuguugaauccaaagccaccuguguuuugaauucccauaaaaguauuuauguucaaccuaaagccaccuguguuuugaagucccauuugccagccuaagggaggugacagucuagcuugucccucagcgugaagggaagucagagccauuuuuaguuuuccuuguggaguugcagggaacacugagcagggagaaucccccuugagggacacuuauuaacugaucucgugcugggauuggauccuggagugaauucauauacauugggaaugaguggcaagaagcaguuugggaauaguacucuucaaauggaaaugagguuugaaaggggaaccaggguguuucucaagcagacagucucuguggcaaagaugaagaguugcuggggccagaaaugcuuaauuaagaucugucuuguuuuugcaagggauaauuuacagccaccgguauggcccuggccucuggccuucaaaggugacugacauucuaucagugucauuugaaggaaagcauaucaaccuaaaaggcggauauaaaggaaguaacaacucaucagaauuaugcaugaguuguuauauaaugugagugaauuuaguaaauauguccaauaaaaauggaaaugaaauuccuugcugcagugcaucuguuuuuuugugauuuuuuucauacuuuguugacauacuauccaaggcauuuuucuauauaaugcaaaacaguggaaauuuucucauguuaucaugagucuaaauuauuauucucucaucauucuauaaaaauuaaaacuuuauguucucaucuccuguuuugcugucuguugccuggucauucaacucccugaaguaugcagagaggagaguauggaaauagaaggaaaacucaauuuugucaguuuaacaguuuuuauuuuuagauguauaucuacacacauacauauauaaaauaaauggugggcugaaaucuggacucaagugagccuucuuuuuuuaaaaauuuuuuccaugcuuuaucccauuuauuauucauuacaaagcagacuuuuuuuucuucccagcuuuuagguucaagggguacaugugcagguguguuacguggguaaauuacgugucguggggguuugguguacagauaauuuugucacccaggcaaucagcauacuacccagcaggcaguuuuuccauccucacccuucugucacccuucacccucaauaagcccuagugucuauuauuccuuucuucguguccauguguacucaauguuuagcucccgcuuguaagcaagaacaugacagcauuugguuuucuguugccguguuaauuugcuuaggauaauggccuccagcuccaccuguguugcugcaaaagacaugguuucguucuuuuuauggcuguauaguauuccaugguguauauggaauuuucucuuuuuuuuuuuuuuuuugagacagagucucgcucuguugcccaggcuggagugcaguggcgcgaucucggcucacugcaagcuccggcucgcugcaagcuccgccucgcugcaagcuccgccucacggguucacgccauucuccugcuucagccuuccgaguagcugggccuacaggcacccgccaccacgcccggcuaauguuuuguauuuuuaguagagacgggguuucacuguguuagccaggauggucucgaucuccugaccucgugauccucccaccucagccucccaaagugcugggauuacaggcgugagccacggcacccggccaaccacauuuucuuuauccagaccacuguugaacaucuagguugauuccacguuuuuguuguuauagugcugcagugaacauaugcgugcgugugucucaagugagcuuuuuauauucgaguuccaacuuauuuguauggauaauaaaaauuaguuaugucuaguguugucuuauggacgcuccaguauugaauuuugaugugaaaugugaaaacaauacagaacaaagguaaccuaaaguacaaucacuauucugaguccucuggccaguuucuccaauauaacauucagauuguucucucacucccuaaaguaagaacauaggauuauagaauuuaagguagauugccuugcauucacucauucauucauucauucagccacucacucuuaacuagcuugugccaggaacugugcugagcacuggggcuguuaaaacggaugggacagauguaaucugacuuucaaggacuccuuuuagucuuucuggcuuucuaaaaugcaguaguacuuauucauauuuuggcuauuuaaaagugauuuuucucaaacuacagcaacaacuuacuacuuaauaauaaaugucucaggguaguguagaaaaugcugucacccuuuccaaguaauaaucuacacuucagugcccacguguuuuuucauuuugaauguugggauauuaccaucacaauaagaggaaugcagaggauggcgguaaagcaugagcauuguguuagacuaguaaccaucucaugcuugacagguuacaccguggcuaccauaguggacagccauuggauauucuccccccauagaaauacauucgucaaaaaucaggcgucagauagcuagcuauugagaaucuucucuguauaauuuugaaguauuacagugcaguguuacuccugcucucaagcuuucuaagaaacaaagcaguugauuuugacaagaacgugcugagcuucuguccagugcucugccagguacuggggauacaaagauaccaucugccccugugucugcuucuaguaagggaggaaaaggauggaaggaagcugaugaauuaguaagugccagauagccucacuuccuauuucauacgauaccuuuucaauugcugaccuuuauaagagggcuuggucaagugugauuaugguucauaugucuuuuuuucuaccuauucuggguaucucuguuucuaucuguaaauuaaggaauuuguugaaaagcaaguuacuauuucauuuagugccuauuucauguaugccacugcccuaaccuuuacaguaaguuauacuaugugguuaucucccgguuggaagccuuugauuuuuuuauguaccagaaagaguuugugauucaagcgaaugagcaucaauuaccccugucaccuuguuggauaauuuggaguauuuuagcuauuagcaagcuauuagcauaacagacauuaaaaugauuaaaauaucagugauuacuuuaaucccuagggcuauaaaaugauucuuuuacaaaaugcauaauauuaaaaaaacauuuaauuuguuuuagaggaucggcuuuuguuuccaaagauucuuuuagcaccuacugaaaaauaugacauaguguaggcugcaguaacuguucuuggaugguuuucaaaaaaaaaaaaaaaaagccuuguguuuuaggaagagcccugaacuuugagucagaggaccugaguuccauugugaacccuaucucugauuagcuguaucaucuuuccaaccucucuagcccuucuucugaaaaaauggagauuuucuuuguaccucacaaauuuuugugaaagucagaugauguauguggagcacuauaaagugcuacacaugcuaaggugguggauuggaauuaaagaauagcauugcaguacuuuguaaggcuuuuccuuagauuauuggguucacuuaaagauucucugugaugcagccaaguaagguaaaaccaauagggaauuucagaguccaguaaaugcaaguuccagucaugggauuagaugaagcugugacugcacagucugugguaccugguccaacuaacuggucaacugcccucucuuuuuuugauaagaauauguauucuucccuuugaaccuucucaguucucuagguuuuuugguuuuguuuugcuacucaucauucccuuaggacucuuccccuuucuuaguuucauaguagcguaauacaaagucaugcauccuacuuuuauguaagaugaaaagaauaaaauaaugggauaaugauauauauuguucuacagaugaauguagaugaagggaauuuuacagcuuuaaagauuuuuuucaauuugaaaguuaaacuuuaaaauuccagaacucuauaaacaucuguuaucuagaacuuucauaaaauuuuaugugccuuuugcaguuuaauguugguuucccccuuuuuguggaaacagaaguaauaaugucuauuuguagugaacuucuuucuuuugaagcugucaguugaggaaguuuacauauuuuauguaacuuaaucuugaugcacccucugcuguuacuauucuguuuucaagaggagggucuaagagguugucacauuucuaagcuacacauagucaugucuggguuuuaagccuagagcccaaacucucucuuuaauggagauaguuugguaucuaggguuccuguugggaacaaauggaaaaaaccauauggcuugacuagacucaaacagugauggucuugacggucagccugcagaguuugaagacaugauuuagaaccaaguccauagccuggccagcagggauuccaccuuccaguguccaaauuauugaugguaaauggaagguucuuccgagaaacucaagguguuguuggaaaggaaugggccuggguggguggaugccaucuugggggccuuccugggugccucugaaguuguggaaugcauacacuacaguacuuggcagugaccguggugucuguuaacugugggggccuuccugggugccucugaaguuguggagugcauacacuacaguacuuggcagugaccguggugucuguuaacugugagcaagauaggacacccccucuuugcugaucauguucaggaagccaggaagugguggcagcuguaaccaagaagucuucugguaggaaacuuagcuuuaggcaucaggaagcaggggagaaagcccaugaguaugaauaugaauaaguuaaugagugucccuuuuacaggauuaagccaucccaggaaguccacgauggugagugcaaaaggacaaguaauacuguuuuuagaauacagcaguaaaauaaaagauccucugaggaugccaucuaauggaauuacuuguuauucuuacaguuugauaaugccacauuuuuaacuaacacauuuucagugaccuucuuggucuacagaauguuuugccuuccaguguaugcuuuugagagagaagagagaauagacucagaaaaguuauuggcuagacaagaaaugugaaaaauugcacuuauuuuuaaccuggagcugacuuuguauugaucccuauguagcaugguaauuaggagcauaaguugaugauguguacauuuguuauggagcaaagaggaaaucaauaugccuacauaaaagugaucccacagccuuaucuugagguuuuuuaguaucuccuguuggcaagcaaacuguaaagaaugugccagaagcuagaaaugcaguuuccauccauugacuugauuugguauaucgagaggaagccaagcauguguaucaaugaggucugaauuuuucuacuguagcaggaaagcaaaagucuuuucuuuaaaaauguugcaguuacacacggguugagcagcuuguuuuuuuagaaaugucuuuuugugcuagguuuuugggcauuuggucuguucggguuucaguuagccuuuauuuaacucaucgaaauauuugccaugugccccauccacagcagcccccaguuugacacuccacaugagcuggggugucuugccugguguccucugcuaaaaccccccaagugggagagaggaugcgugccaagggggacgcagauccauuucugaugggcacugcagcaugaggacuucuccaggcucauuugucauucuucuuuuaugccuuuucccauuucccuaaacauugguugaauuuucuguaugcauccuuuaaggaauuucucauauauauggaacggaacugaguuugacuagguuugaugaucgcuuauaucaguaguacuaauuuggcaccuuagucauagaaguaaacaaagcaaaaucuaguucacaagaguaguugcuguaaaagugucacauaauaacaaaauuaguuugauuuuaaaauaaaaccauucuuuugagaauagcuaauuuuuauuagggcaaaagaaugccaguucuuaguauuuuaaaagaccuuuccuauaugacuuucugcacaagguuggagauaaaauaauuccacccagauucucucuucaacuuaauggauugcacagauuuuugccagcauucucucaaaauaugagucaugauuaugcauuuauauuacauguuucuuuccaagccucaagcuaaauuauagugucuuauaaagacuacagucuaugggcaugaauuaaguaggccacacuacucagccaucugucuucucuuucuuuuuuccucuuaaaaaccauaccaaacaaacuugaaggccaaacaagcacuggaaaugcaaagaugucuuuggguucacaagauucaagguucacguuccuuucauucaacauauaacuccaggaucuguaacuucaaugguagucaguuacaguuccugaugugcacuacucaggcagcuggaaccugugagacaccaaagccugguguucaccugaacauccagugacgcuuagagcaucgauuugaguggaagacaaaaguagguuuucuucauguuuuauuaucuacugucauaucugacccuugauuucugauuaggucuuuggcuauggggaugaaucaguagcccuagggaugugguaucuuaauaaacagaaaacacuuggaagcaauauaaauccaugaacaaaacuuauagagccuuggcauuuuauaagaaaaugaugcaacccaauguaauuugcauuuacucaguuugaccaauaauguaacuguuaaacucaguaaauccagaguaacuuaaacuaaauaagagaggugaauuuuacuuucaggaagggaaacagaguuaaaauaaaggauaagaacuaaccuuuacugaugcacagagaaaucacuaccucauguucuauaagcagguguuaagauuucuuuaggaggguguauucaguccacucuacucuauuaacgcuaccaugaauuugguuucccaagccaaaaguuaggauguuguuuuuuauuuuuucucuuucucugucccaagcuccaaguacuauggauuugacaaguuagaaaucacuuucacccagaauuuuacaaggauuuccuuuguuauauuuuguaccuucuaguauuguuguugagaagaauggaacuauuccacgcccagguccuuagacccuuaggcucccacccacccuguccccagaaccguaggcuuacuuccuuaacccaggagucugaauuccucagugauguguuuucauguggaccauuuuuuauucauugggcucgguacucucuggaccuuuuaauccaguuuuacauaucuuaguucuagaaauguucauauacuauuucuuaauaauuuucucccccuuuuuuuuucccucuucucuuuugugauaggucugucugguaguugccggacuuuuuagauugaacuucaguuuccuuaauuuuuuuuuuuuuuuuuuuugagacggagucucgcuauuuugccuaggccggacugcaguggcacuaucucagcucacugcaagcuccgccucuuggguucacgccauucuccugccucagccucccgaguagcugggaccacagacgcccaccaccgugcccggccaauuuuuuguauuuuuaguagagacgggguuucaccauguuagccaggauggucucaaucuccugaccucgugauccgcccaccucggccccccaaagugcugggauuacaggcgugagccaccgcgcccggccaguuuucuuaaguuuuuaucucucauaacugagagaauuucucaguuuaccuuacaacugucuuacuggauuuuuuaguguuuaauuuuaacucucauaaguuccaccucuucuucagcgaucuaguuguuccaugagcuucacugcagagugauuggaugguuuacaucugcuugucuuuucucuagagaaccaucuucuuugaucucugugggguggugagcauucugaggccaaguuuagaggaaggagaagugacccugggucucaucucugccuuaggcuugucauuuucaucccuguucuccucugcaccucacgcccuugacucugcaucuuuucuguucucuaaaaaccacugcuguugucccgcagugguaggggauagguuacugccugacuaggccaggcgcuguguggaccucagggcccagggccgaacuacuguuccuccuuucuaaguaacuuuuaugccuaaaucucccuugucacuuggccuuuugcagugcuuggugcuuaccgucccugcaccauuuuggcauucugcaaagacaguggucuuccuuccuacugauuuuucccucagcacaccuuccucugcucugcugagccauaaccuuucuuccauucaccuccaacuuacauacuguguauuagaguuucagggaucuccaaauucaguuggcaguugagguuguuucuguuucuuguucuccuuguucuguugugaugauuuucugaaaaggcugaaacuuuuacuauaccaugcugacaguggaguucugcuuuuuaacagagugaucccuuguucuaauagauuucucaaagggcaaauauuaggaaguguuguuguuguuguuuuauguuggcucuggaaugucuagggagaggcacuggcuugggaugcugacugguuugccaacaugguaaauugaauucuagaguugagacuuaucuagucuucccguguccuugccgaacugcaccaauuagcuucgcaggcugacuuuggucaaguuaagaguacgccuugcacugugcaguuggugggaaccuuaggcauagccgacuuaaaucauauauuuuaggcuaaagagucuuaaguaccugaguaaucgcuugagcacaugggaaagcugucuagccugugaccuuuuagggagcugugaugccaguuuaagagagcaacuaugguaacuaaaagccacaccugacuuucacaugauggacacucagguuuucccugaauugugacagcuuuuacuaauugugcuuuucacuucucucagacucaauaaaaaagugauuuguaacucugauuccugauuauauuaauauaacuauaguuuaaaauaucuguucagcuuauauaaaugaaguauuuuuaaucuguuaaagcuuauuuaucacccauguucaaugcucuugauuccacauaugcauauuaguuaaagguucgaucaguucuguccuagaaguuugcuaauuagcuggaaagacagaauuuguauaucacaugccuaacagcaauauccaucaacuagccagaaccaaaaccaugaauauuggaucauacugauccauccugguuguaaauagacaaggcccccauagccaagaauggggcuacugcaugcacuugcauggcuugugucagaaaggugccuuccuucaguggugagggaccacugaaguucagccauucucugucggggcaucugugcagagcacacaccuuuuuuaaauuguaccauggcuugccauccuuugcacugugcagcacagucagcaaaucuuauggagaaggcaagauuuaaguugagaugugggucagacugggagauacgauugccaggaggcggggcuggagcagaucagccagcuggggguagauagacaacaugcagagagcuguggcaggccagguuccucuacagggggcuguccaauagaaagauuuuaucuggauuuuccaguagccauauuaaaaggaguaaaaagaaacaggugaaauuauuuuuaguaauauauuuuaacuuuauaucuccaaaauacuaucaucucaacaucuaaaaaauguuaaaugauuauuaaugagauaguuuacauuauuuuuuguauuaugucuuugaaauuuggaguacauuucacacugacagcauaucucaaaucagaugcuaaauuuuauccugaguacuugcuguuuauauuucguaaaauguaaaguugaaaacauagauucauauacccaaguuauucuaaacacuuaaaaaaugaaucagaguaucaguuuuuaaagucaaauuaaugaaaaugaaaucacuguguuccuccaaacacaaguccauuucaggugcucagaggacucuggguggcucugugagccaccucuggcgucugcucugugggcaaugugacuauggagggacuggggcaagccagugcuaggcacauggugugccugaaaggcauuaaggagacauugaaguuuucaggaagauaaaucucauacaaaguuuguaauaaggaggaacuacagacagagaaagagagagaaaccuuagaauccaccaacucccauauguugaacacagacauggccuaguucuuuuggucacuaagacugguuaugcugcauuuaaccaaacacuuucuugaagaauaaaauaucagacaaaaggaagcuuuucucuuucuauuuaguaugauuuuuucuacaaguuuauugagguguugaugcauaaugaacugcauguauacaaagcauacauuuugaugaguuuuggcccaugugugaaauagucaccacaaacaagauaauggacauuuccaucaucccuaaaaaugacgaauauuugcuuagagggucuuauuucuacggucccugggaguggaugugaggaccagaggcccagucuugguccugcugaguaacugugaacaagguguuuaaugucucuggacuuuagauuucuaauuaccggagauaguacuuguuaucuccagaaauauauuuaaaauauuuaaccuacaaguccuggaggccucugcugugccagguguuaauuuuuuuuagcuguguauugggggucuuggaacagcugcuucuuacgcauugguaguuggaacauuuuaauaaccauacggcuguauuagcagguaccagcauagaugauguguguggcugcacggcagccaggaaaaaagccacaaaccgccuuucucauuucuagacgcagucauugcuggcagaagaggaauugaauagugugggaaugugguuuuauuauaggugagaugcuccuaaggguggaucgcucugcaucauugacuuggagccgggagaggcacacaccaugugauguguguugaggggcccagcugugaguaagccaugcugacagcucagcugagagcuucccuucucaccauuucuucuuggcccaacagaggguguucagagcucugccggaucccuaugguggaauauaaacucgacagcgagggcacccccugcgaguauaaaacccccuucaggaggaacaccacguggcaccgggugcccacuccugcccugcagccccucucuagagcuucccccauccccggcacgcccgaccggcugccgugccaacagcugcuccagcaggcccaggcugccauuccucgaagcaccuccuucgaccggaagcugcccgauggcacgagguaaugcugguuccguuuccucaaggggggcccuuguaaaucacuggggugagaacuugacauuguagggaggguuuugcuuaaucacuucugaguuagcuuguucacagcaaguuggcaagcaggguagcaaggcaggccccagacacaguggugccuggggucgggcacucuccuggccccaagauggugcugguaaaaugcagguucugcccaccagggucacagcuuuuccucuucauccaguauccuuccuccauguccacuggcucucuuccccaagaugggaaaggcaccccagaaacuauucugcuggagccucuagaaaagugugaacagguuugagcauaaauaaaacugaacaaucagugcuuaaauaucaucauaaugugaguaauacuuuaagagguuccaagcucauuaagacuuccucuuugcuuuucuccuuuuaagcaaagugaguugaguuuaaaauuauuuuuucaaagaagaaugcauacacuuguuuaaaaguuaaauccaguaccauuggaagcuggugaggguuuucagaugccuaauuugcauagaucauuuuaacaaaacaaaauaauaaauuucuuauuguuguuaauucguacuccuuuuauucuaacuuuuauguaacauguaggcacgguaaugccaugaguuuucucaauuaugacuugucaggcucuggucugauagaccacggacugggagccaggcuggaaucacagcucuuaacuuacuugauguacuguaaccauaggccugguacucauccucucugaaccuccaguuucuucaucugacaaaccacaucaggaaauuuugaggacugagugggucaauguauguaaaaugcuuggaacugggccuggcacuuagucagcuuauauaaauauuaaccagaauuaauugauaagcuuauauaaauauuaaccagaauuaauugauaaaaccuguggucauccucucccuucuccaauuuuuauucuuuccagagugaaugcaggagagguguuaauuuaacauucaaucaucuuggcucugggucucccaacucaaaagucggcuaaguuuauaacuuucccauauucaaagaaauguacauagauagcccugguaaaaggggcaacauguagaaggaaggggaucugcagaaccucccuuauuuaaguaaauuuaaauaaucauaacuuaaguaaauuguauuaaauuaaaauuuacuuaaguaauucuaauuuaaguaaauuauaggagaaaaccagaaguauucuaguagcaaaagggaaacuuggcaagcacaucuucaucaagugaguuuucaugaguauuuuucauuuuugcaugucugaaaaaaagauaaaauaggauuacauucaagagaugugugaaaauaaaugguuuugccaaauuuagguuuuucuuuuugcauaaguuuuaaguauagaacuaaaacgugacuuguuuuaaauuucacauaauaagaauuaguaauguuuucauaauucuguauucucggaaauuguauugcuguucuucuguauuucucugggagggagucauuaucugugcuuuaaaucuuuagacagugagggccuguccugucauaccucuuuccuaggacaaauugccaaucauaaaccacugauaucccugggcaucaccgauacuuaguuuauuuuuccaugauuuauucuguuucacauggcaauauguuuuucuuccuuuucuuugucauucucaaaguauauuuauuugugaaacaaaacaggccaggucaaggggcuuggcagauaguucagugcccuguuaaugauucuacucaaccuuucagaagcucacccagcaaccagucauccuccagcgacccuggacccggcgggagcggacccuggagaccacaagugggcuacgacggguacuguucauuuuuaucuuaguuauccacugggaggaaccuguuuucugugacucauugaaaagcauuuacugugugccuucuguaccuggggccauguggggaauauaauaaugccagacaugcuuuuaacaagugacuuguccagguuggaaagcucauuauuucuguguaaguagugcucacuugucgauguucucagccuguuuuuuccuuuuugaugaggaaagguuuucagaacaugaaaauuaaggaugugagggcuuaguugccuccugacuuaaauugcugaugaggaaacgccgcucaaaaucagagaaguggguuuagcguuuggcuuuuuugcuuccugucugagaaguacugggagguugccccagcacaccuagcugagagcugcccuuuauaguauccacgcaguccaguccgcaguagccagcagcucaggcagagccugaggacuucugugaacaaagacacugaguugaccaaucccaccaccucugggaagagaagagggagcauggcaccagggugcgcuccugaggaguggucugcuggggccacugugacuuggugcugcuuuggguuggaguuaggagcuagucacacugauugagaggagagaauggccggucagugggaaggacuccacucugaggagcagcuuauaucacugcucccgcaggugcacugggaaauuucucuccauauguagucugaguuauauguuuuccuucccuuagaugauagacagaguucuuaaaaauuguaugucaagcaacuuucuaaauuaaauugcauuuuaagccaagagaggauuuuuugauguuggcuuuuuugguguucuuuuuuguauaaacaguaaaaccuuuucuggcuuuuucuguaaaccaaggucuucaaccagaauucuguaaauaaggaucacuuuguaaugucaauaaguuuucuucuacuuauuucuaucauauuugggguuuucauaaaacaaagucuacuuggauguagucuagaguuaaucuuuuuuuuccuuuuuuuuuuuuuuucuuuugagauggagucucggucugucgcccaggcuggagugcaauggcaugaucuuggcucacugcaaccucugccucccggguucaagcaguucuccugccucagccuccuggguagcugggauuacaggcgcucgccaccacgccuggcuaauuuuuguauuuuuaguagagacgagguuucaccauguuggccaggcuggucuccaacuccugaccuagugaucugcucgccuugaccucccaaagugcugggauuacaggcaggagccaccgugcccggcccuuuuuuuuuuucuuaagaaaaauuuaauauaaagagaugucagugccauguauucuaagcguaacguaaaaaugcgaccuccuccguagcuugcagguacauuguuugauccuggacaguccuucaaccuccuggugucagcagcccuucuuuaucuguaaauggcuaucauccggcugcuuuuucugacccucugguuaaaccagaucccacaauuucagaugcuuuuagcuucucuggcggggcugagcugacaauuugcauuuucauuugccagaaaaccagcuccuggauagggcuuucccucgcauagccuacuuggaagccagcacucccgugugcaugcuggcagguggcacgguugagaaaggacaggcucaacucuguguucuuuucaggugccaguccccucuacugcucgaacaccagggcucaggcccuuuggaaugugacggagccagggagagggaagacaccauggaagcaagcaggcacccggguaauaaggaacuccuggaaauugaccucccuugcucccccuuucccccucucugcccccuccucucccaucacuucauuuuauucauucacucauucaaccuaugugcaccaaguugaggugaucagcugggucuccagaugcaggaggggguguggucaugguugguugugguuguggcaccugcagaaagugaacacuuuaugguggugguucuguauacuuuugugacauauccauugguaagaccagaaagucccagaaccacaagccuguucauguuuaccaaaccacuugucugacuccugguuuucuuuacucuuuugguaauacuggaaauuggaaauucaacuccucucuuuuuaugugacagaaaccaaauggcauggcccaccuuccaaaguccuggguuccuauaaagaaagagcucugcagaaagauggaaguugcaaagauucccccaauaagcuuucucacguaaguccuuuguucauaagcccuucacuggccuagccaggacugaucugucucagcacacagugguacagccugauuccuggggaugcucaagagcacauuaccucacagggcucuuagaggugagguuaaaaaaggaaacuaucuuccugauuuauaaaggaccucaaagaaagguugcacagcaaauuaguggcaaagccaaaauuauauccucagccuuuugauccucaauauccagugcaguaguuacuaaaucauguucccauuuguaaucuguuaaccacuuauccauuuaguggcacaaaacagaagcagaaacugcuaaucgguguguguggucagaggaacucugcccauagguagccauuuacuguacagucaucgaugauuuaaucaucacggccgcagcugcccauuacacaugucaggguagagcaccgcccacgugguaguucucaguccuuugcauguguugccauguguaccccuugaagaaacccugggaggugagccucgagggagacuguagcccagugaaacaaaacuuccauugaaaugcagaaacaggaauuguugguuauuacaaauaaagccaacauuuuaaaguggcuuauuuuugaaaauguucaggugaagauaauuuauaagguccugaauuaaguuaugucuuucuucuuucuuaaugugucaucagccagcuuugcaguugucccuuagcaaacacaugugacauuucuucccucagcugugaccgcgaccuugucuugagucagccucaccguaucuauuuaaauccaccuuuacaauauucucauauugguuucagcaaagggauacauggugugggcguaguuuugagaauaucaguguaugaugaaaaggucaaggugauuugcuuaaggaucugauaggcuggaauaaaaaaagauaaggccaaaccacuuuaaaaucuacuggggccuggcucguucuuaugauuccaaagcccuuugcugaugcuucagaucuuguugcuuuucccagacugugaagagaggccgugucuguaugaguacauuguagagacagggacauuucuucuauucuauuugcuuuuugucuuccagagacuccccaccccaaccaaaagcauugacucuuuuucagaccuauuuacucucaauagacucccauuucuuaaaggcuugggacgcacuuugacuggggcugucucagagagauacuucguguuuaccguguacuuugcagcagccaagugguucugcauauauuaucucauuugcuucacacaggaaucauguaagcucgguauuacaagcacagagaggguuaagugauuaaccagaaaguccuaccuuugugacuggaaccuaagucuucugcccugaacucaaggcuggcacuauaauuugucaugaagcauuuucuuaauaaguggcccuucucuuccuuauauuaauuucccauguuccuucccaguuuauaucaccuuugcuuauuauuuucuuugcuagugacacuguggccauaguuuugugcuuaaugcacaaauaauuaaagacuuaaagauacccauuuaacuuagauaaauuaugggaagaaguaugaauuagagacuucugcacaaaaccagguuguuuuugaaaaaggaaguccugucauugcccacauugaagagugaguagaaagggcuugggugcgaucccauggcuuguagcucccugagucagggugagaagcaccugaguucaagauucacuugagaacucucuguuccucuuucuucugaagauuggggauaaaaguugcuccagucacuccagcagcaacacgcucuccagcaacaccuccagcaacagugacgacaagcacuuugggucuggcgaccugauggaccccgaauuacuggggcugaccuacaucaaaggggccuccaccgacaguggcaucgacacggcccccugcaugccugccaccauccucggcccugugcaccuggcaggcagcaggucccugauccacagccgggccgagcagugggcugaugcugccgacgucucugggccugacgacgagccagccaaguuauauucugugcauggcuacgcguccaccaucuccgccggcagugcugcggaaggcagcaugggcgaucucagugagauauccucucauuccagguaagccccacagcacugcagaguaguaccugcuggugccaccugggcccugccugcugggauagggcagaagccugaacuguaagcaguaggggcaucagguagguugguguaauuuuuccuagcugucugacaucagaggaagggcuuguuucuacaauaugaaaaugucaaagcuugcauguuaacaagucccuuguugguguuuuuuuuuuuuuccuauuaaguuugagugaaaagucaauagagauauuaaucgcucuagucaggccacuuaugucucucuccuaauucaaccuguugucccuacguguuuuggagaagagguggcacucacuaaucuucagaccauaguaguaggaagccaugaaggcagcaugugcguagagcacauguagcucccugccgugagggcaugcacacacuuccucccuguuccuacggcccugacagcaggggaggccugagaucauguguauaacaaugaaaguguguucagcucugcagcugggguucauucaguaaagacuagcuaaguguaaaggaacuggauucuaaguacuguaaguguagauguuuaauaucuccuuaugagugguuuuaaacuccuguuugacauacuucucugcagugguuuuaaaauaccuaauuugcgauuucugccuucacuuucaaagacuaggcaaaggacaaagaaaugcauuuauucaguuuggcuguggacagaauuuaacuauuuauagcaacuaccacugucauuuuucugcuuguuuccaaggccuucccugauucagcuccaaguuacucucugacuccugcccacaaugcuggagggcagagucagaugaacuaagaaugggaauauuucuugcagguaccuagugcuaugagggagcauuucuccaaaugauggugcucaaggcagaccuguagcagucacggugaaaggcuuuuuauguuccucaggcuccccuucaaaguccccccucaccccaccacugccaggggauacugagugucauucagggaccuuuacauuacaaguuaaagaaacuccaugcugauugguucaugccaccagggucauauuggggcuuauguaaacaacaagucuagcacuucaagguucugcuugacccagcgucucaaaaugauacugcccaggaccagguugccuccaucuucccacuccacaugaccauuucccaaaaucucagcauucuucucuuggcugaaaacagcugugccaccugcagaccucccacagucacgcucgucuguccccggguagaaagugguuuuuuucuaguuucugcagaagaaacagguuucugcccucuccaaagccaaccccugcccccacaccacccccguaucuccucacauguuccuagcucuaaucacgugguuaggggguagcaucgucuacggcacuuggggcccucagccugggcugggggucagucccugucaccaagcugugcagcugaggaauggcaaauacagccacugccccagaagagaagcaggacauuauuugaccuggagaagggggaguggaugccagagaguagaaaucauguguguccaccaugcagagggagcuuaggauaugaagauuauuuucaaaauagacauuccuacuacuuuuuuuaccaguucuauuuaauaauuugacuuaaaauagguuuaguacuaauaacuaauauaauaauuaaggauuaucagugaauuuggucaucugaauuauuccuggcuuaauuucaggaauaguggucauacuguggagaccaucucgggauugcacaaccugcuaacaucuaguucaaaguugagaugauuuguaaaagagcugauuucaugacaccuuuuuggacagaugucauuggcaucacaaauagaguuuuguauuauuauuauuaaguaaaauuucuauggagacugccuucagaguacauucguuuauugauauuugguagggcuuuuuaccgguauuuguaauggauuuucaugacuaccuuaaccauuggcaaauuuaaugggcuagacuauuagaaaguauaugacagugcuagauuggauuucugauugauuuuacuuucuuccgccacucuaaauuggauguggcccagcuguuguauaagugauagauguugagugaguggaaucuuuuaccacuugacugcccuuuuccuguaauucuucguugaugguggcuuuugaagccacauuucaacuugcauccuaggcuuuugcucagcauggaauucagucauugaaugaaaucuuuuuaacacuuccucuugcgugccccccgagcugcacaggaggcgaggaggagggaugggauuuacagcauuugccuuguuuucuguguguugagugaaaggcaggugacucauuagaggacgagggaccaaccuaucaagccacacaaagauucugcaaacucugaaaugccaaccccagcuggggcauggguggccaugaggaaggcucccuuagccccccugcuuuccucuccugucccaguucaggcagccuugcaguccccucaagccgaggccuacugcuggagggcuuggguugugacugggaguagcccagguaacagaagagcagaauaaacuuucaggaacugaccggggugaccauccugccuaaacccacacuucugccuccaagugcuccgugccccugacccguguguuauuuucuucacagcacccaccccuaaauaaaauuguuuguguuuacugcauauuccuucccacaagaaggccacuuaucgccaccuucuccucacuggagcauucguguuuugagcugauagggucguggccuaucuuguucgcuuguauccacaacacuuaguacgcuucugugcacauggcaggcaucugaauauuuuuugaauaaagaaaggaacuaggaaaagugcuugauaaaugcuuauugauggaguuaauaaaccagugccuggguaaccuagggaagcaggaggaaugugggauccaccauucccaguucacagugucaggagccccaaucaguauaugguguacucuuaauucuuuaacucuggguuuucacaaccgacaccauagcagccuccuccagccccaggcacacacacgcacauuccuuggcagccacccgggaguuaaauaaguacagaauuguguauauggcaugauuccaagauuguacuaaggaggcaaagggaggacuuacaacucuucaagacaaguuacacucuugugaggaagaggguaggggaacaggaaucaucuauuaagcagaacaagcauauaucuagccugcuuucuccugcuguucaguucuuuuaauuuagcaaacacauuuuuuuucuuucuucgagggcagggcauuuagauaggagcucagaauaccaagcaguauuuaugcuaaccuaacuaaggcuuugcaaaaugaaauaaaucaacugcaaaaacaaaccccauguucuggauucuccuguaaauggcacacacgacguugggcuguuuaucauuauucaugccaccguaccuuucuccugguacaaaugacuggacgucagcaguauaacuccgaaagaagagcauuaguccagaaggaaagaauucaugaaaaguuuguggacaacauucuagaauguuaucagcaucagagaacacuucuguaaugauacgacugcuacuaaacaaggaauuaugccacauugcucaucaaauggauucuguacauuuguucuucaaguuaacuuuaaaacaucuuacaguugggauaaaauacauuucuaaugaaaucuaauuuuuagaaaauguuauaaaacaaauggaaaaauacauagaguuugugaucacgcuaucauuaccuauacauuuucaaaacuauacgcuuuggucauuuuaagggggaaaggugaguaaccuacacacaugcagcuuauuaacuagaccaugacuuugagugccccagccuuuaacaacgaaacaucucggggaucauccaaggcuuuaaaauacaugagacacacggguaguggaaggcagugcacaguccuucaucagguucuugauggggaaacuaaggccauaagccuuauugggacaauggggaaacuagcauguggacuguuagauaacaguauugcauuaaugccugauguccuguacaugaucaucacuugguuaacuacuggggggauguccuuauucuugggaaaugaaugcugaaauauaggaguaugaugaugucuuuaggcuugcagcuaauuaucagaugguucagagaggaauuaguggaucuugaaaaaggguauguggauguuuaugcuacuauccuuucccuuuucuguagcucugaaauuuuucaaaauacacuugggaaaauaacauacagggcgucagagcucguugucuagacacacaguuuucauguuagggcucccuaacuggcgugcaccccagugaaugggaagaguccauuagcuccuauuauucaugccuguugauugcuugccuuacuccucaggucaccuuggucauguugcuuuacuguucucccgaccugguguuccauguguguggaugucauuguagaggcagugcagcgucuucccgagacccacaguuagcacccagagagagggagccaucagucauacucaagggcaccagaccagccaccagcaacuaaguuucuucauaggaguagaugaggcgcuuuguuuguugguugguuaauuuuacuuaauaccgcaguguuuuccaaaacgcagagacccugaaaauggguccguuuauuuugugucuuuauuuccucuugaaccucuacaaaaaguucauuuuaauaucacucuuauuuuuauacuuuauucgucuuuuaugagacuugcuuuauacauguaucagaaaaggucugugcucaccugggguuucagaauaagauuauauuuacagcauacuggaggagcuugcuaccgcgggaacccuguguuaaacucuuucaauagaaaggacuccuacucgugaauaauccuuugcugggucacuuucuguaacuacguuuauauaaugcuuacccuaugcuacucacuguucuaagugcuucacuaauauuaacucagauuaucuucagagaaaccuucggagguagauacuguuauuauccucaauuuacagaugagaaaacugagguuaagaaacuugcccagggucuggcagugguaauggacagagcugauguugagacccggaauccucgcauugcacucacgugucaaguuugcugaaagugaagcccaccugccuuucugaacgcugagauuagaccuauaauuuaaacucuuaaaauuuuucauauuuauaaaguaacuuuuguuuuucauaaaacauauuguugaucuuucuaauuuaagaaaaagauauuucugguggugguuaacuguccacuuaauuucucagucagccggggguggguaguccuucuggccuuagcuuaauuacuaaccuugaaaauuuuuauuguuuuuagggccucugucuguuucaguauuguugcuguuguaucauaugauaaugcagcaaacaccccuguaacuaccaccagguuaaggacuagaacauugcugugucuggaagcucucugcauccuacccaauuacaaccccuucucuucucccuugagguagccacuaaccuggcuuuugugauaaucauccccucauuuucuuuacauuuuccugaaugacauguuguuuacuuuuaccuguuuaugaacuuuauuaagcaacuggcucaugaucauuguauucuuugugacuugcuucuucucuacauuguucaugagaucgcccaagucgucuguagccucaguccauucauucguagaguauuccguguauucauucauaguuauuaaucgaauauccuucuacuauugaugauuuggguugcugccauuggggaguucuuaaaaucagugcuucuaaucaacauuguuccauguugacaguugcacgugcagcagggguuugcugugugugugcgcccuuggagugggauugcuguaucguaagcucugcaggugcacacaccuucauagguaaugcucaaacuguuucaugcacuuuuuacucccaccagcaguaggaagguaccuauugccccaguucuuacuaacacugggucacuggguauugucaggcauucccauuuuugccugucuggugaguauguaaugcuauuccauugugguuugcauuggcauuucccuggagacaacugaguuugagcaccuucuccgacaaauauauucaccauuugaguuuguucucuuuugaagaaucaguuuaggaauguugcccauuuuucuaucagauuuccccggccauguuuuuaacauccuuccugccacaggcauacaacuugcacgugaguaaccuuagccuacguaaaaugaggcuuccuagcaagcuccaugguagaaagaaggcuccaucugccucacugggcccgauuuugcucucggagaaagacuugaguaaagccuuguggcucugaauuuggccgugugccagcacugcugaaaucagauuguauugcagcuuuugucuguuuuucuccucagugguucucaccauucaggaagcccuucagcucacuguucaaaaaguagugggucucuggauucauccaaagucuacaucgugucucacagcagcggacaacagguucccggguccauguccaagcccuaccacagacaaggggcagugaacaaauaugucaucggcuggaagaaaucggagggcagcccaccgcccgaggagccugaagugacugaaugucccggguaagguggcuggcuguucuucucuggucagcauuuuucacuguagggauugacuaagcaaauguauuuuccucccaaaggaaauguauuuucuaaaaaagaauaaucuaaaaacaucuuucuuaaacucuuuaaauguugauguuuauauuucccuauaaaauuauucucuugauuuuuacauaaaaaaaggaaaagaaaucuguguucuuugcuuuuauauucaaaucugccugcaauagaaaagucaugguaacaugcugcugauggugugaguauagcgucucuauaaauacaccaggucaaaggcaguucaaauucccacagaguccuguguguuccuuaaaguugccguguaagugacauccuaaaacaaaaaguauuuuucuuaauuuuagcaugacuuccaauuuuccuuuuaguuguuagguuugagguugaggggggcguggugggcacguaggaaaggaugcuuuguaucuguuugaaaaagaaaaagauuuaaaaauacugauaacccaucuuacaacacuugugaaaacuaugcugaugccucugugaagagacagguaaauaaauugcauucaagaaugcagagcaaggcuggcuggggcuaaggaacuauuugcuuauuucguaaagaagcuuaacagaauacucgugcuaaaugaucaggucugugugcucugcuguaccugccugcgauagcgucaucaggcguguggugcugagcguggcuugcacccacacugggauggcucuucagagagagccuccagauuuuacacuuugccagugaacuaguaucacuuuuuucucuuaaaaaaaaugauccugugucuuaaauacagcucauaugauauugccuucuaaauuaaaaauucuuuuagugcuuaaauugaacauggaaucuuuuguuaaaaaaaucaugucagucauugcaaauggcuuauuuaggaaggaauuucauagugauaacuagcccuuuuuauuauaaaugaaaaugguagaaugauacauugguauuucugucuaauaagagucuucugagugcuucacgggaauucauuccaagccuuuuuuaaguucugugaaauauuuuuagaagcauuuuauaugucgccguaguacuauguuuaggcgaaggacucuuuuggaaagucagggaagugugaaaggagcccauucggacaguuuuaaugcaaaagcccaggguuuaugcauuuccacgcacugguuugauggcacuaaugcucagugagagcgaggcaguguccagaaugaggugagaaagggguuugugucucuugagucgcagguugugugcacacuagaggagacugagauugugucuccgcuggagcuccccaccuggggaccccugugguauggaagggcaaauggcaguccccacacaugcucuuggguauaccugggaggggagaggcuguagaaguucuucuguccuaagcugcauuuuaucgggaggauuugagcucaaacugguuaucgcaagaggccggugcugggauucgagaccagggcuccuggucagugugccggcucauccuggcagauggagcaggugccccaggcucugcccagcaacacagaguguuucuaaggcaaggcagucauacaggacugcacuaacuagauuugaaguuuuaucaaaacaguguuuuaccggauugcugaaagauaugcuuagaaaacagucagccaaguacaucauauuuuuagugucucauugugcacugaagaagaaaucaguugugcucuccagaaguuucacauagaccaguuauuucucaaaaucauauuguggaagcccuacuguuaauuuuguuaauaauaucaucuuacauuuuuaaauaauaucagcgaaugagcaguucugucucaggcuucugugcacccauucaugcuguucccucugccuaaauguccuuugugaguuucugagccuggccagcacccucccaaaggggauuguucucugcacccgcuagcucaguacuuccuacagugucuucgcacuugauuggucaucucagccugcagaacauauaccacauacauaccacaugcacacacccccggacuggagguccugugcaagcccccuguccugcuuaacuucacuacucacgguggcaggcacagaguaaauccucagagcguauuuaugacacgucauuggauaauuucuuuaaauuacuaguuuagcagagaaagcuaguguuuuuuuauaaacacauauuuuaacacauauucuauaaacguauauagaaacuagaacagcacauuguaaucguaauuauggauguaauauuuuuauccaugcaguuauugguaggaccugggauuuuuccccgcaucuuucccaaaacacauacggccuggagcucuugagcaccaccuaacucaccucaggaucgaauguugggcgcuucuuggaugcagucuucguaaaaacuauauuguuuuguuuuccuuauguggcuuuugugcaaaagcccuccagcgucuugguuucuucuuguagcucccauuuuuaugucaugccaucccacaaaccaacuaaaucuucaguaauguuuuaaaaguuaugaaaugcuucuuuuuuuuuuuuuuuacagccacuauuuguucauguuguaacuguagcuugugcuucaagaacugagagguacagggaaaccuguccuaccucaggaauaaagccauagaggauuuuagagaaauccuucuuaauuuugagcauguuuguguauguuucuuauucuagcaauuucccagugagcugucauacaguuauaagauagccuggcuuuugaaaucaagagucaucucagaggcacacagcaauaacauucaggucauucuccagcucguugcugugggcugugaauuccuagaguguuauguuucagguuguguggcaaagacuguuugccuccacugacagugcagccgcugacuguuuacugugucuucaggaauauuugguugcucagacuguauuuucagaguaaaccuuuuuagaaugauuccccaguuuugucccuguaaaggagcuaaaaacaguaauucagcuugacacuccuuuguugucugucaauacauuuuuauauacugauaauuaagggagacggcugcuuuauccaaacagcuuugugaaauugcugauaauaaaacaugcuuagcacacgugugaauugaugacucguaaaccccgggcucccucggguggcuuccucucuguugccugggugccaucggggcucugguuguccagccgcgagagcacacaagcguugcuucgaaagacauaugaucaucucugaugaauuauugaaacuguguuuucugacacagauuaggaaagggaaaacacagccguauuuuaaaaguuggcuguguaauuuuuucauccugggcuuuggggaucugauuugugucugaauuauucagacaucuaacuuuguaguugagcucauuucacaaaugugaaauggcaugggaauuuggagcaaacgcagcaaaagugaacugacuuaagaccuaagaaguguuuguaugcguuuguggcuguugaaacugcuuccuagguuuuaauucuuaccacuacaggcacuuuacaaauaggcuuaauuuccauucugauuguuuucaacaggauguauagugagauggaugucauguccacagcaacucagcaucagacaguggugggagaugcuguugcagagacucaacauguucugucuaaagaagauuuucugaaauugaugcuuccugacagccccuuaguggaggaggggcgaagaaagguuagugacuuagggagcuuugaaguuaccagaaacacuaaaaaaaaaaaaaaaaaaaaagucuaaagaaacucagagguuuccagaguacucccacaugcuucaucucucaugacccuaccaacaacucacugcacauaguugaccguugccaauuuugauuguaucaguaugugaagggagccugggagagguuaagaaggcuguuuuuaaaaccucagauagagcugaaaguccggcuggccuagccucaaauccuggcuccagcaauggguagcugcaugacuuuaugcaagugacuuggccucuugaccucaaugcucucaucugaaaaaaggagaucauaauaacugaauugugaaguuacagugaagauaagaagugaugucugaagagccuaguacagcuccuggacauaacuagugaucgugaacaguagcuguuaaaauucacaccaccugacuuuuguuccagagcucuagccucugcuccaagcugucucuccuuaaauguaauccuguuccagaacugaacuggaguuagacagcacacugcugggcauuuuaaacaggguuggaacuugcacacugccauuuagagauaugcagagaucauagggaaggucaugcuuaaaucucauaaaccaaccccaaguucaguggcauaccuuugucauucacaauguaguacucgauaauguuagcuugcuuauuggcuucaguuucauuauuauugcaaucucuuaagccacuuugcuaaacaauuuaaaguacugaaaaggacuuaaaggcgauuuagcccaaucaccccauuuagcaaguaacugaggccccagaugguaaaaugugagcucuucauaaauauuuggugccagagucagcaacugaguccuugucucucacuucuaauccagcacucccucuuguucauaugaaaaggaaaaaggaaaucagguauugccauacugaccaugaucaggguaaacugcaggucuuugugcuucugucuucccuauaguaaaacaauucugcaauuaaccuaauuguguuuuuagaacaacacucuaauuagacacuacugcaaagcugcuuuaaucugauaugccuguaaucaaguucugaagaaccugcugguggugugugaggagggaaucccauaagaacuccaucauaaugagucuuuuuuaaaaaacuuacaucaagucauguacaugauacuguauaagcuugggugcaaaggcagacuguuguacaaagaguguaaauagcuuuucuuuuuggaggguugaacuucuugacauguguuuuuucuucuaagacaaaucaccuucuuuucaugauguaaauuuaacuuuguaacucacacacauuccaguuaccuuucaucaguuggaaagacuugacagaauggaaggaacacacacaauaggaauauuuuuagacuuacugcuacauucauaaauguaaauagccauuucuuuguuugaugaugugaacauucuggcuuuuacuauuguuuaccuaaaaggauugugguucaguaugcaaaggaaguaguugaaaauucagauuugauuuaacuuuucuugaguauuugaccacucauuucuuaguaagaauuuuccuuacccuaucuguaauuaaacacaacaauaauuuuaaugguucauuuaagucugguuaugauccauuauuguaacucaauuuucaacaauuauacagacuuuggcaagugauacuuuuuuuuuuuccaagacggagucuugcucuguugcccaggcuggaguacaguggcacgaucucggcucacugcaagcuccgccucccagguucaugccauucuccugccucagccucccuaguggcugggacuacaggcgugcaucaccaugcccagcuaauuuuuuguauuuuuaguggagacaggguuuuaccauguuagccagaauggucuugaucuccugaccucgugauccaccagccucugccucccagagugcugggauuccaggcaugagccacugugcccggccacaagugacacuuuuaaguggacaguaagacuuuauuggacugcugcugauuuuuggaaauguguuuauguggccggcaaagcuucaauguucacaauuagucuuauuauuauuuagauuagauugaaccucacauguaguugauugguagagaaauugccuaauauuacaauguagucauuucaaauuaaaaucaaaccaguauuauguggagcuuugaauaacuauugccugaaauggcaaccuuauauaacuccaggaacuaucacugcuauaagguuauggagguuuuauuuaacauuucagaguuaauaaagcugugcaugucuaauucaugauaauauuucauagaaugucaaaggaggaaaacauaaaaucuaauaacugcacccaagcccugguguauuugccuugauccccugcaugcugcguuuggcauucuugagcuaacagagaaaacucaaagaagcuaucacaauaguaugugaaaccacuggacuuaguccaacaagccccgugcauucguuuuuuuaaugucuguucccuccucgcaccuuguuuaaacccuaguuuucguucuaugggaaccugucuccaaggaggucgcuuuaccgcacgcugucugacgagagcaucugcagcaacaggaggggguccuccuuuggcaguucccggaguuccgugcuugaccaggcccugcccaacgacauucuguucagcaccaccccacccuaccacagcacgcugccuccgcgggcccaccccgcacccagcauggggagccugagaaguaagugaggggcuggcugcucccuggccagcgccgagggugggcugaucgcacaacuccugccucauugagcucugaggguggagugauuuaggaguuuguuuuuguuuuuauuaaauauauauuauuugguguuuuaaauaauuuucaaauauagaagccccagaguggacauuuugaaaaaguuagguaacacuaccuauuuugaaagcaauugagaaacucauguuagauauuucugucaaguccaauagugacuucugcaucauaucucagcuaucauaucuauaaaggaaaaaaaugucuuuagccugauuuaaaaaaaaaaagaaaagacugauguaaggaguggguuuuccagugggugacagcaaggagggacaucugguuuucuagccuucaguuucuucgugcaguucaguaccuggagauggggagguggcacgugugccucgggagaccuggcuuguagacugggcuuuacccgugggcggcuuuguguuccugugcagaugacguguguucucuuguguccccgcuuauuucaacuuacuagucacaggucaaccugacgauuucuagaugauuuuccuucaaauccuaaaaaucuuugauuuuuauguagugucaagucuucauuaaugucaguuuuuaagggcacuuuuuuuuauguuagccuuauuuccuuuauacauaguuauuuuuguacagaaaaaaugggaauuuaaucagaaaucuauucauugccaaguuuuuuuucauuucaucacagaaaauaucuuuagaaccaauucgaacuucauaauacacuuagaagucccaggcuaaaugaaaucaaaguucuaauaauauuuccaauguuuaacauaauuggaaaugaaccuuaucucauaaaauucuuaaucuacuucuuuaaguaacauaauaaccugccuguuauaaagaguccauuuaccuaaauugaagaaaccuuuaaacgccuucuugacaaccaugugaaaggucagccagaccuaggccacuuuccuaauauuucuccagcuguuuucucuuuuuuguaaaagguaacuucaauguccucuuaaaagcuuuuguaaaaccaaugaaccucuauuuuccugcaaguguuauuucauuuacaguguuugaagugugcuugugaacucucugugguacguguguuauguuggucuuacauucuacccuucauuuuguuuccaggugaaagauguauguccuuuuuuuuuuuuuuuuuuuuuuuuuuuuguuagcuucacuuaaaaaaaaauagacuucuuagagcaguuuuagguucacaccaaaaaauacagggguuuuccauauaccuccucaacacauuuuccccacugucaacaaaccccugcccucaaagaguggcagugguacauguguuauaaucgaugaaccuauguggacagauccuuaucacccaaaggcccugguuuacauuaggguucguuccuggugguguacauucuguguguuucuaaaauguguaagaugacauguauccgccauuacaguaucauucagaguaguuacacugcccuaaaaauccucugugcucugcguguucaucccucccuccccucuagcuccuggcaaccacuaaucuuuuuacuauuuccauuguuuugccuuuucuagaaugucguauaguuggaaucaugcaguaugcagccuuuucagacuggccucuucuacuuaguaauaagcauucaacuuccuccaugucuuuucaugguuugauagcucauuucuuuuuacagcugaauaauauugcgucaucuagauguaccguaguuuguuuagucauauacuggagaacuguauccuuuuuuaauguguucaaaggcacaauuaggaaacagucaaguuauacuguucauucacuguccuagcugaaaacugccucacuugucuucauuuuuacuucucuagaaaaagcacuaagaguuuuccuugccauuugcucucuuuaaagaaaccuucuuauuuggugauacaucuccuccaauagcuacacuuaagaaacuacucggaaaaaguucucuaggcuugauggaugaacuaacaaaauauaaaucagaaaacuggagguaauuuguauugaaguguauuccccuaaagacuucugauuuccaaccuccuguccauggaaaguuuaagcuuccagaaucuaauuguuuggaggccucuaguucccuggccuucugacuaccacaaucgccuaugugauuauagaugcuccuugacuuacgauggggccauguccagauaaacccaccauaaguugaaaauauuguaaguugaccacguauauggcgaccuaaccuacugaacaucauagcauuuccuagccuaccuuaaacguacucagcacacuugcauuagccucuaauugggcaaaaucaucuugcaacacaauacacuauacaauaucaguuauuuacccauggaaucucgugcguggcugacugggagcugugacucacugccaguucagcauugcgacagagugucauaccgccuaucacuagccagggaaaaguucaaaauucaaaauuugaauuaugauuucuaccgaguauguaucacuuuugcaccauuaagaucuacucaagacagguuuuaauaauccucuucuuucuaugguuucuggccauucuguagacccucucuaagaagauaccacucuuuaagaauaguuugacagucaaaaacuagagcagcccaaaaagcugaaaugugaguguuaaugcccagaagaugucuuugagcgagaaaugaggaauauuugaaguugcccaguaguuucucuuaguuucucagagagauauagcuucacuucaaaacuuggagcagagguugguuccagaugguuuugaauugcuguguagauagaguugggcagaaaacucagaaagcacagauacucuucuuuuaaacuuuaaaacauagagcauucauagggaaaagagaaucuuucaccaggagagacucaaucagauuuuguuuauaauuuggagggaggguagcagggcaaagcaccaguaacugcccaucucuucccagugaauauuggaagaccuaaucucugcaccuuuucuacauguaauuaucauagucacaggcuucucuuucagguauuuuuagcuuuuaaaaguuacagauuugaaucugucucaaucuuucuucucuugagacuaagaucuuaaucuucauacuuaacaagcucauuuuggauguaauucaugucaugauucauguauauuuccugugaagucacugcaaugugcuguaucuuuaugucuucaacuuggagguaugcaaauaucaccugauccagcaguugagaauauuucugaaacauuucugccuugccuuuaggaccuuuguuuuugucauugguagauugcagaagaaaauuuauuuaagggcccaggugagaaaaaaaaaugacagugggcuuuugaacacacaguucacaggccacauaaccagugacacugaaaagcagucauauuuuccuuuuauuccuuggcagguagacaccuggguucauucagcacaaucccaagcauuggcaggcucacaggcuuaaagauaauuuuuugguuuuuuauggaacggagaucaaaacucugaaaucuuccuaucagaauggacugaugagaauucuuagauuucaaaaaugaaaauagagaauauuaugugugguuucaaauccuauaguucugaccuacgcacaucacaaagaaugccccuugaaguuaaaaagugggagagugggagaguuuagaauaaauaaaauaaacugguauuuuaguuauaauguaauacuugcacauguugcuucagaccacauguguagccucggugguuuuguguuguagaugauaaggacuaccaaccaccagaggaagaaucuuugccaaggguggcauggcaagguauccauccaucugcaaacaggguuuugacuauucaguauuugacuaggcaguguuauucaguguaauacuucuuucucuuuuuucaaauguccucagucuucccuguaauaaacaucgguuucugaaaaguguaauugugaaaccucagauaucugaccaccaggaaaugcuguugagaggcuccuuggcauuuauaauaauagcaauaaacucagacucaguaaagaugguuacugugauuucagguuuuggguaaacagacgggaagccacaagaucaaugucgcuugagcaggugcgcaagccagagcaggugcgcaggcagugguucccugauacuaccccccuuucagaauucaugagucucucgaaaggcugacuuagguccguaugcaacaugggcaguaagaauugugagcacggagaagugucuucuccagaagugagguaggauggcaucuacccaacugugcccaaaaaaugcuuucagacaguguccuccccucucuccuguuuuuuaacucauccugagaacucccaagaaauauuauggguaugaaguaaauucaguuacuauuguuuucuacucacuaaaugucucaucuuguuugacauuaguaugugauaccauaugcaaaauugguucggguuuccauuuggaaaaacucugugagaaacuuguuaugccaggaggucaccgugcuucguguggggagccugcaaaugugccccacacuugugccacccacuugccuaggcuggcacuuucuuuuuuuuugagacggagucucacucuuucgcucaggccggagugcaguggcacaaucucggcucacugcaagcucugccucccagguucacgccauucuccugccucagccccccgaguagcugggacuacaggcauccaccaccgcaccuggcuaauuuuuuguauuuuuaguagagacgggguuucaccguguuagccaggauggucuccaucuccugaucucgugauccgcccgccucggccucccaaagugcugggauuacaggcaugagccaccacgcccagccacagucuugucuuaauuggccagaagaguuguacgggcuccugaggcuugggagagcuggauuuaaaauaacaggcuuugauaccugaggcaaaugaugccuuucguauaaaaccguacaacugaggagacaagacaguuccagccacuguggcaucacaaagcacaggugaucaauugcucuugcuccuucaggucugcacuauguguaucuuuuuuuguuguuguuuggagacggaguuucgcucuuguugcucaagcuggagugcaguggcgugaucuuggcucgcugcagccaccaccucccggguucaagcaauucuccugccucagccucccgaguaacugggauuacaggaauguaccaccacacccagcuaauuuuuuguauuuuuaguagaaaugggguuucaccauguuagccagguuggucucgaacuccugaccucaggugaucugccugccuuggccucccaaagugcugggauuacaggugugagccaccgcgcucagccagcacugugcauauccuacuccaaaccccucucagaccaacaccaacaguauucaucuguuuguugacagggcucuuugaaggauagaacuugugucuuacuaguuauucucucccuagguucugauguaguacccaguaguuccuggaauauagaagaugcucgguaaacaucaucugggugauggggguagugauaaaaguauugcauauaauuuuggcuaguuuagaaucuguguuaggcuguucuugcauugcuauaaagaaauaucuggggcuggguaauuuauaagaaaagagauuuaauuggcuuuugguucuucaggcuguucaggaagcauagugcuggcaucagcuucuggugagggccucaggaagcuuacagucaugguggaagguagaggggggagcaggagugucacauagcaagagaaggagcaagacagaguccauggcgagaugccacacucaaccagaucucacgagaacucacucucacgagaacucacucauuaucaugagaauagcaucaagccaugagggauccacccaugacucaaacaccuuccacgaggcccuaccuucaacacugggaauuacauuucaacaugagauuuagaggggacaacauccggaccaugucagagacucaaaaaaacaaaaacaaaaacagaauaguaauuuucccaguuacaugauauucuaaucaauggaaaagaaaauguauguguuuuucauguugauuauucauggagaucuauagguggcucuuugucuaacaagacugccauuggaagucuuccugcuuauggaaaaaugauggauuuuagauuuaaauccccauauuuucauagcuuuuauuccuaaacuaugcucuucauuaagaagcuucucaucauuugugucucagccaaguguccccuccuuggacaggccucccccaaaugugccaccaagcuucacagucacaucacccuguuuugcuuucugcagaagacuuaaucacuccuuguauuuucuuguuuauucauuuauugucuuuucuuugauguaaagcuucaugagagcagggccuugucugcccuacccacuguugugcccccaucacguggcaggcaguagucacuuaucaaauacauugugguagacugcugaguggacagugcuucagguaaacucaugagaaaaggagacaucucaucugugcuaaccuucuuugccaguucugcaguaucaaauagaagucccauucaccacuggaggaggggggacaauauuuuguaauaaagaaaaaaugucaccaacaaauguccuuugcuucugcucccugcuuggccagccauacaaauuaaaaguggugagggguugucugggcuugccuuugguugugaaauauacaccccgaaaccaucucagauccgagagccauuagugccacauuguguggggucucugcaugcauugcguaggggguagcaggcagagaccuucagagcugguuggcuggccugcuccgugggcagccgggcccacucacgcacugugggccacaaagauucauguuugugccuuggcaaaauuaugaauggccacguaucaggaacuuuagaggugcuuaggaauugucagagcuuauuucacucaagacugucaggaaaccacucuauugaguacuggggaaagaugcacacagcugcaggagggaccaggggaaggggaagcaagggacauuaaucucacaucccagcuugugaaucagggcacuggccgccauccccucuguucucauugcauuuuaccccucuugucuacuguguuauuuuucucuuuuccugucuccuguuaucgccaaguaaggaucuuguuguauaguggucuuagggggaaaaguagcacauagaauguguguuaggcuugauuuuagccuucaagaaugccagaagcuggaaugaaggauuguuucuuuauaaacacaaggaaaauucacgaguuggcauuucuuaguaaaacaugaugaacagaauguacuuucuguagaaauggccguguaucugaauagaauuccauuccgcucccugaugcuuccccuccagugagggaaggagggaggacagugcugcagugggcccagauuccagccugccugaccuccgcggcccucacagagcuaugccgcucuugcaccguuucccgaagagcccagccauguggaaaucagugacaaaaguaauugcugccuccauauuuaauuucuuuacacucggugcagaaaacuugccuugagcaaagcagcauaugaguugcagagagagaaggaaguguuuuuuaagugaaggaagauuccuggguuucuuuaccuuucugcuugagggucuuucuuuaccuuucuggaacccuuucuuccuaagcaacugagacaggacccgacagccaguucagcccagucuuugcccaguagggagcaaggaugcuccugggaaacagugagugcugcgugcccuccuucccaccucccacuccugcguugcugcuucccuccucugcugguuaaccucuuggcaaggacaagcacaucacacacagaacaaguagaauaaggaagaaccaguguuguuucaaagaagagcauguggagaagggaggguggaaacaauguggacaauauauccauuacuggguucccuucaaaauagaggcagggaauaauuagguggaauauuaccccaacuucuaaaggugguagguagcauggaaaauuggcguagcuguaacuguuagagaucugguaagagcugcauuuguccagagucucaaaaaagucugucggucuccuucaaggccaaauuuacuagcugucuuaguccagaugccagcauuucacagcuacccaaaaggaugugggaauaaaaauuacaggugcauuugguuaauuaugcccccuuacuuaacauaauugcaggcucaaacagccagguggucauuauuuugauuggucuaauuagucagauguguucacaagcagcugcaugcaguguucugggcagguucagaaaaggcacauuaaaguccaguugaagccuuuuuagaacuuguccucagaugcguaauaaguucuuaacaacgaguauuauuaaugacauaaacacuuaaguaccuugaugagaguuuaaggagaaaaagaaauggaaaagguccauucauagccaaaggaaaaccacccaacauugaauacagggugggugagugguuucugcuuuagccauugauaaaacuaccuuacuaagucagaaagguaauccaaccacuaugugugugcuuuguauaucaaauagcauccucaaucucauguauugauaaaagcaaaguuggucuuacuacauuuuuauaaucaauugguauuugaggcaucucaaguuuguggugcucagcuuagaaguguuccucaguaagcuuuaugaaucaggauggagauuguuccaauacuucuuacagcaacguaaacccugcaacacuuuuaaaaagaggaaggucuccccugaagaaaaugaggauuugucuugcaauagucagaccuggauguacucaaaagaagcccccuggaagaaaaccgcgaaauuacaauaguguacagaggcuugauucuaaucuuccugccaucccugcccuuacaugcuggccaaccucucacuagugcagacucgccugcuuuuuacaaaccuccauuuuuccagcuagaucccuuuugggcaacugcagccucauguuuucuuuuuccauuaagagcaggaaaaauuaucuuggccacuuugggaggggauggugguuccugugcugacugacucacugggaggggauagcauugccugugcugugcuccgacugacugacuccugacugacucugggagggacaguggugcccguguucugacugacucugggagggacaguggugcccguguucugacugacugacucugggagggacaguggugcccguguucugacugacugacucugggagggacaguggugcccguguucugacugacucugggagggacaguggugcccguguucugacugacugacucugggaggggcaguggugcccguguucugacugacugacucugggagggacaguggugcccguguucugacugacucugggagggacaguggugcccguguucugacugacucugggagggacaguggugcccguguucugacugacugacucugggagggacaguggugcccguguucugacugacucugggagggggcaguggugcccguguucugacugacugacucugggaggggcaguggugcccauguucugacucacucugggcuggugcccgugcugugacugaugacugacucucugguuuuguuucuguuuagaugaguucugguucuccgauggguccuuaucagauaaguccaagugcgcagauccuggccugaugccccucccggacacagccacaggguuagauuggacccaccucguggaugcugcacgggcauuugaagguaaagacucaccagccucuggccucaccccuuacccugggagugcuuuccugcagggccugugcggcaucuuaggggagcccgucugucucccaucgucuggucaaaguuuugaauguuuugccuuguuggaugaugaaaacaagcaggggcuggcuugggcugugaggacauuuccugagggagaucaugucauuuaguaaaaggagcacuaggcaagaaaucugaaaacccgaauucuagcucuggcaccauuugugaccugggugggaccucuguuuccuaucugaaaaguagaggugauuguauggagagcaccuugcgucuuuccucauagcauacugagguauaaugugggggacacauuuaggaggcgggagcugcugggcuucgccggacaagcacaggccgagaagucuguucaccuggcguaaacacagacuccagcgugauuggcuugacccaugcaagugucuuuggcuguugaggccucggcuucuuccucuuaaaaugugggucagugaggguaggugggcuagccaaucucuaagagccauccagcugccacacugucuucugucauuuuugguugaggcuaccccuucaggaacaccuuuguccagcucgcagauaaagguagacaaaacaaggaagaugcuugcuucacgugcagccucaggaccucacggugauacuguguaaaccuggggcccucgggaucgugacuuaugacguuuugcccuuugccgcugcauucuucagugaguuuuuacgauggcaggcucuggcacuggggaaccuggcagcuaggacugacaaaggaggcaggaucauuuuaguaggggcuguuuaaugcccugcgcucugugagacucucaugguguaacugagucacagcauccuggaggcgcccgaguccacugcugccuucucaggccucagggcccuuccuucucuuucucacuccccauuucuuuucccuucucagucucugcuagcacagccccaucaccugugacaccaggccucaggaaacaaaaucaaauucuuuucccaggaggggaggugcauuugaagucaaaaugcggaagguugaggguucacugccccucaucugugacuagcguaaugcguuagggaggcccgaugguggcuucgcucuacccagcugguaucagugccucugguccugagccucugggaacaggaguuggaauccacucucaaguggacacaggggaaguaggugaaaggcagcuugcuaggaggaagcuucugcaacaugaaugugcgcucacugcucccuaaauggaaggaacgagacugcuuucuuuacaaaccacucaguccuuguagaaauuucagaagagcccugucugccugucugccuuguggggagacccucauucucugaugcuaccagaaguuaguugcauauuuuagaagccccaggcugguggucuaguuguuuccugggcuccccaugcuucuagcacuuucuugggcaugacccagcaccagagcacagggacgcugucuuuaccucuguccagagcaacccagaggggagguaacaccauuuucucuuucccugggguguucuuuacacacuacagucucucacucugaccagaucuuucugccccaggagagauuagaccagagauaagaucucuguguggccucacuguguaacuaucugcagaguacugaacgcacugaauucugcuucauucucaugccugucucuuaagagaugaguuucuuaagagaaggcugccucuuuuauuauuuuaucuguauuugucaaaaauacauaucaagauaaccaaaggagaagcgcuaguaacaaggaguaaguagguauucaauacacacaguuuuacacagcccagaacuaucccagcucauagcacagcucucaaccucuuauauccuuuugcauuuugugaucaccuuucagauuucaaacaauauuuaucaccuuaucucuguaucuacccuuguuuaugucuuuacuugguucccuuccaccccuuucaaauguuccuucagaacagaaugacugcuagaaaaugcauuuuuuuuuccaggggauuagagaaggcaaaauggugcauggacugaaugaucaauuuagggauuucggucauaacuucagccauuucugggccauaggccuuuggacaagucacuuaacuacuaugacauccacacuuugucccaauacucuucuaggucuuuuacaaauaugaacuuggugaauguuaaauaguaauccuuuuggacaugugcugaauuaauuugggcuucagucuucucaucuguaaaaugaagaaccaaagaaccuguaaggaaagcuucaucuaguccuaaaccucuaguucugugguuucauuaucaacaaguauuucuaagcugaaguaagaguaugggugguaguuggcacagaagggaaaaaguaugacauggaaauucucccuagccagugcccucagguacaugaaugccuaaauuaaacagaaaauaauguaauauucuauuugccaaaggagaagacuuugguuaucugagcuuuaacauugauaaaauaauguggaaggaguuaccacugaccccuaacauugauagauaaaauaaugugggaggaguuagcauugaccucuaacauugauagauaaaauaauguggaaggaguuaaugacguguuuaauuuuugaugcugcuccauaggguggcaugucauggugagacaguagccagcuuaugaaaauuugguugaguauguguaccuccuuuggcuaaucagguucccuuguaucaguguugccucagguuguaucccagugaccugcuccccugucucgugaguugcaugguggugaugagcgugaucaaucuccuuagcacuuuuaaagagaaaugucuucagguagauaacccaguugcccugcucauaacuuuaucuuuuuguaccaguucucaaggccauuucugagcuagaguaaacauuauaaagaaaagauaacccaaaacauguccauguacuuguuuauguuauugcugcaaacuaacaaaggcaguucaaaaggcuuauugccucagacuuccuuggaauaauccugugccccuauuucaguuaguauaucugaaaauaggcuuggaaaauggaauuuaccugccuauuggauugagaucccaugaucccuauaaaauccaauaguguaauugaucccuggcagacuugccucucccccauuagucuaccucguuuaugcuacacauuuuggcauaugauauguucaccuucauuuaagggcuaaaguugacauuggaugcgaguuuaagaauuuagauuuuacuauaccacuauacuauaccaauuuagagcagaggcaccaaauuaagcugucaaaucaugacuacuuaaauguuuaaacucuauucgugcaaggaccauaauaaaugguauaguugugggugagagucagguauucugugcauaaggacucaguaagcucccuccaaaaaggaggcguguuuccagaccacauugcugaccauaaggcagugauaauagaauuaaauaagaaaaagagaagcaaaacacaaaaaucugaccacuuagaaaguuguaaauguuacuguaauaauaauuaugcugggaagaauuaaugaauaugacaagagcaauuuuuuuaggaucaugaaaaagaugcuuuguaaaucuggacuacacccagagagaggguagcuuuuaaagaaaaauauguuucagaagcauuuauuucaauggcaaaaagggaaaauuaacuaacuuaacuguacuuaaaaagauuccacaaaaacugugaaagaaaaacacacaaagaaaaggaaugaaguaaguuguaaaaaaaaaagcaacuggcaauugaaauuacacugcaauuuauaaauaaaacuaacaaccugaguuuuucuuugaauauugauaaaccaauagcaaauuugauccaaaauauaaaaaaguacaaaugaaccauguuagaaaggagguuaaguuaacaugagaagaagacagugggaccaaaaugaccugugcagaacugugccaucucccugcagaggacaguggguucugccuuaccccucaaaccccagauaccucuaggauaggaauguuauuaccucucccuggcuuggauuauggagaccucgugaucuuuuggggucuugcacuccccaccauaaugcaaaccaggccagccugaaccauaaaaucuggucaagacgagacccuguccuuacuaaagaacuugguuuccuguaaaucuaaauauguaaauguacaguauuagcuguagaggcagaaggaaaccugucaaagggcaaucuagagaugcaagcucagaacacccuccuuaauucacuguagcacauacacacugccugcccagcuuggcugaucccaguuguggggcucuuuauuuacccagaaaauuucuuuucugucuuuaaugguauaagaugaugcacuugaucacuuaauuuucugcaaaccuuggcaggcuacuuggcugguuccuucugcacaaaauacugguauaccacccuaaccccuagcuucuggccccaaguggaucucaguccucuauauuuucuaauuaauauguucucugggugacauuuuaaaaaagagacauagagauuuuuuuaauuacuaaggaacgucaaguagcuauauaggaauacauuugguggauaagguacuuagauuauuucuugcaagaaaacguugcagggagcauaagaaacggucaaaggcccagguguggaaggcauugaaaaagucacccaggaauauccccaaauaccaaauauauuaccugaaaauaauaaguuuacaguuaauuguuuucagaguuucaaagaguaaugaugcccuugcguauauauauauauauauuuugaaauucagaagcagccuucuugcaugauaggauucuuuccugauaaacacguacacacaggaaagauaauuauaagacaaucucagucuuuaauauuaguaugagaaagcuuagaugaaauucaguaguaaauugaaaagauuauucauuguuauuggcaagaguuuaguuuaguaaaagaaaaacuuuaauuaaaaaguuacaguaggugaaguaauuaaaagcuauaucaauuugucccaaaaaaguauaucuaauagaauuagaaccuauuucuucaaaaauuaagauuugagagauacccccaaagacuaauaucuacuuuauuucaaaugguuacauaguacuuaauagaaaauguuuauaagcagauugcuuauguccagaaacuaagcaaguguacucuuugagaccgugcccuuuaauuuuuauacuggaaucuuugacauuuaaacaaggaaugcaaagaaaaaaagggauaaauguuggagauaaaagaaauuuagauaggguuuuauacauagaaaauacaaaagaucaaaaugaaguuuaauuagagauuauaaaauagguaaaguaauuagauauuuugaaauauauuuuuauaaguauaauuucaaaguguuauuaauuuuuucaguuaccuauugcuguguaacaaaccacccccaacauuuauggcuaaaaacaacaauagcuuauuauuucuuaugauucucuggguugacuaggcucagcugggugguucuucugcuccaugugaucuuagcuggggucacucaggcagcugcaugcagcugcagcucagcuggaucuggagcauuaaggagauuucacucaccugucugugucuggaauggcugaggccuagugggaccccugccuucaguagaguaguuauauuuauucacaugggggcuuaaggaauuagaagagcaaaagcagaaguucugugaugucuuaaggccugguuuugaaugucccagaacauuauauucaccacguucuauuuaggccaaaguaguucacaaggccgguauuccaggggugcaacauagacucuaccucuaccucuugauggcaggugcacacagggaggaguuguuggcagcugucuuuggagacagcuuuccacuguaauagucacaagacaccuuagauauaucaguaagauugaauuaacauguucuuugagaaguaaaccaucggaaauaugagagaauuccaaggaacgcuuuaauaucugaaaagucuuaauauguaagacuagaaauggauagaaagcuucauaguaaagaugacggugcuuccugaauuaacuuguagaguuaaugcaauuucaagaaaaauaguugaaaaacuaaauuugccuccauuuggaaaauagguaaaugauauucaaccaaaagaucuauuauaacuuaauaauaauuaaaacagcauaauucaaaaauagggauaagaauuuuugaagaaaaauuaagagcucagacagaaaucugaauauaagaguuacauggguaaggaauuuauguauuccauuuggauuuagguauuuaaaaagucaacuuuagaaaaaguaaaaguaagauugugguuuuggaagcaagauuaugcuuuaauuauggaguagugagagaacauacagaauguaauauggucagauaaagguauuuaaauauuuagaauuaugggagccugaaagagaauauuaaaauaaaagaggaaauauuggacuuuaggaaaagauuucuaaagaaugugauagguaaaaccaggauaccuaaaguacguaaaggaacuuacccagcaaaaaaacaccaaacccacaguaaacaaauggucaaggaaugugaauauaaauuucacaaaagacaaaugcacaauaaauaagaaggugaaaaauguucaaccacacauguaaauuuaaagaauaaugaguuaccagcucacacuuuuugaauaugaaaaaugauacaauaacucuaggaagcuaugaagaauacucacagcugguaucauuauaaagauuauaaagugauccaucuuuuuguucagcaauaugauaauauguuacuacugccagaaaacuguacccaccuuuuaaccagaaaucuaauuccugagaauuugcugacagaaaguuauuaaaaagaauuaaaaagcuuccaauagaaaaauauugugcauuuaaaaaaauuaauaagugaucaaauaacauaucucuacccaaacaguuuaaaaaaaaaaaaacaguccuucauaggucuaagaaggcaaaaguaaguuggaugcccugugccucccccaugcuguaaggucaaguuugaaaagcuggcggagucacauuuuagacuuuguuuuaauguaugcaguuauuuuguuuguuggagggcaaaacauguccuucuuacaugucagaauuccuaagugaaauugguggucugucuaguucaauaagaucauaguuuugccacccugcagugcuuaucauacccuuuguuacguagaaucaugucaaguuuggggguaccugauaauguauauaauggcuuucgucccccguuaaacaugguaaugggaacaaacccgaccagaaaaccuggcuaugggucaaacagugaagcuggggaagggaaguggagucucuucaaaagcucuaggauuuugaguagcucucauucaucagaauaucagaaagaggcaguugguguguuuuuagcauuuguugaauggauaauguuguuuucagugaacauaggcuucaaagguaaaaucaccaacuagugauccuagacucuggauuccauguugcugccccacgaaggccuguccuccuagguuuccagacuuccccaguuggugguagagaucgccaucuucccauagcuguuugggagcauggacgugugugugcuccugugcaaauaucaaugugaaagacacaugcagaguuaacaauucacauuccaggcaccacuguggcaaugaaaugcuccacauaaccguauuuuccaaaaauucaaagucuguaucuuuaauuuguuguguucuuuaggcccuugguuucuuaaacagagcauaauaaacaucccuuuuuaugaugagaacuuuuucuguuaugaagcuucagcuuaaaguugauaaaguuguuacaguuauugauauuugaccacuguguguaugagagaguguguguauauaaguauaaacaaaaugugacuuacugaguaacuccuagugguaacauaauuaguggaaaaaaaaauggaaagaaaaaugacuaccacaugggugaaaaaugcaaagucaaauuuggaauaguaaauccauuuaaauuaucucaaaaguaaauugaaaugguuucaggccaaugcaauaguuguuucuuaaauaaagaauaauuucaggacuuuuucuuguuaauuacucauaggcagauacuagaccauuaucuuuuuacaugcauggaugggcuuccaaaagucuaaaccagagaauuuuagguggaaaacaguacagugcagccuuuuuuccuuuccuaguggccaguuaagucaguuuucugcaaugcaauaagcacaggugucagaaucaaaacuuuuaauuuucuacauguagcuacaaaacccuacuuugucuuuaguuugcaguucuaacaaagacauauuagaacagcuuuauuuguggaaauagguuuaauuucaacuagccucguacuuggauguuccaucuggcauguaucuggggcaggcacuaucguucuauuccucacccucaacagacaugacgcguugaucagaccauucacccccaccaguccagccuuggccuuauguuggacagacauaacacguugaucagaccauucacccccaccaauccagccuuggccuuauguucaacagacaugacauguugaucagaccauucacccccaccaauccagccuuggccuuauguuccuggugcugcaggcauccuagacggggucaugggagugacuugcagucaucuguuuugccaucuuggcucuaggauauggaauagccuguugacuauucaucuuguuuaguguuaaaugcacuaaaaauaagaaacugacauugaaauaagguuuuuuaaaagauuauuuuaaaggauggauuguuuugugugucagccaugcccagcguuccaccuuagccagaucugcucacacaggaaagaaaaccgaaggggcuccacguguggagugugggugauuggaucuguaccaaccgugaccacguacaugaagcuccuauucuugugccugucuuuucugaugguuuuguuggugccauuugauucuaucucaguaauugcuugauuauugaauauuuaucaucagaaauaagcugaaggggcaugaagcuuccacuggaaacugucucuaagauuagcuauuuuauaaaguagcuuggugucuguacuuaaucaaauagcauccucuuugcauuucagccucccaagcuuuucaauuccaaagugaaauccuguuugugaaauuacauugcuggcaaaacucuaguuuuggcuucuugccuccugaccaguaggacccuguuucucccuaggggaugucugaaugacugccuguaggaaauucuguuucuguuaaauauguggguauuuuaucaauuaagguaaaaacagaugaaggaagcuaaggcauguucauccauguauuuagacuugaccaccagacccaaauacauugagaaagaaacauaacugaauuaucacuggcuugcauaaaacaaggaugagucaaugaaacuccuaaagaguuagacaaauuuuuauccauuuucuuuuccauuccuuuucuggucaguaaagucacuauggaauaaaaauauaucuccuaaagauuuuuuaaaaugugauguguucccauauucugggcucuuuacagaacagaggguuauguuggacaccacugcagcccagaccuccccacccagccccuagagcagcucaagcccagccaggauucugcccccagcucugcugugcaggucacaucauaguagaaguuggcagggccccaacuauguuguugaucuuaauuaaauagcaaauuacuuuaugcaaaaagccuacuaugcaguaccaaauugguaacaugaugcucaggaauguauaguuauagaauguuuaucaucuuauggaagauucgauguguggagcuuuacagaauuaguugaaagacaucugccugccuagggcagguguguuagcaaauggagccacauggauggagaacucuuaaugcaaucaguagcugggugcacucaggagggcccaggccucugucagggcacugacggugcuuucagcaccauggccacagccuacagccuuggcuuuccuucauauguuccuggcagcuucaaugugaccauccuuuuuaauuaacuggaaguguaugaccugccauaaagcaaacaagcagguagccucauuaggaggcuuguccagcagccagagggaggcagagugggguaaauuaagaguggagcaccccugacacggauccaagugcagucucuccagaauuaaccaauucauaggaaaaggacugccacagcacuaacacgccugcuguauaccucagauuccuacuguagauacauaagugugcucagaaaccaagcagagagacuccagggaaugagggugaauugaucauggaauagauugcgagguucucacuuccaugugguucaaaaacagaauauuuuccugcaugccauucagcauuucuggauugcuguucuuggucagugcucagcccccagagcugggccagucuggcgcccauucuuaagacuauucuauucccuuuccuuccgaccucuuaaaacauugaauauuaaguuccuagugccaagaauaaaaauguccuugugcuaagauaaggcauuguagucauacugaucauuggugcuacugcuauacauacugagccccucagaucuuccuuuaaggguuucuagugagauuacuuagcuaaucucucuuaccaccacucucuuuggauuuguggagugagucauuuaaguaagcccacaguuguguaugcucaugguuggauccauguguguauggcauaccacaugucuuuguuguacccuacagccccgcuuccaaccaacagugaaaacaugaaaugugucaucucauugcauuggaguuacaugauacuggcucucaaggguuuccccugguccaucacacacacacacuacuucacacagccgcauuuugugggcccccgagauucucaaguauagagagauacuccuguucauaggaaaauucuaaaucuuauuucaggucuugacucagaugaagaacuggggcugcucugucaccacacguccuaucuaggugauugucuggggcugcucguuggcuccugauauccuguaaccuuuucuguauauuucaugugucugcacgucugcaugguuauucacgcccugaggguugggggugcacagcgggacauguguccuggcuguucugucuccagaaccuucuccggguuuggggagaacuugagagagaggucccucuccuuuguucugucagucgagucauuauccaacuauuauuucaugcauagccagcagcuuuggcauuucuugggauguggaaagaagaaagcaaauuggcuguagcaaauccagugucugcuaauuguccccauggcugugaugugcauaggccauacagcccaguaggaggacagccaaucuccaugcuuucuccuucucagaagcuugccugaauuuguuuuucuuuguuuugcuccaaaacaaggcaguaacugguuugaaggggggaaaagauuuuauuuagcuauugcauuuccacaaagaaacauugccuugcauugauuacuaacccuucuuucuguguguguuucuccccuccccagaccagaggguggcauccuucugcacccugacagauaugcagcaugggcaggaccuggaaggggcccaagagcugcccuuauguguagauccaggcaguggcaaagaguucauggacacaacuggguaugugagccccuguggaccccucccuccugcuguuccaggcaugauuagccaagauucggcuaaccgacuaacccugagccaggcgggcgaccauauugcaccaugcccuuucccaguccugaagaauccagagaagggacugagugggacuacuuggcucccugcccugcugugggagaccgcucuuggcugcaugaccccucugcuccaugggcacacccugccugccaagacuugugacccugugcccauggugacgagccucacugucaaagagggcaagaagaggccucaaggucagcgucugcugcugaauuacugcaacagcaccaugcagggauaacucgccgauuggccuuccaccugccaggcugcacaugcucaccagcccagggcauggccccucccagaaccugguccuugauccagccucaugcccuccacugaaauauguugggaacaccccacucuuuccccuauauucaugacauguucauuccccgugaaauguguauucuuuaccucugucauccauucuuaauuccaacuucuaugugagcugaauauagaacuuggaauuaacuucauuaacuugcauguucacauugguaacgagcuucauaauauuguuaucauagggaaaggcaaauuggggaaauugacugguucccaggacuucauuugggucuuccuugucuccauuggauaaaccaacuuaaauaauauaucuuuuguuuuccuaccaacucguauaucuauagaguuucugcaucucuuuuuaaaucaguaaagucccagaaugggcuuuccacuagaucagcaauauggacacuuucccauucugacauaauauaauauaucugcuugcugggcucuaagcacaugaaauaauuuuuucgagugaaaacuugaccaacaaaaaugcucgauugacucucuugaaucuuucuaauucuauccuuauuugcuagggagcguucuccaucaccacugaccgggaaagucaaucagcuggaauuaauucuucgacaacuccagaccgaccuucggaagguaaucaauuggaagagcauaaucagaacuguuucucuuauaaaaucagccccuuauaacuacuacagauaaauugaaaagacucaggaaagaaaacugccuuacacaaaaaccaaugauaaauaccaacagaugcuccugaggucucacuccaucugcugaccugcagcugauguauuucauuuugugggaugcagggaucucaauggauaugaguaaaugaggaugagcccuugguguggcaaaucuucaguguguaguagaagcauggugggccagcauuuuuuaguucagugaguuaucaguugcgccaacucuguaugagaugaccucagaggaguccauugcugccagaaagccuggucucuaugaguccuguccucugucuugaaucagcuucacagcccuuagaacuucugcuguacacaucaaccugcacauggucuguccucaaaagaaauuaaauucuguaucccacaaauacuuggcugagcucuguuccaucagcccugugcuggagagccaguuggcuguccagggaaacggaauggggugcgguagcaagcgggagggcaucacaggaagguuuuuguugugaugguuugguuugguuuggcuuaugaagaagggagaaauuguagcuggugagaaugcugaggaaaggauucaguugggagggaaauuaugaugagggugaagagcaaguggguggaguucugaucuagucacaaggagggagcuggccuuggauaggaguagggacagcucauacauaguuaccagaguggagcagaguaugugugcacauguguguguucauauaugcacauguucauucacauacacaggguccagacagagauguuggcaaauuucucugauuguuucuuuucuuucuagucaugagcuaagaguggugggaguauaagaguuuuguggauagcggauaugggugcaccacagcguguaaaccaaccggguuuaggagacuugcccaaaaaaagcuaaagcacguuugaauuuggagcauaaauuaaagcgauaccuguuuuccuggucguguguuuuuuccccagcuugggugaccagcugucccaguuugcccgggauggagaaguuuucuaggauguggaaguuuccauauuagaaccggcaaagucccaugcaagcugggauggcuggucacccuaucuccagcugcaaguguagaaccguuggagaguugaauuuagccaauauuaaaguuuagacgggaaaucaagacgagagagagagagagagacaaggacccuggggcguguacagggcaugaauaaaccaaagaaccuggaguccaggcugguugaagagaaauaaugucacugcuggggaauggcuggguuggagguguugguggacagugaaaauaagaguaagauugauaagauugauggagucuaucauuacuggaggaguggauacuggagaaauuauuuuuaaaagacuggaggugguggucaagaaguaggaacuugaaacuuuuaggaagaggugcagucauugacaauagcaugguauaggauguggucaugggaguggggguugaggagggugggguuugaagaucacugagagaaagcgauggagaggcugaacggccagagugucagauggaauaucucaguggauucgaaaucaucaacacagaugacaggagugggauggggagaaaagagcaaaccagguucuagaaucuucccguaaugaugguuggaacuggggauacaguagauaauugcagccaggagggguagcaggucucaugaccuaauggcacguuuuuuagaggagcuggaauuguaggaaguaguggagaucuggccugaacaauagaggaugcacugucugccugcccgacccccauagugagcugcuggggacggucuccucgggagggagccaggauucacuuagagcacgaagacgaaaggaauuucaggagagacugagcgugcacaaggucuucuuggcagaauccaaguucauggaucacaauaaaagguuugcagggauguggagaggugggcagccgagucgcagcagagaugugcugagcugugggacucagacugucuugggacugagagucguggugaggaauguccggggagagucaguauccagggugggcugcagcugcuucuuagagugaagugagucuauccagggugggcugcaguugcuccuuacagcaaagugaguggucagcucugauucaggccuccucugaggaccagugucuuuugggccagugaccaggcaggugguauugaggagggccuuggaagggcucaggaaacgaggaagccuugagggcaggaccagauaugccaagggugggggcguccacucaccucacucaaugcuccugcacagugcuggggguggcaugugguggcuguagugguugaguuagaucccguuacagaaauaccgauuauuacaaucugacagugaccccucuauucauuuagggcaaggcaucccuuucagcagggggggaacugaaacugcugcuauacauuuuuuuauugcuacauguuggaaacuccagaugugauucuucugaaagucuugauuauuuuuacacaguuuuuaauagcagauuuuaagggucauuauggaaauauaguauagcaggaaagcuugauggaaugaaagaccuaaguacauauuuuauuauaaacauauguaacagcucugcuaauuccaauuuucuacuuagaaaguuuugugcauuugucaaaaggguauuaccuuuaaccucccuguagucucccuuuuuuggauagaggguaauauaaacuaugaugaacacccuuccuauauaaaggcuaucuuagcaccccaugggagcagagugggaugaaagaacaggguguguggaguguucauucccaucccuuugucaucagcaggaaucaggaucagaaaaguccccucacuaaagaaagucaccccuucuccccucaaaaaguacauaaguaaaaauaagaaucaaagauucucguagcccagcuuaggaggaaugaauguaucgaucagucuccaugacucaguuuauuucugcucugaccaggaaaaacaagacaaggccguucuccaagcagaagugcagcaccugagacaggacaacaugagacugcaggaggagucccagaccgcgacagcucagcugcggaaauucacagaaugguuuuucaccaccaucgacaaaaaaucuuagccaauccgcaccucaucaagggaccacugggaaaugccccuugucccuuugaagucacaaacaugugguuuuucugugugcuuucaaccaaucguagauguuuuugcuguuccauucuguguagcaccauucaccacagcaggauagggagccucgacucuuucucgguaaccacggcagagagcagcgccgaugugaagaugaaugaauguaacuccuggugugaagaugaauguaaacccuggcgacaguugagaccuuuuucuuuuagacucugcuaaaacagugcucuggcuugggcuuaccucaagagggaagauaguugaguuuuauuuccuguauaucaggugaccugguagagauguaaagcaauuuaccauaguuugggcuuuaguauuguaaaauaaacaugagaacaaauaaucagacauauacuuuaauguuaaaggugcucuauuuuuuuggauguacaguaguuuuauuuccacagccacauuaccauagcaauaagaaaggaggcauaguacauaguuggaaaagcuuuguggggggauuaaaaaaaaaaaaaagcacuguuguguuuaacacuaguucagaugcaguuaccuuagagacuuauuuauuugcaggaacaaauggugccugaauauuaacaguguucugauuaaaaacaaaaaaaagauacauaugccuuguaaauggcucaccgaguggucaguagucacuucaacucuuaguucacuuuuguauaguugcucugcuggaaagaaaugagagugaaucugcuuacucacuagaacuucccugugugcugugagccagcggaaccacuuguacaaugccagauuuguuuaucuuuguacagaagcuuugaugaagugucuuguauuuaacacccuuauuuaagcuuauuuaaccuuaaauuguuaauuuuauaaaauuugguuuggccugcacuacgaugagggauggagguagcugcaggcucagaagagacugagcuugcacagaucagaccgagaagcagggugagagauucuaacgacuggaugcugcuaguaacacauuguuuguauugcuuuaccauuuuuaacuguuagauuugagaugaacauacauuuugcuuuuuuaauaaauguuuaaaagaaguccacauaagaa

SEQ ID NO: 192005 - RNA, 27850 nt, Homo sapiens
gucgcgacccugguccggaccugaccugaauugcgaccccaaccuggacugcuccccugaccgcaaccccuacccccgcccaccaguauggcccggcacguguuccuaacggggcccccagguaacccugaggggauccccaccuccaagaggucgagggggugggggcgcgcgggcugcgggcgaccuugugcugucggggagggucuccggcuccagggcuccggccucugaaguucccaauuuaaauggcgggcuugguagucugaagaguuuguacuccuucccggaaaacgugauuuaaaagacacagggccuaaaggauuagaacacacuugugaggggguccuagacuggcuucuugaugaagggcagaaaccgcaggggccagcggcagcgguaacuccuacuguaguguugacguuguggucugcacaaaugguauuucaagagaucugcggcaaccgcgaugugaaguggagaugucuaauuucuguugauagucacagguauuuccuuacugugggucuuugcuacauugaucgugcaaaaaaaaaaugguaaauuuuaguuggaggacagcgaaacugaaguuguaaccuuucuuucccaucuaaguucauccccccacccccauccccaucuccauccccacgaauucccuccacagcugaggccagagguggagaagcuuugguaccuacaggagcccuucucagacacucuugcuuguuccugucgcuguccccuccugaugucugucagaucccucaacccuguggccuguggaguucucaucugagaagcaggauagcguugaggucagaugagagguguaggaggaggugcuuuuaaaccaaggcgcuacccauguaucaagcauuacuaaaaaggacagguaggcugcaucagauaggcuaaaaaaagauagaugggcuaagaguggagaaagugauuucuucagcuccuuugcaaggcaaaucuaauuuugaaguuuaguguggguucagauaucaaaggcuguaacccuggaucuagaauucucuuucacuuuauuuuaaugauuauguuuaguuguaaguagcaaaggcuacagcuaauauugcagacuuugggauuuugucaggcauuggaugggggaguuggggagcagggggugaggaggaggagggugguuugagaaaugccugcuaucuaaagucacuccuaaguauugcaaagaacuguuuucugaaaguugguuugucaauccuuuauuugaaacuuggaaugcaguuugauacucagcaggcugaccccaagacaacuguguguuuuauuaauggagguguccuguuaccgugauuguauugauggugguucuuguuucugcuuuaucaaagucuuaccuacacguaguugaaagacucaaauaauucuacaguguagcucucuuaaaccuguccucaaacccacgcaccuuugucuuuucuccuucucuucuuaauguaguuacagcguaauuuucauuagucaauguuuacaguauuauggccauguaaagacaaucacaacagagccacauaguaaucuaugauuucuuuuccauuuauuuauuuauuuuagagacaggaucuugcuuugucacccaggcuggagugcagugaaacaguuauagcucacugcauucucaaacuccugggcuuaagugauccucccacuucaaccuccugaauagcuggaucuacaagcgcaugccaccacacccggguauuuuuuuuuuuuuguagagaccugucucuuguuauguugcccaggcugaucuccaacuccuagccucaagugauccucccaucugggccucccaaaauacugggauuauaagugugagccaccuuacccaucuuuuuuuucccucuucuuauugagacagggccucucucuguugcccagguuggagugcaguggcacaaucuuggcucacugcaaccuccaccuuccaggcucaaaccaucuucccaccucagccucccuaguagcuaguacuacaggcaugcaccaccaugcccucuaauuuuuuuuuuuuccuuuuacacauaacuuuuuuccccauuaggaguuauugucagguguuuuuauuugccuaguuucuuucuguuuucucaauauguucagaccaucagguaaagucuccucucaaagaggucacuuuuuguugcauauccucuuagugccccuggcacuuagcauuuuuuccgauuuccaacugucuguacccaugacucaucuuggagggcuuucucuggucccuggagcccacuuggccugcaaacagagcaggccagaagagccagggaauuccugugcccugggauuagccuucaaccugugauuggugaaaguuaguugauaaauucccuacuuucucacuccucagacaggauaacugagccacuugcccugacuugucccuuaggauuccccaggggguugaagcuccagcugcccccaguggaacuugcuugacagugcaccucaugcugguguccuucccuucccuuucugaauuucuucccugccaguccaucauguugucacugcccagguuaaacuaccugcacuugaaucuuuaucugaggaucugcuuaggggagaaccagaaccaaaauaauuccagagcuuucugaucuguuugugccugguauacagcuaucaucucgaggucuccugaagcagaggucauuucuuauccagacagcauugggguagcagcuuaacuaaugaagaaaaaauuaacugaaagaagauuccuagagcugaagaagccaaaagggacuuugcccaaaugcuuccuauuuauugcucuacuauguucuacacaacauacaguccccacaguauacccuuugugaacaggaauaguuaccguugcuccauuuuaucuuuuucaaaauauaaacggcaauuuuuguuaggauaagaguaagacccauucaguauaagaauuaaaaaaaacaagaaaaguuuaaggaagaaagugacaaucacagggaauuugaacaucagaaaucaacauuguaaaucuuuguucuguauucuucuugacauuuuuuuuuucuguagacacguacuugaccauucuuuaaaaaaaacauaauggaaugguuucugcuauuaaccugcuuuuuccauauauuauuuucauacauuguggucuauuuuccaugcuaauaaauacauauaagcaguauauuuuuuaaugguugcaugguauuucuguguauuuaugugcuauuauauacauggugccaugaguuaacauucccuuacaaucaacauuuagguuguuuucaguguuuugcuauuauaaagaauguugcagugaauguccucuuucacacauuuguauuguugauguuuccugaggaugaauuccuagucaugaacuacagggugcuguggcaggcgcauugaaauugcccuucagaaaagaaguagcagcuuacacauucggcaaugccauuacuugcaugaaacagauucuuuagugacuuuccuaaagcaguuguuacugauggccagggcuggauuagaaugucaucauuuuauguucuacacaguucuaccagcugcaugcucacuguggcuuacuguagccagaauccuguuguguugcuguucauguuccagaaagccaggugccauuauuuuaaugugaagugugaagauagauacauuaaauaagaauaauggaucauauuuuaugucaaggaggcuuaaaagaguggguagucuuagaaauagcaugauuugcaacucuguaguaucucaaaauagcucacuugcagacaugcuaggaguuuucucucucuuuccauuguuggguagucaugaugccacuuacuuaaauccauauugggaacaaggcucauauuuuaaaaagucauggugacagguaaaguccccuguugaaagguauggaccuuaugagggguauagccuuggguaaaauaccuaaccaccauguaccucaguuucuccaucuguaaaauaugcauaaggaugguaauugccucagaggaugguugugaggacuuaaccaagaaaaugcuuccaaagugugcuagaacagugucuggcuccaugacgucagugaugaguauuacuauauuagguagcaccuguuggugcuuacaaaccagugaguucaucagaguagucagcugaccaggcuggauggacaggaaggaucaagguggggaggcugagggggcagagguacauagguucaaacuggggaaggugugggggauaaaggugaagaaaugcuuagagacccuggagaagaugauguuggaaggaguugcuaaccugauaggcuugcuguuaugaaaaaguuugaaagugaccauuaacagggaugcuaaugauauuuaagagacacauuuucaggaguuacaacaauguaagucaaaggaggaacaaagugauuuucccacuguuaaguguagguccguuuguaaucucuugaaagcugaaaucuuaaauucccagccccugacucaagugugaccaguguuacuuccugggcagaaaaaugggaacuguaaaccauuucacaggaugcaaauggcaugggagaauaucaucaggaaccucucaguugauucugggauuguguacgugacaaaauuaacaauguuucacaauuuaaaaauaaaccucaagauaucauucguguuuuuauuaugcuuguuucuacuugaaauuaagcauuuuuagcaccuggagcaaucaaaauuaaauugaaguucauauucauaaauccauuuacagcccauuucucuacccaccauaauugcugccucagaguccacaagugcugugugugcucuaguaagggaauguuuccuaaugggcuuuucuucuuuuuuuuuuuuuuuuuuuauuuuaggaguuggaaaaacaacauugauccauaaagccagugagguuuuaaaauccucuggugugccuguugauggauuuuauaccgaagaagucagacagggagggagaagaauaggauucgaugucgucacguuguccggcacccgggggccuuuaucgagaguuggguacugauauuucauuucugugguguucuauuaucuaagcuccccuuccaucugugcuuugggagcuuuucaacaagagcuaaauucaccaaaagcagauacucuguuggguccuuggaugcccaucugcuuucccuuuagguugagagugucucccugggcacaggguugagccaaauguugucaucuauccucaagaaucuuaggccuuuagggauuucucagagaaagaaaacagaaugaaaccaucacaugaaaaaaguauaagaaagugauauuuuacuuaaaacuuguucaccaagucauaaacuccucucacuuuauaauucuuaguccuguuucuggugccacuuuucaaagacuguugaugcaguagcugcuuggaccuuaagagauagcccugccauaacugcaaggcccauuguuggagguguggacacuuugaacaggguagcucuguucaaagcagagaaaaccugaucagcuuuacagaccaccgcauuuuguguuggucauuuuuaaggaugauuuagcauauguggaaugccagaggcucaguggagcagcuaaaaaccagaaaucaauacaggaguuuuucaacaaagaacauaaugucuuuuccuucagguuagagccuccaccuggaaaacgugaaugccgaguugggcaguauguggucgaccugacuucuuuugagcaguuggcacuacccgucuugaggaaugugaguacgugauuucugcuuuuugaacccaucugcucuuaguguauugugggaauugcuagccauggaaacagaaugccuuuugcucuuaaaggccccaguuuugcauuuuacaauugaaaagauugagucuuaauaaggauaaacaacauaauuugcuaucacucugagcuacagauaaauuccuauaaauucaguacauauaaauauuuuauuuuggaaaggcucuugaugcccagguaccaacauucccaaagauaagucuuuccucugucuucucacagucaugucuuaaccugguuucacagcacaacaaacauuuaggaagagaaaaugucauuauaugaacauaauagccaguuguuauugaaugccuaccaaguacuguaagcaguuaacguauuauauuauuauauuaccuuuuuuaaaaaagaaaaaaacuuuauugacaucuuacggcuucuuucuuucuacuuugaaugccuuuuauuucauuugcuugccuaauuacccuggcuagaaccuccaguccaacauugaauaaaaguggugagaguagacauccuuaucuuauuccuaaucuuagaaagaaaguauuuagucuuucaccauuauguaugauguuaacugugucuuauuuguauagaguuuacucaggcguauuuuguugaggauuucugcaucuuuauucacaaaagauauggucuguagcuuucuuuucuugggauauuguuguuuaguuuugguaucagguuaauacuggucuaauagaguuaggaaguguuuccuucuuuucuaauuuuuggaagaguuugugaaugauucguauuaauuuuucuuugaauaauugauagaauucacuagagaagccaugugggcuagguuuuucuuggugagaagcuuuuaaauuaccaauuaaaucucuccuuauaggucuguugauuuuguauuuuuuuguugaaucaguugugguaauuuguaccuuuuaguaauuuguccauuucaucugaaguaucuaaguuauuggcauauaguuguucauagauucacccauaaugcuuuuuauuuuguaagauuggugauauugucacuucuuucuuuauuuuaguuauuuaaaucuucucuuuuuuccuuggucagucuaaaaguuugucaauuuagaugaucuuuucaaagaaccagcuuuuguuuuauugauuauguaguuuuauguaucuauuuaucagauauuuaucaaguacugcauauacagucaugaacaaaacagacauguuucuacucuuucaaaacuguuagucuagugggaaagguagacacuaaguaaauuuauacuugucauggucauuaaugcugugaaagaaaagaacagggugcuaugaaagggagggacaggaagaacugacuuuagaccaagggaccaggaaagaguucugggaagaugacauuuaaacagaaaggaacaggugagagggcauuggggagagagaguuaguauugggguauuuguaugugucaggguggggaggucuggggagaauauucuaaauggcaggaacagauacauucagaccucagagcccuggagcaggagcaggugaagaagguaaguuuggugagguggggggccaugagaugcagggcucuguggaccauguuaaggaaugugagugucauuuaaucuauuacagacuuacuacuuugauuugugaaaauuaaaugauacagaccugucucaaaaaccaacuauaaacuauccagaguuuucuauggcaccaagaauaaaguccaaaguccuuccaguggccuagaaggcccuguagcccugugauaucuggccuuacuaaccucugaccucaucuugccauucuucagccacacugguucaaucagacuucccacauaugccaggcugaggcccuuggcacuugccauuuuuuuuggugagcacgcugucuucauagaucuuugccucucugcuccuugacauucagagcucagcugaaguauguaguggugguugcccaaaggcugcugaagauuuuagcuauagccucugaggauauccucuaaucucagagggcuggugguaucuuauggucuguuucagcaggggguugugcuucuuggaacccaccaaguucuccuuuucuuccuacgcuguguuuccuccucccaccuccuucuuccccaauuccuuccucuuggaacuuacccucaguuccugugcuggggacucucguggccacuguguuuugcgggagcagagaacaugguacuuuucuuuuuagcuguuuucccgucacauacauuccucucuacuuaaauguucaaaagucaagugaaauacuucaaaugaaauuccaagugaagauucugguuuuaggaacugacugggucaauacaaagaauuuuuuacuuacccugcucagacagaguagaccaaauccugggaggagaguuugcacagguguuuagugucuagaugcaagauuauauaagagaucauaugcugaccagaucagagcauaaaucuguuuuuuaauuaaaaaauaaagaaauacagacuucucccaacauuuuguauucugauugccaaaugcagacauguacauuccauguagaaaaaguuccuggcaggggauuugauaugauuuggcucuguguccccacccaaaucucaucuugaauuguaauccccauguguggagggagagaccugaagggaggugauuggaucaugggggugguuucccccaugcuguucucccgauagugagggaguucucaugagauccagugguuucaaaaguggcaguuuccccugcacucucucucucccgccgccacgugaagaauauccuugcuucccuucugccuuccaccaugauuguaaguuuccugaggccuccccaacaaugcggaacugugagucaauuacaccucuuuuguuuauaaauuauccagucucagguaguuauagcagugugaaaauggacuaauauaggauucucacccagucagggucauggauuucuuuucuggagcagaaauuuuucucccaucauacauauuuuaugggaaugaagaaaggagaaggaacuaguguuuugucuuuauacuaaagaaaaaaaugaaaagaauauuaauuaaaauaauuaggcaacaaaacuggggaguauaaacacaccauuuuugauacuggcaaugaaaacaaccaaguaaacuggaaguguuagaaacccuuuauaaagggacacaguauuaguucauagugcugggaucuaugaaaacacaaauuccgauaauaagaaauauccauuguguguaagaaauuucaauauguaugagugaaagauaguuugaggguuguauguauguguguguguguguuuuaauacuacaaaaaaauaagaaaaaaguacuucucuaauuaggccaagcagggcuaugccuauuugcagguggggaaguaaggauguggcugggacugguugcagcggcucaugucuguaaccccagcucuuugggagucugaggugaguggauaacuucaggccaggaguuugagaccaggcuggccaauauggugaaacccaguaucuacuaaaaacaaaaacaaaaaucagcuggguaugguggcacaugcccgugucccagguacucaggaggcugaagcaggagaaucgcuugaacccaggaagcagagguggcagugagcuaagauggcaccauugcauuccagccugggugacagagcaagacuccaucucaaaaaaaaaaaaaaaaaaaaaaaaaguggccgggagcugaagagcagcuccaggagaggcucaggagggccaggcacaacccagguucaccuugcaaaacugcucugguuauguuucuuguuucuuuuucuuuuccuuuuuuuuuuuugagacagagucuugcucugucagccaggcuagagugcaguggcgccaucucagcucacugcaacuuccaccuccaggguucaagcgauucuugugccucagccucccgaguagcugggauuacaggugccugccaccgcaccuggcuaauuuuuguauuuuuaguagagacgggguuucaccaucauggucaggcuggucucgaacuccugaccucgugauccacccaccuuggccucccaaagugcugggauuacaggcgugaaccacugugccuagccugguuacguuucuuuaggcaggaauggagccugagcaucguggucgcucgugagaaauaaagaaaaauagagugugugugguaaguguucuagacucaggaagguuuuuggaaagccucuaguaggguugacuguuaauuuuuuucauuccaugaguuaacucuuuccuuauuugucaacauuuguuauuuuccugaguauucaaguucuagauauucaugguuaaaaaaauuauaaaaaauguaaaauaaaaauaaaaaacacaaugugaauaacucauaaucuuaucacuaaguuagccaauguuagcuuauuuuguuucugccccuuuuguauaccugguuuauuuauucagucauucaggaucagggaaaauguuauguauaguuucauaggcuugguguguuucccuuaauaugauugagggacaugggaauggucucacaacaugcuaaucuucaaagcugggagauuuuagugguuucauccuauuucaugguaugaguuuucaucuuugauuuaacuauuacucccucaguguugagcauucagguuccguaucaccauuguaaguaaccuugcaacaaagcacccuuuauacaugaaucuuuuucucuagccaugauuguuucccuggggagggucuaaaaggugaagucugagaugguggggugugaaccuucaaggucuugauggugcugcguugacuuugugucccacugccagggugugagugugcuugucuugcugcgcugugccagcccugagcacucuacuuauuuucaacacacugcuuuguuuugauuugcauuuuucaguuacuaaugggguuaaauguuuuucaguuguucauuaaguuuuccuuaauuuuaguuguucauccauugcucuucccauuuauuuucuuugggcuuaaauagauguuuuauaaagcagauagccuuuuuauauuauugauucuguuuuucucaguuuagcacuucacuuuggugauuauuuucccuucaagguagagaaaagucugucccuauuccaaauuuauauaaaauuuuaccuauauauuucuucuucugcaugcuuuuuuuaaacauuuauguuuucaauucauuuggauuauguugaguguaauaugcuaugagauucucagcugauuuucuuccagauauuuagccaguuuacuaaaacuguuuguuaaauaacccauuucuaauuaguuuuuuaugcuuaauuaauuauauuaaaacuaugugugcuuguauguauaguguuucagaguuaucuguucucuuccauugaucuguuugauccuugcaucaguaccauaguauuuuaauuaccaugguaaucguuuuuauuuuucuucuucaaaaaauggccuuguucagaaacuguaguaaugguggcacuuguaauaguaaacuauuauugagugcgaacuacgugccaggcaugaacucacuuaauccucagaacacuaucacucuauuccuauuuuacagaugaggaaacugaggcauagaauggaaaguuacuugcccagggacacacuaauuguguaagugguagagcuggagugaacuauagaaucaagacuuuacuauccauuaaaaaaaaugucuuauauggagugauugggacuauaguuauuuugacauaaagggugucuuaauuuuucagauaaucuuaauucuccacagcccaaaacauguuucucuuucuccaucuguuucuuuaaaauuuuuauuggugagguuauucauagggcucuccuauuuucuggugcuacuggaauuaggauuguuuuuucuguuuucuaaugaucaaggcugauaagauaaugcuggccuuuuucauaauggccuuuuugauagcuacccucaaugcuuuauuaaaauuugaugcaauguaagauguaacauuuuauugauuuucaacauaucuccuacucacacaaaauggagacaauagauuauaauguuuuaaagaacaaaggacaucuacucaaagcccuguuuuccaggugaacagugucauuuuuuacaaagaucugugaaaggaagaguaagcuaaaaucagaacacccagggaaaaccaacauaguuugaaccuuguauuuuccuguuuugauuaaaauaagucuuuaaaguauauuuguuuuugagagcaggaucuacuuuugguucugaaauaggcucugcuuuggaaaaucuuagaaacuuccuuugaaggugagaggacuccugucuagggaaaaguauuuuguuuuuguuuuuuuagacucgaccuggaaguguuccuuaggucacucucaggccacuuggcuuuagaaagaauguagaaaaaccaaguucuagucaggauccauucuugaaagauugacaagcuccucagcauugcuagaauuucugucauugcuguuagcaaauguggcauuugauucuuuguucucucucagcuucuguuucucuaccucauguauuacaaguauguaaugcaggaucagccagggaaauuaaaagcuaucuggcgcaaacagaaaaucaguuuuuaaacugucaguaaggacauuccugcagugaaucagcauaagaaaaugaggugaaaauucagcaugagguugacucugcaguucauuuugcaagauuugucauggcaaaucuucauaauuucuauugagcagagacugagacuuuauuauuucugauuguuggcgagauucuguggauuuagaugcuaagcaggcuuuugcccuggguuaugacaccuucaugucuuucuucuugcaguccacucucaagaaacacagaaaaguugcaugcuccuuaagucacacgucccuuaagcuggacugggguugaguuuguauaaacuguugccguuuuucuuuuucccucucacuuugucccauuuccagcauuuccuucugucucgccucccgugcguaucagucuaaaaccacacuccauuaggaggaaguucauacggggugaguugguuguuuucuugagucugguacugagaaaguacauacguguguguuuucuuuuuuugacaauuuuuuuaacuucauuuggauaaaauuuuacucuuagagaaaguuauaaguguaagaauagugcaagaacaccuguauacucucauuauccagagucaccuauguuuaucauuugccuuguuugcuuauucucucucucuguguguguguguguguguguguguguguguguuuguguguguguauaaauauauaagcuggaagggggugacuauuugagaauacguugcaaucaucaagguacuuuacuccuaaauguucaguauauuuuuccuaaaaauaaggauaugcuuuuacauaaucaauacaguuaucaaccucuguaaaucuuacauugaaaaaauacuuuaaucuaucguuaguguucuaguuucaucaguugacaauauucuuuguaacauuucuuuuccuccagauguuacacuuaguugucacaucuccauagccuccguuaauuuggaacauuuccacagucauucuuugucuuccaggacauugacauuuguaaagaauauaguuccaauuuaaaagaacguucaucuuuuggaguuuuucugauguuuccucaugaccaaauaaagcuggaauacuccauaagucauaagugaugaugcauccuucucgaguaucucaucuggaggugugugauguuuagugauauuaauuuugauuaccugaucaaggacuuguccuauuucuccacuguauaguuacuauuuuuuucuuugacacuaaugagcagugaguggggagauagugugagaccaugcacauccuccucaucagauuuccccuagccaauucuaauuuuaucuaaacuuuauuagaucaucuuaagauaaaaauaauuuucucuugaggccuuaauuggcaagcagauuuaacuacucucuuuugaaauuguuucucuagcaaggugagcaguaauuaacaaacauaaaauuacuauacauugaagcugcacuaaaaaaaaugccauaaugguuaagcuuuuuuccacucuaagcugugcuucucucuauuuguauccgguuaccuccccauuagaaaagccaucaccauuuuauuauaggaaaaacaaucaguucuuucuccucaggcaguuucuaaugaaaacgguaucagguaucagagauacuaaacauuuaccaaaagcuuaaauauugaugaaaauuuuuacuaagcaagugaaauuuuuuuuaauuugguuuuuguaaacacuggcaggaagguggacauaucaggauaccuggucauaacucuuccaccgucuucucggggugugcuccugguagaggagagaaguccuuuuacuuuaucauaucugccuacugcagugggccauucgcuauccauacuugaugaaauaauuuuggugauauuauucucagacccaaaauaugaguuauuuucgaguaauuuagagcaauaugauuacuccaaauaaauugagguuuugugccuaugccuccauagaucccuaaacaccagagugcuauucguucuuauuggagaggaaagcaguuucuucgugguuaggucaguuuccuagaugcuauucuuuauuucagaaucaaaguguggaggcguauugcacacaggguguggaagagagcuuugaagucaggugaucucugguuugacuccagcucugucacugugcucucagugaguuuugaguaaaucccuuaaugccuaauuuccuuuccucaucugugaaacagaugcuguuaccugcuaugugaaguugcugggaggacugaauguaaugcuuguaaagugccuuggccccuggcuccuaggaggugcucagcagagcaauagcagugauuauuuucuugagaaguuaauugaggugguggauggcaguaccuugagaggagccucccuucacaauuugguuuguguuugccagggagcugggguccggagugggauaguaaucugucauggagucccaggagcccaaaugugcaggccagucccaagugcucagagcaugaggaggacgaggaguacugggcucuccgucucacuggacugacugucagccaggagguguuguuucagucccaagauagcuuggaaaaccccauggcuaccauucaagcgcucuucagucgggugaccaugugggugagccccugugagucccgagaggccauuuaggacauccaggaagagccucagagcuagucugucugugugccggggugaggaucucuggcauguccgggggagcagcuucugcccggaguauucuugacuggggaagggccggguuaccaggcgccaucgggcagucuagacaccuuguccuggcuaugcccuggagacucacaguccauaugccaccagacagcaaagggauuaugagacuugaaggcuuggaauaaacacacauaaaauaugaccggagcccugcauuuuuagcuaauaacuucagugggugaggaauugugggcuggcucagagauggcugcuguuagcaccauuugccuuucugcuucccuagaacuugcugcuguuuggcgaagggcugcaguuuugcugccuaacuucugagagacacuccuuauucacuuucaugacuuuccauacuugcugucccagguggguaagcucaggagcuagucugugugucugauauuaaaauaaaacaauccaaacaguccuccuaaaauuaacauuaauaccacuggaaacauuuauuaugcaaauaauucagaauaaggcaaagaccacuuggauuagcuugcucucaguuugauauuuugguuaaaugaaauuauuuuauauuuauauguucuuuguauuuuuaaaaguacauauaaaaauaaaggacccaaaaaaaucacacuauuuucaggucucugauauaacugguacgaagauauuuguuguucuaaucuuucuggaaagcaaacuaggugaguguaaccaaaguuauaaaauuauucguagcuucucuuaucccuggcuggucaauuuuaggacucuaucuaaggaaauaucuucucucccggaacagggaaacuaaaagugcgcuucauggcugaacauuuauaaucagcugaaguggaagccugugagggguguggccaggaaggcuaguguguuacauaggacugagguguggcacuaggaagcaaugcugccuggguuguucucugaggagaggcugugaggggaggaaagggugcuccccaguugguguguacaccccagaugguguguacaucgugauucugaccacguggcugagagccaccuacaguuuuuacacacuccuuacuccagcagcuguagguggaguuucucugggagcucauuaggacucuccucacacuggggguuggggagggguuccugaccaucuucaaaccugggccccuauuguucuaagucugugucucuaucaauuuagaacaauguaaagggggugaauguuuguuuacuuacuuauuucuuuguuucccucuaaaguugcuugaauuuauauagaaauaaaaccauguuacacguuauagugguucuuuuuuuaagaccuugaguguaugaucuuguacuauuuagaaaagcaggcugagugucuacaugcuucagaguggcucagcagcugacaucuuucucucaacugaauaugaauaacuugcauuuuuaauuaaaaaucacagauuuauuuuugagauuccugaaguucuuggauuauaaaauuccccaauucuggacagauugaggauuuuauguaagcuaagguuuuaaaaugaggauuuccaauugguagaaaguaauguauacauguguguccaaauucuuuugugcugaaacuuaaauaaauguugaugagcuuucacuggugaauguucuagaggauugcaggaaggcugguuguugaagagccacacacuuucuaccuguacguguguauuuacacauggccacgugcauuuuacuacccucauguauauagucaaauaaauacaugugcauguguacacacauucuuucauaucacuucuugucugauuuggcaccuuccaaaacucauuuugaggugccagaauaaguuuuauuuuggcuuuuagaugacagccuccagaggaauggcauccacaauuacucuucgucucugggggcagcaaaauguccacagcacuugggaacagucgggucaguuggaguggcaugcccccaggaagacagaaaccuucuuguacaguugucuguuuuuauuaucauagacaggugguugauagcuguuuuauuucucccaaauauggcuuucguuuuggaggaaaaacuuggaauaaguagugacuuacuucauagaugcucugcccuucuccccgaccccaccaguggagggugacauugcuccuucagcuccccacuucucagcucugggacaucggugaguuccccaggaaggaugcggacgaggacaaccauguaccugcccuaaguggggagaccaggcguguguacagauaaacuuaauagagaggcaaaaaugaagcaugucagaaacacagaagugcggagauuguucagaccucucuugggugauuacaguggacuccuuauugaucuuuuagcuaauaaaaugaauggaaaaauauuucauaaguguacaauaugcaguaggaaaauagaguacuguuuacuuaaaagucugaaaaacacugcuguacugcuuccgugcaaucacaacugggguuuagacacccacuaucuuaucuugucuauuccaaaaggagucuaacauuuguuucugacuccacagccagcagucuuucuagcacaacuugugauccucccuggauuagacucuuucggcugugggagaagauucccaccucugugugugccuucgaaggccuuuaggaucugggcccgcagccccgucugucacuggcugccccugguugccacugaucccuaccaccagccacacuguaccauaugcugcuuuggcuuuuggaauuugaacaaaaucuagcuuaacucagacaugcccucuaggacuauauugcugucaucauuuaaggaaucagaacuguagugaagaauacuuuguaaaucagcuuuacauacaguuuucaaaauaaucauguauacaaacauauauaagguguauuugucauucaccauucauugaaguguuuauuacauguucuguuuugucccucccagggaagaaucaaccaaaguccugucagccuuccccaggaaggcuuucuauagaggacauguguguuaguuauauguugcuauggaacaaguuaucucaaaauuuagcagcuuaaaacaacaaacacauuauuguacacaguaucugaggaucaggaauccagguacagcuuagcugggguucugagguugcagucaagcuguuggcuggggcuguggucaucugaggcuugccugggagggcccugccucuaagcuugcucaugugguugcuggcagguucauuuccucuuggcuguuggcaugaggccucagugccucaccacguggaccucaccgucagcugccugaguauccucacagcauagcacuucucuucccccagagugagugauucgagagaggggauccaagacagagaucaagcuuuauauuuauauacaaccagaaaauaaguggcacccaaauaccucaggcuuaaaaaaagugagacagcaagcaugggagccuuuguugauaauaauggccucuuuuuuccauuuugagccauaugagauucccuacgugcugggggggagauaacugcucuagguagauguuuguguauuucaugaucugguccauaagcguuguuggaaaaaagugaaaauuaaaaggaaacaagucuuggcuaaaggggaaaaaaaaguaaguacaauugcauccuuuagaucucagauucucuuucucaugacuuuauuccaauuuauguccguuacuuccuugaacaucccacuggugacaggcauagcugccagcuuccaagaguccuaaugauucccagcuccugggacucacccuugugcaguccccucccacacaguaccagcgguggucugugggaugcugucacuuuuugaaauccaguaaaaagguuucugucuuuuuuaccucauuggugagugauuggggagugggacccaugggcccuuugauuaaugugacucugaugucccagugaaagucuuugucauucucaggccgacugcagcaguggcccagggcaaagagugugcgucaucgaugagauugggaagauggagcucuucagucagcuuuucauucaagcuguucgucagacgcugucuaccccagggacuauaauccuuggcacaaucccaguuccuaaaggaaagccacuggcucuuguagaagaaaucagaaacagaaaggaugugaagguguuuaaugugaguacagccaguccuccauaaucaguggaaauggagcagaugaucuaaaauagcagauggcucuaaaauaucucuuugguuuugaguuaacauuuuuucccuuccaugcugaaauguaggugagucuaauuuucuagaaauguauagaacuuaaauuauaccucuacuugaugaaaaaacaaacucgcuuaugggggggccuccugacggucccaguuguucuggcugcuuuuuucuuccaucuccucaccagacacuaggaccucucuggcaucagaauugccugagcuaaggugcuuguucuaagcuuaucucuucucagauugaaaggcgccagguugggauacagaggcaaauauuuuuuguuuuguuuuaaagauuucccuuuuaaagcugacccacuugugcuuguggggagaagaggcuguggauguguugggagacacagcuuccaggugcugaagagcagcaccguccaguugaacuucccaguagugagggaaaugugcucucugcauugcucagaacaguagcgacuagccacaucucgcuauuuauguuuaauaaauuuaaucauauuuaaauugaauuauuuauuuaaucacauaaauaaucaaauuuaaauugaauuaaacauuuggauucucagucacacuggccacaucugaggugcucuguggucucguguggcugcuacauucacuagugcaucuguaggaugugccacucagugugaggcuugcagaauggcagcaugggcaucaccugggagugggccuugcccugguccaaggagucaaacucugggggauggccccaugaucuguucuggcaaguucucaugugguuuuuaggucccccgcacuuugagaagcacugcuguagaccacaugugagagaugaggggcuagggcuuguugaccaguggcagcgucugagccagucggaagggacucauggcauugcuggcacuuugucuaaauucuugccuuucuuucccuguugucccucuguuuuccucucagucagauauugcuucuccccaaccccuacccuuaguuucuuugagucagugguagcugugcucuuggcugagcucugcucacacaccucacuccccacccccaguuuaaaagcucccuggcccugcaagugccaagugaacaagucaggcaggcagggccacuccuaucagggggaguggagagugaguacccgugagcaccuuccucaugaucauuuuaaucacugagugaaaugucaccuuggcccacuggcaguauccacauguugccaccaaagaauccuggaguauccacauguugccaccaagaauccuggaguguggugguaaacagccauuaggguuagaccagccagacuuggaaaaauguaugcgcuucuuuauugauuuauuuauuccuucauuuggucaauagugauugagcaccuacuguaugcuaggugucauucuaagucuugggauacuguggugaacgagacugaccaaggcgcugcuuucauggagcuuacauucuaauggaggagcugaauaccaaaaaugugaacagauaaguuaagcaauuucagauacugauaaaggcaaaaauaaagaaaccaggcaaugugguaguugggggcaggaguagcaagggcgaucagggaaggucucuucaaggaggugacauuugagagcccugaaaagucugugggguucuucagaguuucaugucgucuucucuuauuuuacauuuuugguugugauuauagaguuuccauggaaaucaaggcaaugaauagugaaagaucaugaaagaaaauuaguuuugaggucagauagcuucuaggcuggaagaccgggaaauugcuaguguuagacuccagggauuggcuaguuccacaaacuaaucuaaucuaacaguccuaaggaaggauugaaaggagcugacugugaugcccagaaacagacuuugugucuuaggaucauaccacauuucuuccgcucucugagacucaaaauuauucuccaggcaagauaaucauugcuucuaaugaucuguaaauaaaacaauuagcuuugaguuaauuaaguaagagauaggggcugacauacccuguuuuuuuuuguuguuguugcuuugggguuugugugguccuucuguuucaguuuuauuuuauuuuuuauuuaacuuauuuuuuugagggggagggacagagucuugcucuguugcccagaguaaucugugcugggauuacaggugugagccacugugccuggccuuuuccaguuuuauaaaucaagaaccucauuuucuuuuuuucugagacaagguuagucucuguggcccaugcuggagugcaguggcaugcucuuggcucacugcauccucugccuccuaggcugaagccauccuccaccucagccucccaaaaagcugggacuacaggcaugugccaccacaccugacucauuugugcauuuuuuguagagaugggguuucaccauguugcccgggguugaucucgaauugaagagcugaaacaaucugccugccucagccucucaaaguguuggaauuauaggcaugagccacugugccuggccaagaaccucauuuucuuuaucugcaaacuuagguguuggauuagauauauuuuuggguucuuuccauugcucacaugcaauaaaguauccgaauccauuuuugagagugcccuucacauucaguacuuaguccaucguuuaggcaccugugaggcaugaucucugcccucaagaaaaacagaccauggggcaaucaaaaucuaggggcagggaagggagagaucuaugugagcagugguaguggagagguguccaaaggaagggguucuugaguuggcucuugaaggaggaaaugggaaaaagaagggagaacauuccagguaagaaaaugagcuaugaaaaggggucagagucagcguccccuugcuaccagcugaacaugcguagugugaagaugagacugagcccgugauaugggggaaauguaccacacgaauuaguaauauuaucuagacuuauucuucacaauguugggugaacagaguacuuuccaaugaauaugcauagugugaagaugagacugagcucaugauaugggggaaauauaccacacaaauuaguaauauuaucuugacuuauucuucauaacguugggugaacagaguacuuuccaaaaacacccgagaacucuuccaguuuuagacaagauagaguagacacacuuguguuuauuuuuccugcuaaggauguuauuuauaauacaagcauaagaagaccugaaaagugaagagaaaaagacagacuggcuaggaaccuaaggaccuaaggaacaacacaacagacacaacugaaaaucauuugucaugccaagaaucaggaauaccuaaaccugagugaggaaaggccaucagcagaucucaacagcaaggugacucagauaguggaauuauagggcaaggauuugaaaacagcuaucauaaaaaugcuucauaaaauuacagauacacaugaaacaaaugaaaaauagucucagcaagaacuggaaaguuucagcaaaaaccuagaagauagaagaaucaaaugaaaauuuuagaacuauacaauagccaauaaaaaagucacugaaugggcucaucagcagaauagagaugacaggagaaagaaucagugaacuugaagguagaacaauagaaauuaccugacaaagagcagacuuaaaagaaaaaguaaugaacaaaaugaacagaguuucugggaccugugggacuauaacaaaagaugugacauucacaucauuguaguaacaggagaugagugugggguugaaaaaguguuugaagaaguaauggcugcauuuuugucauauuuggcaaaagacauaaaccuacauuuucagugaaccccaagaggauaaacucaaauucaugccaagacauaccauagucaaacuuaugaaaauuaaagucuugaaagcagugaaaggaaagcagcaccuuaccuauaggguaaaaacaauaugagugacagcagauuucucaggagaaaccaugaaggccagaaggaggugguacauuuuccaaguguugaaacaacugucgacucauaauucuauaagacauucacagaugaaggaaaacuaagagaauuugucauaauagaacugcucuaaaagaauggccaaaggaaguucucuuaucagaaaggaaaugguaaaaggagaccuggaacaucaggaaggaagaaagaacaaugggaagaguaaaacucugagugaguguagugggcuuuucuuccucuguugacuuuugaagaauuauguuugacaguugaggcaaaacgauaacauucucugauguguuaaaaaaaauagcugaaaaaagaaaagaaagaacaguaccugagaaggaaaauaaaaucucacugauacaaucuuuggcaccuccuauuaccuaguaaagcaucaguagaagaaauuggugauggaguauuuuuauucaucuauuugguaaauauugagcacgcacuguaugucagguacuguucuauccacuggaguuuuagcagugaacaauagagagggagaaccagacaucauuuuaucaguaacccaguccugccauaacucacucccucccacuauaauggcauuaauccauucaugagggcugcccccaugaccuaaucaccucuuaaaggucccaccucuauuugcauggggguuaaguuuccaacacaugaaaugugggggacacagucaaaucauagcaggugacuuauggguucuucaauaauuuguuuuucagaacucuaagagguuauuaccauuguaucccauugaguuuuaucccauuguaucccaaugagugugucauugauugauuuugcugccuucuaguuaaugucauaacauugaaaauguuaucaacaacuuuaguucuuuuucaagcuggcagcuucauaguaugacuaagccucuuguuuagaccuuggggugcacauguucuuggcagcagugaguggauauuaucugaucuuccaggcugcuugcaugcuaccucacugccuucuaacuuguuuaauaugaucagugucuguaugcccugcucagucuccccuucccgcuucuugauuguuuaaauaagaaguugagguggugauaucacaaauuugucuucucaucugguuggccuagguacggcgagagacaguacuugacucaucugcugggcacagaugcaguaccagauacuggguccugcuuauguucugacuuuaacaaccccagaccugaaaacauggauggagcaggcaggggaagaaaugccucuuaguauacaacuaugugcaagaaagcaaaacaaaaccacaugcauuuccuugaaacugugggaagggcccccaacauuccuaauaagcaagggauuggaucuggaggucacaggaugaaugagauguggccucugaccccauggugcucacagucuuaucuucacugugcccaggauaaauucuuaccaagggccccccuacagccacugggcaggugcaaggguucagguucacucagcuuccuuucuuucucuuaaggcuccagugcagaaaaaaagaaugguugggauuacuuucuucuuucugcagucuucuuuauuuccuuuuccugcucccagcucccaguucccucuucuaauuagcuucucaggaaaggcuuucugcaaccaaaauucuggcuguugaauaaaaaguagacuagaauuucacauaaggcaaagacuccugagguuggcagaugcugugauccuuguucuugcauuugggagugugcuuuucucaacagggaauaucauaagugaauacugcagagaguugcacaucaacauuuuauugcauaauuuucagaaauaaucuuagggaaaucaaagggaguaucaaaauauuaauauuggaguguuugcauucugcucaauuuucaaauuaauuuuuaauuuguaauugauauaauguacauauuuaugggguacagugugauguuucagugcauguauacauuguauaaugaucaaaucaggguaauuuccauaucugucacuuuaaauuaucauuuuuguggugaugacauucaaaaucuucucuucuagcuaucuugaaauauacacuaccuuguuauuuacucuguagucaccguacugugucauagaagaccagagcaaauucuccagcuguguaucacaguccacucucacagagccuggcuggaggcagaagcuacugcaaucacugcugaacucagaguggaagaaaagggccccuguggugcccaccucugugucgccuccuuucuaccucagguggauuccuugaaugcaaacaacaggaauggacuuuggcuaacuuaagugaaaacagcaucaaaaagccuuauaggcuuuggagcugucccaugaagccaaaggaaaagcugacuguccucauuucaaguggagccacagccgcccaggauugacgcagccaggaccaguagaaaugggaucacaggauugacgcagccaggaccgguagaaaugggaucacgggacugacgcagccaggaccaguagaaaugggaucacgggauugacgcagccaggaccaguagaaaugggaucagcuucuggcacuugcugcgugagcucacuccucuuggggugcagaucucagucacuccucuugggguacagaucucagagaaguugccagggccuggcuugcccacuuguuggcugggggcaaguuuccuagaccguacagucuccuaaagacaaccagagcacucuuccaagaagggugagcaggugccaggaaccagaauugacgagguccgcucugcaucuccucuucagacauguauuggcaccuauuguaugccaggcccccucuucagauacaaccacccugaaccucagaaggcuuccacaugcacucccugcucuuaccgggaaccuuggcucagccccuuuuccaugguucaccugucgaaauuacauccaggcuuaagcaccccuggaagccuuuccugccccugaccccacacaugccccuguuccugccugccccccagacuccuucauuguccuuguucaugccuguccuguccuggucugcgagcuccaugaggucaggguccuuaccuguggugcuucucuaugcgcaucucugugccuggcuccuguuugcccuuccaccccaucagcguguguugaguggauggauauuauaugggccaaguaggaaggcacugugaugggagcagagauggcccuuccuuuacccuggggcacucgggauggugugguagugaaagaaaaauaaacagaucaucggguaaagcucuggugaacucuuuguugcuuuuguuugauuuuguaaugguguaaguguuggagaacacacugcagucaggaggccugaguaacagucuguacggaggcacccucacgucucuggcucucccacuucuccauguuucaaaugagcacuugauguuuguggagaggcggguagaugacugagcaucccagaauccugggcgcuucacugcugcucugcugggugcccuccugggccccgcuggcucccaggcucuccuccucgcuucacuccaacaguugaguuccuuccauucaggacaggucgugcucagggguccugugugcccaucauccgucccggugugccucgucggacucacuucacagcucuccccaugguuggcugaaaucugucugggcuccaaacccacuuugacuuuuugagcugucacuuggcagaaacugaugcugggacucggugauuccuguccuguuucugagugcuccugaagagcugggccuccugccuggguaacaaaacauaccucacccucucccagccuuccaggcguuucuuuuagagaguuaccuagcacaagauugaagaagaggaaaggagcucugaagccuguucucucacuucuucccacaggucaccaaggaaaacagaaaccaccuucugccagauaucgugacgugcgugcagagcagcaggaagugaagacacgugcauuccugccuuccgugaaggagugcccaguucaagaggagccugauggagcccugccugucgaggcuguaugccuaugggguuauggaaccuugugggcuuuucuagagaaaacucaacagcuguuucccauaaaauguuuaaaagaucaaauuagccuuaaugcuggauugucuguacaagauuaacuauccauuguggcuuaucuaugcuuaaagauuucuuguuuauuu

SEQ ID NO: 192006 - RNA, 10367 nt, Homo sapiens
ugcauguguuuauaacagguuuuacuuuuuuucuuaaaauagagauuucuuacuaaauaccauuuuauuucauuucuucacagaucuucugguucuugaucaucuuaauuaucaagugucguauauagggaacaaguauugauguucacuaugauucaaacuauuacuguuccauagucaguggagcuuuuucaauguccagaaagaauacuuucaaucuuuaugaacagccuaggauuuugcaguuguuucugaaggcucaaauuguccugcuucaaauuuuucuuugaauuuuaaguagucucuucuuuuaucaaaauauuuuaucuguuggaaaaaaaaaggauuugaaauaagggcaaguuaugcagcuuagauaagcaaaagcacagauuuaaauguaacauauuauucaacauaaauuuaagugauuuauauucuagaaccauuuugugugugugugugugugugugugucagcuguaacuaugaaugauguuuuucuuuuuuuuuuuauuauacuuuaaguuuuaggguacacgugcacaacgugcagguuaguuacauauguauacaugugccauguuggugugcugcacccaguaacucgccauuuaacauuagguauaccuccuaaugcuaucugucccccccuccccccaccccacaacaggccccagugugugauguucccuuuccugugauguguucucauugucuagaaccauuuugaauugaggcauuugaugaaaaagucucugaggagaguacagaccagugaauccuaauccuuuuuggauuacagaccauacugagaauuugaauaacucaggaaccuucucaagaaauggacccaugugcacacaggucaggcuugcuggcgaguucagaguccacagagcucucagguaggucagaaggcuucaaaugagaacacauuggaccauuuuucuuacuucccuucccuuccuuccauucccuucccucccucccucccucccucccucccucccuuccuucucucucucucucucuuucuuucuugacagagagucucgcucugucacccaggcuggagugcaguggagcaaucucggcucacugcaacguccgccucccagguucaagcuauucucuggccucagccucccaaguagcugcaauuacaggcaucugcuaccaugcccggcuacuuuuuuuguauuuuuaguagugaugggguuuugccaucuuggccaggcuggucucgaacuccugaccucaagugauccaccugccuuggccucccaaagcgcuggcaggcgugagccaccacacugagccuggaccauuuuucuuaucaacucuaaauucaucuucauugucagaccagaaaacacuaguucuuuuguuaaaagccuuucuuuggauuuaauucuuaaauauuucaguggugcucguaaguaaaaauuaucuuggacugcaaauguaaaaaucugcccugugcuguaucaaucaagcuaggauaacagacacacacaaagucagcugaaaggaaacaugucucccgaggguguacgacagccacggagugugcuaauagauccguuauuugagugauuacugcuuucuuauucauugggaaaucuuguucucuaaaaucauuaacuaccagaaauuugcuguuugaagucugaucuguaagaaggaaacaucccacuuuugucuagaagaucuacggcgcccugacacagaagcagccuugaucuccaacccagcuccaggaugucaaauaacauuucucaacaugaacaugacacucaaucuuuuaacuucaaagaaagaaaacccugguccacuuuucgauccagagcugacgacgacaccuaugcuuuguacugagguugucaaaacaccauuucauuuaaauuuuaccuaaacuccauucuuccccuaaacuucuaauaacucucuuuuucuuuguugguaagaugcccacaguucucugguguguggucuuccugguuauaagcauucacaaaucagacuauacauucaucccugguggucucaggcugauugggcuaggauggauguuauauaaggauaccaaaggaagaaguggacauugcccuuaacauuuuugugacaaauuaauagauguuugcauguccugucacaucuccaacugccuaagacaacuccauuuagagguccuacugauguugcagucccaacuuguccagaacuuugcuccucuccaaacauguuucuccucuaauaccuauuucaaugaacgcaucacaucuaccuagacacuuacaucucuuuucccuucuucacugccacagcacaaacccucaucauuucucacuuggguugcuguaacagcucuuucacuggcuucucuauuucuaggcucaaccauccuuaauucaccugucccaggcugccagaguauaaucuuucugaaacccaaauuugaucaggucacuugcuuguuugaagaucuuucaagguauccauauugccuuuaagguuucuaagacaaacgaggccacugauggcuucaucccugcgccccuguccauccucucugaauucaccagcagucccugaacuguuuguccuacagagcuaccccaugcucauuuccugcgcgucuugauuccaugccuuugcauauuaccacauucugccuggaaagcucuccucccuagccaucaccuucucuuucaaccaacagccuaaacccucaacacacgguccuuucucuaaaaggcuaaugaaucaacaaggauucauugagaaauacuguauacacauaugcgaguggucucuaaaccacugaauaagacccaggacaguagugugaaugccaaaauacugggauuucugagacauuucaaaguuuuauagaaaaaagacaauauaugaauuugauauuaagaucaaagaucuuggauaucugguugcucuguuuguggaacuuuguuagaugaugcuagaaugauaggccugaucccugcuccuaaguuaggaacaauaggagccuuuuauuuuauuuuauuuuugagacagucuuacucugucacccaagcuggagugcaguggcgugaucuuggcucacugcaaccucugcuuaccagguuccagugauucuccugacucagccucccgaguaggugggacuacaggcgcgugccaccgcgccuggcuaauuuucguauuuuuaguagagaugggguuucgccauguuggccaggcuggucccgaccuccugaccucaggugauccacccgccuugggagugguggcucacgccuauaaucccagaagacuuucaauaggaccauuauacacaucauacugaugagugcuauaaaacagauaugugaguacgagagagaacuaauuuguuuugguaacagcuaccauauuaguuguauggcauauuuauuuuguaauaagcauguauuuuugguguuuugggauagaauuacucaaucuaaaucccaauuugguggugcuauuuuuuaucuuuauuucguggcugucacaucagcuaaguaaaagauccaaauuuugaaaucauagacauucaaauccucucucuacuacuuuacugguuggcuggucuaagacaaauuauuuuaccuuucugaaccuuaguuccuauuguauaaagcagauacaaaguaccucacaagacugaaugaaaauuaaaggcaacaaaaacaaagcaucucauucagaaugcacucaaaagagauuuccauuuacuugcccucccgugugccuccccacccuuaugcacacauaucucuggaaaaacuuuucagcuuuuauucuguggcaauugaguaggacuuugacaagguaauacuugaaaagagagcacaggugaacagggagcaaagaaccgauagugaagggcaggcugagaaauaacucaguuaugaacuaagaaagaacaguggugcagaagaaaaugggugcaaaugggaaacgggcuaucacugucaaaugcugcagaagucaaugggaauaauuuacuauacuaccugcuucccuucuuuguuacagucaucuacaacuuugcaggucaccaucugauaugguuaggcuuuguguccccacccaaaucucaucuugaauuguaauccccauaaucgccacuugucaagggagagaccaggugaagguaacugaaucaccgggguaguuucucccacgcuguucuugugacaguaagugaguucucauaagaucagaugguuuuauaaggggcucuucccccuuuguuuggcacuucuccuuccugccgccuugugaagaaggugccuugcuucccccuugccuuccaccaugauuguaaguuuccugaggccuccccagccaugcugaacugugagucaauuaaaccucuuuccuuuguaaauuaaccagucucaggcaguucuuuauagcaguaugaaaacggacuaauacaccaucauuuuuuccaacaauaaucaggucacaacucguggguacucaggucaaaacucgcggguaauuucaauguccacauacugaucuuuucaauaccauggccucuguuccuugaccucuucaaugaucucauccuccaaccuaccuuacucccaggaucaaagcuuauaucuuauccucauaacaaacagaacccuuccauaauuccaauugugagaaucccauucuccaaccccuaccucugaacauucccucuuggacuuaaugccaacagccaaccagucccaccaccuuucuacugauugucaucccucucauggccucacuucccuccuuacuccuaaacccaaagcucuccaauagcuuccuguauuacuaagaguaaaagcaccaaccauggccgggcacaguggcucacaccuauaaucccagcucuuugggaggcugagaugggcagaucgcuugaguccaggaguucaagaccagccugggcaacauggcaaagaucacaccacugcacuccagccugggcaacagagugagacugucuggaaaaaaaaaaaaaaaaaaaaauuaaaaaaguaccucccuggccucccgucucuuggcucuaacuuaugcuauuuucuucuuacugucccuuaaacacaucggugcagguuuuuguugcuuuuuuuguuuguuuuguuuuuuucaaaaagaaaaaaaaaccagagucuuguacucacccaggcuggagugcaguggcauaaucucagcuuacuggaaacuccaccucccggguucaagcaauucuccugccucagccucccaaauaguugggauuacaggugcccaccaucacacccagcuaauuuuuguauuuuuaguagagacuggguuuugccauguuggccaggcuggucucaaauccugaccucaggugauccgcccaccucggccucccaaagugcugggauuacaggcaugagcaacugcgccuggcccaucagugcagguuucuggcuguuucauucucucugccuggaaucgucuucaccagguaucugccuaucuguucccuaacuuuuuucauaacuuugugaaaacaguuacuguauaaauaaaaccuuucuugaccauccuacuuaaaccuguacccuuguuugauuuuucauccuaucacuuaucaccauauaacauccuuuuaauucuacuacuugucucucuccccauacuagaauguaugcuacaugagggcugagcacuuugucuauuuuuccuugcuguauuuuccuauggcacauaggaggugcucaauagauauuuguggaaugacuaaaugaacaggauaugcaccaaaaaaaugaccauggagcugaaguagggccaucaucuauauuugggugauuuuuuuucucuaucauuccauuaaaaugggcagguuauguguucuugaacuuuaauaaauacgcuuuuuacaaaacacgugaauguacuuuucuugucagaaggggaacacugagucuccgcucuagauccauuaacugucauacuccuuccccagacaacacaagugcuuuaacugaugaugaacacggucauuccucuccuucacccccuggcagcaagacugguuacagagagcuugcacucagcucugcgguucuacgggugaguuuuauagguacacaccccaugugggggugcugugguagcuucaugcugccugcaucuggacaggugagguaauggccacuauugggccucuguccagauucccucugcagacccaugcacgcacuccccgcugugcugggcaguggcuaacagcagauggcugcccccuucuccagagaccugccccucagccaaugccaaugacuggcaggcacaaaagccaugaaauauggugcaauuuacacuccagagcuuccagaaggaucagagugaagcuggacagcagcugagcucacagcccuaacuuaccuagucucccuccugagaacacuccaauaauucagucgagggugacacgcaggucccggguccuaaguugaugcuggugucuuucacugaagcuggaagcaugggaggagaggccuacugggugcaggucaugagugugggcccugcuaaccugaugggauuaauguccuuauaagaagaggaagagccgggugcaguggcucaugccuguaaucccagcacuuugggaggcugaggcggguggaacaagaggucaggaguucaagaccagccuggccaagauggugaaaccccaucucuacuaaaacuacaaaaaguaacugggugugguggcgggcgcuuguaaucccagcuacucaggaggcugaggcaggagaacugcuugaaccugggcagcagagguugcagugagcugagaucacaccacugcacuccagccugggugacagagugagacucugucucaacaacaacaaaaaaaacaaaaaaagaggagacagagacuggaucucucucucucucucucucucucucucucucucucucucucggcaacacagcaagaagguagcugucuacaagccaggaugagggcccucaucacaaacugaccaugcuggcaugcugaucucggaccuccagccuccaacacuaugagaaauaaauuucucuaagguauuuuguuaugacagccugggcuaagauaggcaucaacacauaagcugggacuucaagccauggcuguaaacaggauugccuuggucgagugaguagcagagaagggagcucuaaugaacacgggcauuuaagacucacagcaaggcauuccaaagagcagcggcugcuagacgcgaaugaaggaacugggugagagaaccguaaagagacccaaggagacagggcuuuuguauucaaguagaccugaaugauaacucaguuucuagaacuacaugagacuugugcaagcuauuuucauggauccuuuucuugcaugguaggcauaggaagaaguauguggggucuggaaucagacuacugaguucaaauccaggcucuguuacuacaggugacuucaugucaaugugcccuuaccuauaaaaccgcuaagagaguuccacgagggauaaauaagauagaugacacauuucaaguguguagaguguagaguguagaggauguacucaauucauguuagcggugacuaggacgcagugaccuggagagagguuggggccucaggggauggcacccagucugcuugagugagagagauguacauacgaucaagaaccaaauggcugguuguaaaaacccuuucuggcacacagacuggaagcugccccggaagugugggagugggagccaucaggcuggagaaaaagcaguggguugcaggaggagagagaggauaaaagugggaucgaaggggaacuccuuaaaccuggaguuccucucaaugcaucugucuaaugggaaaacuacagauguauaauauuuucuucuggagucauuaucuaauucaaucauagagucccacauugaucaguuuucaguuuacaugucaaguuaugcauuuuguugucauaacaaucccacgagauagguuguaacaggcugguuuuacagaugaagaguucaucuaaagcaaugccuggccagacguggugacucacgccuguuaaucccagugcuuugggaggucgaggugggaagaucacuugagcccaggaguucgagcccagccugggcaacauagugagauccugucuuuacaaaauaauuuuaaaaauuagccaggcaugguggcaaaugcccauagugccagcuucucaggagguuuaggcgggaagauugcuugaggccaggaggucaaggcugcagugagcuaugaucacgccacuacacucaagccagggugacagauugagaaccugucucuaaaaauuaaagaaagaaaaauaaaguaauuucuguucacuguguucauccccagcucagccaccaauacgaccccucccugcaucacagccuucuuguagccuccuucagagccuuuuaaagguuugagguaugagagggcaaaaccccuaaaaccacuucaacucuaaaaguaucuguuuuccaacuacaugguauauuuugcagcagcauaagacagugaaaaagcacaggcaaauccaaguucaaaucccacaccagccaguuaggccugccuuaaaauuacaguuuugccacuugcugaguaauaacaagcgaguuacuucaaugcucugagcuucagcugccuccucuggagauagagaauaacaacgucucgcucuguggcccaggcuggaaugcaguggcgugaucuuggcucacuacaaccuccaccucccagguccugguucaagcaauucuccugccucagccuccugaguagcugggauuagaggcaugugccaccaugcccagcuauuuuuuuuuuuuuuuuuuuguauuuuuaguagagaugggguuucacuauguuggccaggcuggucuugaacuccugaccucgugaucugcccgccucagccucccaaagugcugggauuacaggcgugagccaccgcacccagccaacaacaccuaucuuaacagguacuggugaagaugaaaaugucaagcacuuagcacacauggccacuuacuaaccucaguaauaguccucuuuccaauccccccuuauacuaaggacaggggauacagcgcuugaaugccugucagggagacagaauccaccauaugaaccuuuucuuucuucugcuuaccaaacuccuuucuuuauauuuuggguauaugaugacuuacaggauuuuugggugagcaacugggaaugcuuuauuucugauaguagcucuaggucaauaauuuugccaacuccugcccaagauuaaauacuaccccuucagaagauccuggaaaagucuaccagugaaaugaacuggaauuuuuugguuacuguucauauguuuguuguguuuuucgaugcucuuuaaugugucaguugacauucuccaaagaucuagcugauguaagugcgucaaauaaggcugaauuaccaggcaagguuuucucugcgccucaaagaaacuguuaauugacaugccucagagagcgcuucaugucagccuaccacucacaguauaagcucgauguaucuuaacagggaagagaaacacaucaaagugugacuuacccacuguuggggacaacuugauucgaaagagcuucuuaacuucuugcauugagaagcauccucuaaguucucaucuaaacacuuccaguacucaucccgggccccccagcagaccugucuuuccuucauagauggggcugccauuccuacugcgaugaagcuguuggccaaaauaauauuugagauuaacaaugaacuuuguaaucugaagagaagauaaggaaagaggaaaaccgucaaucuccucuuccuuuaaaacuaaaaaaaaaaaaaaaaacaaaaacaaaacaaaaccaugcuuagggauuuugaugaggcaacugaacccaaucaguucucaguggcagcauaaggccacccgcucuugaggcuuaucucacacugugugauuugaucccugcuggggcggcagcgugggcucagaaagcccggcugagaacugugguucugucccagucgcuuagggcagcucauuuauucucuccgagcccguuucccaccaguaaagcggggacagcagugccuaguuuacaggguuacuguucgaaccuaagcgcuguagaaacaggugugugggggccacaaucaccaagcaggcgauuggagugccaccccguuuugcacaagaggaacccgcggcucggggacaguaagggaccucccgggcccauaguccacgcgcgccccacccggacccaucagcaagc

SEQ ID NO: 192007 - RNA, 19599 nt, Homo sapiens
acugcgcaggcgcaggagccgcgcucugggccucugcucaggcucugccgcggacgaccucgaggcccuuaguugacugggaccggaaguggcgugugcucggccuuucuguguuccuggcccgcggccgucgggugugagcugcgccgaccgcucugaggguucguggcccaccgcuccuucgcggucccugccgccaccguccacgcucagcguuguagagaagauggugggucggaacagcgccaucgccgccgguguaugcggggcccuuuucauuggguacugcaucuacuucgaccgcaaaagacgaagugaccccaacuucaagaacaggcuucgagaacgugaguggguccucucuccccuggccaggcuugcugccuucggccgccgcccuucacaggaggggucauugccucccaccagccugugggccgcgcagggcgaccgcguggugcggcccucaauaggcgauggcgcuggcugcgccgcuccgggggcucuagugccccguaggaauuccauuuuggaggaaggauuuuucccguuuuguuuuccccagacacuuuagccgugcaaaugcacucuugauuucuguugcaaucucggguguguguggccuggggaggagguugucucuuuuuuugucguucaucuuuuuaaaccucuacucuuaacuaaaaagucgugcauuuuugucgcaaauuuuagucugaggcuaaauccgcaugcucagugcaguaucauuguugcauucuuuuuuuugagacggaaucucgcucugucgcccaggcuguagugcaguggcgcgaucucggcucacugcaaccuccgccucccgaguucaagcgcuucuccugccucagucuccccaguagcugggauuacagucgggcgucaccacgcccggugauuuuuuguguuuaguagagacgggguuucaccguguuggucaggcuagucucgaacuccugaccucagaugauccgccuggcucauugcugcauucuuaaacccucuugguagcuucguucuaagugcuuccaagauaugagugaaugcuauagaaauugcaggggaguccaaagggcugcgcuucucccguggcucagucuuauuucauaccugcgacaucuuuuaagagaggucuaccagaggggaaucgugucaugaaaaccguugugauccaccuugaauuuucggagaaucuucauucgcaucauugaagagcaaauuuguugcaauaagaaauauuuuuuggcuuaucuugguuguucagccaaauuaguuuuuggaauuaaaauugauacguaaguuacuaaagcccaagggguacaaagaagggauuauuguuuacuuaaguaacagugguuacgguuuaauucagcuauacuaagucauuucaaguguucaguagcccugugugagcagugacugcagcgcugaucuuacuagcacuaagaaucagacaucuaguuccagcuuucuuauguuuuaggagggaagggauauagacauaauuugauuuaugacuaggcagacuaauagaauacuguuuuacauucagaccuugaauuucuagggccagguuagcggcauaauuugggguuucugaauccuaauuucuguaguuguaaaaucagguaaugccaccuaccucuuguugaucuugugaagguugagauguuugaauugccuuccacguuuucugacauaggaaaugcuccuccauaaaugcugguggucauucugccuucggguuauuguccuguaguugccaaaaugggugacagcugggggcuuugguacaaaugcagaguuauaaagaauggauuaacccuaucuuccguuggaaacccugaaguccuguugcagaaacaagagcuaucauuuuagacaaauggaggaauguuauuucaaaauaacuucuccaucauuuucaaucuaaaauuguuuuuucuggauuuagcggcaaccuaaugauuacagugaauuacuuagcugcagcaguaacuuuaggcaaguaacuucaagcuuuaguuuucccuuuuuguaaaaugguauaguguagaguuuuaguccuguuccucacacaugguaauugaugaaugcuagagauuuuuuguuguuguuguuuguuuguuugagucucgcucugucgcccaggcucgagugcaguggggugaucucggaucauugcaaccuccgccucccggguucaagcaauucugccucagccuccugaguagcugggauuacaggcgcacaccaccaugccaggcuaauuuuuguauuuuuaguagagacaggguuucaccauauuggccagguuggucucgaacuccugacuucaugaucugcccgucucagccucccaaagugcugggauuacaggcgugagccaccgcguccggaugagauauuuuuaugaguagaaauauuuuguuguuugauguuuuuguaaaauuuauuuagaauaaucuugcagucuguucacagguaauugaggcugggugugguggcucaacgcuaguaaucucagcacuuugggaggccgaggugggcggaucaccucaugucaggaguucaagcagccuggccagcauggugaaacccccacucugcuaaaaauacaaaaauuagccgggugugguggugcacgccgguagucccagcugcuugggaggcugaggcagaauugcuggaauguggaagguggagguugcagugagcagagacugcaccacugcacuccauccuggggggacagagcaagacucugucuccaaaauauacgugugugugugugugugucuuuauauauauuuauaucuauaucuaucuaucuuuaucuaucuaucuaucuaucuaaucuaaucuaucgaccaggcgcagugacucacgccuguaaucccagcacuuugggaggccaaggugggaagaucaugaggucaggagaucgagaccagccuggucaacauggugaaaccccgucucuacuaaaaauacaaaaaaaaaaaaauuagcugggcgugguggcacgcaccuguagucccagcuacuugggagacugagguaggaagaucgcuugaaccugggaugcugagguugcagugagccgagauggcgccacugcacuccagccuggggacagagcggggacagagcgagacucggucucaaaaaaaaaaaaaaagugcaguugcgugacuggcugauuuuaaaaaguuuagggguauuuugccuuuguggaaugaaauucuguucaguuaauuuugaguuuuuaaaauuaauuuuuuuuaaauuuugaguucuucuagucuuauuuccaauagaauauuuacaucugcaauaaaagagcaguuuuucacauaaggcauguagcucauuggcuuucuuuuuuguuaagaagagagacuuaggcggccgggcgugguggcucaggccuguaaacccagcacuuugggaggccgaggcgggcggaucacaaggucaggagaucgagaccauccuggcuaacauggugaaaccccgucuuuacuaaaaaauagaaaaacuuagccgggcaugguggcgggugccuguagucccaccuacuggggaggcugaggcaggagaauggcgugaacucgggaggcggagcuuacagugagccgagaugacgcugcugcacucccgccugggcgacaaagcgagacuccgucucaaaaagaaaaaaaauaaaaaauaaaagaagagagccuuauauuguuuaaaaugaggcuugagguuaaauuugggauccuaauuuauuuagacuuuuugucaccuguuagcaaaagcagaguaucaggauccuugagguguaguuuuuaucauucuaaauuaugaguaaaugaaauguaauuugccaaauuacaaugccagcugcaggugcauuucacuuauaugggacggauaaaaugacacauuaaaaauauauuaagcaucuuauuuaaaugaauaaaucuuggaaacauugagucaaggcuugauuuugcucauuguuaaauuucuucaugguuuuucaguugauuaccaucugucccuuuaucacagaaauacugcauuauacuauaucugaaaauauguuaauguaauaaguuaauuguauuaugaaacuaaagccagaauuuuaaucuuauugcuaaaaauguaaagcaacuaagugaucuuaaaauuugguagcuguaucaguuaaauguauucaguggcaaucacacacuccuccccaccuuauuaaaaaaacuuaugacucaguuucacuuuccuggguuucauuaucaguuuugucauuuucccuaaauucugguuuagcaaauuguaugucucacauacaguugaucccacaaacuuggcauguucauuucugaggugccuuuuguuuugaugguaauaacaucuuuacuucuccacacuauuaacuauagaggcagaagagagucauguuucaaguccaaaagccuggguuugaguugccauuccaccaguaaguaauugugaccuugguacauuuucucaucuggaaaauggggaugauaauaguaccuggauuuuguuuuuuguuuuuguuugagacggagucucacucuguggcccaggcuggagcgcaguggcgcuaucucagcuuacugcaaccucaaacucccagguucaagugauccucuugcuacagccucucgaguagcuaggacuacaggcgccugccaccauaccuggcuaauuuuuuguauuuuaguaaagacgggguuucaccguaucaaccaggcuggucuugaacuccugaccuccagugauccgcccgccuuggccucccaaagugcugggauuacaggcgugagccacugugcccagcuguaauucuuuuaauguuguugugaggauuaaauaagcuaauaaacauuuagaacagugucucgcauguagcaucuaaaacuuagugcucacauccaagcguuccuugucuucauguccagauccuuugaagucuuccauuucuuuucuaguuuugcuacgcucccuccaguacagguuccaguguagaccacgauauuuagcaauuagauauuguugucuguuaucacucauuauuuucugccuuaagagaacaaaaacccauaagcaaauggaggguugaauuauguucuuuauccuuuuuccccacaguuaguugugcggugaugaacacuuaaguaagguacuuagaaaaauuagcagccuucagauuaauacauaagaucaacuuuaaugcauacuuuuucuguugaaauggcuagaauuguauuuaagccuuacagugguagcacucuauuaugggagacgaguggguaucugaugcuggugugaugaaauccaguuuaugaggguugacuaagaaaagguaccuugaccauaguaaaugaaccuucugucuacagguagggagaccucuuuuuugagacagagugucgcucuguugcccaggcugaagugcaguggcacagucucugcucacugcaaccuccgccucccggguucaagcaauucuccugccucagccuccugaguagcugggacuacaggcgcccgccaccaugcccggcuaauuuuuguauuuuuaguagagaugggguuucacuauguuggccaggcuggucucgaacuccugaccuugugaucugccuggcucagccuccuaaagugcugggauuaaagcaugagccacugggcccggcccucagaccucuuuagucaugcauugaagcuuggauuuguagagugcuuuaagguuuucagaggacauuugcuuguuucauggcuuuuguuucucacuguaguccuguaagguuagaccuuaucuugggagagugagagauuugccuaagaucacccagcuaauaaguauuagcuaauaauaaguauuggagccuuacauuuucuuaacuaugucagcaguuacucucuaugucauugguaguuuuuagugauuaucacuuuagguguaguccugcaucaguauccuugagugacugguuccaggccuccccuggauaccaaauucugaugaugcucaaguaccuuuaagugguauaguauuuucauguaaccaucauaugccuccuguacacuuuagauuuuuucuuucauuuaagaaugccaguuugcaacauucaguaaagauauaaucuggcauauuucaguaauaaaacucccuaauacuaguggccuaauucuugccccuguuacauauccuuuguugguuggaaggggggacuugaucugcuuauuguaauuacuuuagaaguccagcuauuggagcuaucuccaucuugcaaauugcuagaucuucugccccaaagggaaggagaacgcuccagugcagugucacauuuccuacagcucauugaccagaacaugucauaugcucuugacagaucacagggagggauagauuccuagaguuagaaauguuuugcaaauggaauuaaugacugccacagcaguuagaauucuuuugauucccauuuuuauaaugacaaaauguaaauauaacuuugcauuucuugcaggaagaaagaaacagaagcuugccaaggagagagcugggcuuuccaagguaauagucugguuucuguuuaaauuauauauuuuguagaaauauuauuuuaaaaucuguaauuggaaauguaauuaaaauguaauuggaaaaagcuaguugauacuggacauugcuuuuuuauuuuaaaauacagcuuauuuuuaggaguaggugaauaauguaguuccaaugacaguuaucgaguccuucauuauuucuuuugcuggccauaacaacaaacagcuuacuguaugaacaauaauuaaggagcaagaugagggccucaagacauuugcaccaaaagaugaaaaguuccuaaucagcugcuucaaaaugauacaauauuacacuuaagauuuaauuucuuuacuccaacuuccuguaaaagaaccauggguuauuauuucaaaaauuauucaagauuauucaagcccacugauccagaaucccacugcccugacaaauuuuugccuuguugcaguacauaguucuggauauaaaacuuguaauuuauuuuuucuucucauagauccugaguucuugauuauuuuuaaugacuauguagguuuaucuacuugguaaaaaaauguucuguggcguguguaaguaaauuaaguaaauguuaaucauugugcuugcagcuuuuccuuuuuauugagaugaguucuauuguuuggguucuuaggacuuggauuacuggaucauuagugguucuuuuuaaagcaaguugagacaaggaaaaauuaaguuaaccaguauauuuuguuauuuugaaacaguuguguaaacacagcuaguugacuggacaugguaauagugaagugaaaaugggaggaaacuacuucguucuaguaggaucagacuaccuuucugaaguauguaauauguuuauuaugcuuuugguaacuuauauuucuaagggcauaggaaaacagauugagacaugcaccaguauguauuuuuagauucaagaauagaauuaaauuauugcuacaugcugggguagugugugaaagaugucuccacuuucagaaauuuaaauuguuucacuuguguuggcuagguuaauaagaguacguacaguguaauucaaggaccaaaaacuugcacuaauggaaguuuagguuuucucuuuuuuuuuuuuuugagauggagucucacucugucaccaggcuggagugcaguggugugaucuuggcucacugcaaccucugccucccagguucaagcgauucuccugccucagccucccgagcagcugggacuacaggugcaugucaccaugcccagcuaauuuuuguauuuuaguagagauggcguuucacuguguuggccagcauggccucgaucucuugaccuugugaucugcccgccuuggacucccaaugugcugggauuacaggcaugagccaccgcacccagcuacugaaguucagguuuucaaauaaaaauggccucuuuuuuuuuuuuuuuugagacagggucucacccugucacccaggcuggggugcaguagcggugcagucacagcucacugcagccucgaccucguggguucaagcaauccugccuuagccucccuaguagcuggacuauaggcaugcaccaccaugccuagcuaaucuuuuauuuuuuuuauagagagaggcugagguaggaggaucacuugauccugagaggugaaggcacugagcugugaucacacuacugcacuacagccugggcgacagagugagacccugucucaaaaaacagucuuuuagaugcauguaaaauguaggcugggugcgguggcucauaccuguaauccuagcacuuugggaggccgaggcggguggaucaucugaggucaggaguuugagaccagccuggccaacauugcgaaacccuaucucuacuaaaaauacaaaaauuagcugggcaugguggcgggcacccagcuacucgggaggcugaggcaggagaaucgcuugaauccgggaggugggaguugcagugagcugggauugugccacugcacuccagccugggugacagaaugagacucugucucaaaaaacaaaaaaacaaaaacaacaaaaucuguauaaaauaauguugaaucauaaggacaaauugcuuacaguuguauaaaaaucuacaauaauggcauccgaaaauauuguaacgugcguagacgguauagauuuugcacucuuuucucuuuacauucgaguuagagcuuucuaagaauuauucaacuacaaacucaaguuuuuucuuuuauucauuugaauguagaugaacucuuaauuccuacaaguauucaggaguaaaguucuucuaucagauuuuuuuagaaugagugauuugguuuuuuguuguuuuauuuuuauugauaucuguguauugguuauauccccuggcauaauuguggugucauuuauuaaauauuuuauuuccaguuaccugaccuuaaagaugcugaagcuguucagaaguucuuccuugaagaaauacagcuuggugaagaguuacuagcucaagguaauagucauugaaaagcuaaggaaauggguagaauuuuucucacugauagaaauuuauaaugauaaggggcuuuguuuguguaauuuggcuguuagaaaagguacuccaaguaucucaagacaaguuuuuaggcacuuaauaauuggaagauuauuuuguguaagacuggcucuagaaagaaauauuccuugugggauauuguuguccauaauauauuuuaagugaguuuuagguuuucuugcuauaucauaugauguagaagauaguaaguuuuuacaaaugagguucucuuacucugaaguaguuucuaauguauagccauagugcgauauguaaauaguaacugaaggaaugugagcuaggaauauacuccucaacuccuucaucuaaucuucagaucuuuuccaguauuuauaggaaggaauggcuaauguaaggucccagagaagguuaauuuaccuaaucaaggucacacggugaguucaugaccccuuauuucagaaccaacuuguuaucugauccagaauuuagccuuuucauuacauuguacuucauuuauuucaucaacagugcuaagaaguuucuaaaaaauauucuaucuuuaaaguucagcuaugaaauugaaauuaucaaauugacaaacgugagaaccguaauuuacucaauaaucucaaaaguagauuugaaguaguugcuaucguuauuaaaacugcuaucaaauauuuuaaaauucugauugcuguaucaauagauuuagauagaauugaacuacaugauguggggcauuugugugugaaugaguuuguuuuguuguuucuuuuauggggagaguuuaauucauuuaaaauggugguaacuaacuuuaucacgucuccccuuugccaagaaauacuuuuuugauaucaauagaauugcucaauuaauuugaccuaaagagucacaguacucaaauugccaacagacugggaagggguaaaaaucagugaguagggacaggcaugguggcucaugccuguauucccagcacuuuggggaacugaggcaggaggauugcuggaagccaggaguucgagaccagcaucgauaacaaagugagacccucaucucuacaguaaaugagaaaauaaaccaggugcaguaguaugcaccuguagccagcuacucagagacugaaguaggaggauaccuugaacccaggaguuugaggcucuagugagcugugauggugccacugcauuucagucugggcaacagaaugauaugcugucucuuaaaaacuauauacauaaaaucuguaacugcagaggaguacaagauaggcaccagucaggaaacauuuccaagucuccuacaggcaucacacugcaauuucuccaucaaucugagagagaggacccaggcauuggggaaagggaaagcauucccccucagugcuaaagcagugcugcauacugaguugcucugcuccuugcaucgcauaacacuggguuugaucuuccuaugcugauagauagauuuuaugauauucuccaugcuguuguauuaacaaaagauaccacuuacgacgaucuggcuauccagucagcaaaaguuguagcaacauccacuuugcacaagaagggagcucaaaaugacaagaucacugcaacugagguugugucaguguaucuucagcauuguugcuaaaucugcagauacaguaaucaacagugcuaguucagaagagauuuaauuauaguauguauucagaagcaggaacugacuuagccagucuuuugauuacuguaauucuaaagugaccaucaguggaucagugugcagcccugggucggaucccuugugauggguaucacuacaucaucauuucaauaccugggaaaggaauuggccaagauggugccugggaacccagaugacaaugaccuacacaauuggaguauccugaaacauuguguagaugggacaaucauaguccucacauuggcaguggagauucaccuguuucugcugauggucaagagguuaagaaagcucuuggaaaccuuuacuuauacucaggugccaucagauaccccgcaguagucaaaauuuuacccaaaauguuucucagucuuuccacagcagccaauugguagcacagaaaacauauaccagauuuaagagccuggaaagaacaccagugacuauccugauacccaggcuugccgucagcugacagggucaagugcaucggguaugaugguagagauauucccuaagacauacuuaauauccucagcuugcuggguaaaaauuaguaagauugaucugaaacuguuuucuccuuuuuuuuuuuuuuuguuuuuuuugaaguggaguuuuacucugucacccagagugcaguggguggagugcaguggugugaucucggcucacugcaaccucugccucccggguucaagcgauucuccugccucagccucaugaguagcugggauuauaggcaugcaccaccaagcccggcuaauuuuuuccuauuuuugguaggggguggguuucaccauguuggucaggcuagucaaacuccgacuucaagugauccaccugccuuggcuucccaaagugcugggauuacaggugugagccacugcaccuggucuauucuuacucuuuuuuuuuuuuuuuuuuuuuuuuuuuuuuugagauggagucucgcucugucgcccaggcuggagugcaguggcgcgaucuccgcucacugcaagcucugccucccugguucaugucauccuccugccucagccucccgaguagcugggacuacaggcgcccaccaccacgcccggcuaguuuuuuguauuuuuaguagagacgggguuucaccauguuagccaggauggucucgaucuccugaccuugugauccgcccgccuuggccucccaaagugcugggauuacaggcuugagccagcgugcccagccccauucuuacucuuuaagaucaauuuccugugaauuuauaucgugggaaauuguuugguaaauaaaaagaaucuaguaaaaaaugaucuuaaugguauuaagaacuggaaaaggucugagguguuuuguuuuguuuuguuuuugagauggcaucucauucuguugcccaggcuggagugcaauggugcagucucagcucacugcaacuuccaccucccggguucaagcgaggguucaagcaauucuugugccucagccucccaaguagcugggauuacaggcgugugccaccaggcucagcuaauuuuuuuuuuuuugagauggagucucacucuuucgccaggcuggagugcaguggcaugaucuugcucacugcaacuuccgucuuccagguucaagcgauucucuugccucagccuccugaguagcugggacuacaggcacgugcuaccaugcucagcuaauuuuuguauuuuuaguagagaccggguuucaccauguuggccaggauggucucgauauuuugaccucgugauccacccaccucagccucccaaagugcugggauuacaggcgugaaccaccacaccccggccuaauuuuuguauuuuuaguagagauggaguuucaccauguuggccaggcuggucuugaacugaccuuaggugauccacccaccucggccucccuaagugcugggauuacaggugugagccgccguucccguucauuucugagauuuacuuuacuugcaugcuaacauguuaguuugccccaauuucauggaugcuggcaaaagacaugagaccacugggcuagagacaaaggacagcucguuauucacugcaauaauaguaacaaggguauuggcauuugcacugguuucccgagccacaguuccuauggcaaugcagaaaggggacacauguacauguaguggguugcguauaggagaggagcccugaauuuaaggauccugaauuuuuuauaaugggcaguaaacaugugugugcuuuucccuacacauagguaauguugcaaaccugccuuugcuccugagggaggcaguuuauauucugagguuguuuacuguacaaacauccuugaaaagacaguuuggagcaaaggcaguaaauaucugcucagaaguacagaaaugugacagacuugagaauuguuccucuacuuguauuguuauuauuuuuuuauuuuuauuuauuucuuuuugagacagagucucgcucugucgcccaggcuggagugcaguggugcgaucuuggcucacugcaagcuucgccucccggguucaagcaauucuccugccuuggccucccaaguagcugggauuacaggugugcaccaccacacccugcuaauuuuuguauuuuuaguagcaguaggguuucaccaugucagucaggcuggucugaacuccugaccuugugauccacccaccuuggccucccaaagugcuaggauuacaggcaugagccacugcucccggccguauuauuuuuuaaaaguauaucuaauggaguuauuuuuauguaaggcacauuaaaauauuuuaaugggaaccuccuauacagaacagugcuuaauuuaaaauauuuaauagcauaguuuugcucaaauauuuugggacaguuuuuggaguuugauuuaaagugggauuagggccgagugcaguggcucaugccuguaaucucagcacauugggagguggaggcaggaggauuacuugaguccaggaguuugagaccaggcugagcaacauagugagaccccguuucuacaaaaaaaaaaaauuagcaaaauuagcccggugugguggugcacaccuaugguccuagcuacuugggagguugaggugggaggauugcuugagcccaggagguugaggcugcagucagccaagauuguaccauuguacuccagccuggguggcagagggagauugugucucaaaaaauaaauaaaauggaguuaacuaaggacaaggagcacauagcagauacuuauuauuuauugaauuaagugaacuuugaaaaacuguaagccuuaaguauuuuuuucaaacauaauaugucuauugaaggauauuuauagauaaaauaggcugggcgugguggcucacaccuguaaucccagcacuuugggaggccgaggugggcggaucauguggucaggagauggagaccaucuuggcuaacacggugaaaccucgucucuacuaaaaauacaaaaaauuagccgggcgugguggugggcgccuguagucccagcugcgcgggaggcugaggcaggagaauggcgugaacccuggggagcagagccugcagugagccgagaucgugccacugcacuccagccugggugacagcgagacucugucucaaaaaaaaaaaaaaaaagaaaaaauaagcccucccacucagaguuaaucauggcuuuauuucuccugucauauuucauuaguaugaccauuuuuccugcuaguaucacuuaaaauuuuuuuuucuucccaugcgauaccauucaaauaguacaaagauuuggcuuaaugugaaauugggucuucuuucuaccccaguccccagucuuuuaguucuguguuacagaaaaguacuaugcgauuguuagcaauugucucauguagucuuucagaaauauuccaaguauauaaauaguaauauacuuugacauuuuuauacauugauuucccccuuacauauguuugaaacacuuccauaucaguacauguaaucugacucauucuuguuaguagcuucauaauaguuauaugaaugcauuauaggucauuuccaguauuuuacuugcuuaguguuuuuggucagcaucauuuggagauaguguguaaaguuaauuuugacaaaggccaaggcuuuucagguuacauguaauuuuauguaaaucuuacaggugaauaugagaagggcguagaccaucugacaaaugcaauugcuguguguggacagccacagcaguuacugcaggucuuacagcaaacucuuccaccaccaguguuccagaugcuucugacuaagcucccaacaauuagucagguaaggaauuggaauguuaugacauaaaagugagugggauuuagaaucgaaugauuagggacauuuuaaaaugagccuagugaacaugaugaaauaaacuuaucuguauaaugaaaacaauaugggagauaucagcgcuugacauuuuccucucuggugggaaacauccagaugacugcccagaucuagugauugugcccuggagguggaucaggaagugugugucuuagugauaagucucaggucuuaguagucaacuguccaaauucaggucacucuuggcuacuuucuacaaguagcuuucugccuacucuuccaggagaccaugccuucaguuaggugaucugacagaggagccuagauagcuauagccuacacauucgggccuaaacgucgguucuagacauucaagagcauggauucccucugacucacuuguguaaaggcucaugccucugcugcugcugaggugcacuuugaguuuggagcuauuugacgacauccccaaaucccuacucaaaaaugcaaaauagcauuaauauacuguaaaagauuaacuuauguguaaauuaggaguuaaugaaaaugcuuucucuucauuuugaguucuuuucaaggagcccaaaugaaucuugcuuuuuggaauagcgugucuguuacaaguguugauuucccaaguuggugugauuaaaacagugaaugaugauaggaaguauuuacagaacuuuauaguuaguaacugacugguuaauuuuucaaacugauuuuuacucaacugaauuagaaaaggacuggaaagaaaguaaagaucccaacgacuugagggaacaaguuggacaaccaaggacuuugucuaaauuguuuuuauuuagacuaaugugguucuaguucuagaggauucauacuggaaucaucgguuuaauauuacgcuauuugaaaggcagcauaguauaguacuuuuggaaaauuggccugagggugaugucuuuuggaauauuugugaauucacuaugaagccuaauuccuuaaaaaugaccuccuucacucaauuaucaguguucuugguuugccugggagugaaaagagaucuuaaaaucuuuuugguuuuaguuacauaauugacugauguaauauuauguaaugauggcuguacacagugucucaugcccuauaauccuagcacucauuugagcucaggaguucaaggccagccugggcaacaugguaaaacccugucugcaccaaaaauaaaaaaaaaauuagccgggcaugguggcaugagucugugguuccagcuacucaggaggcugaggugggggaggaucgcuugagcccaggagucagagguugcagugagcugagauugugcuacugcacuccagccuggguuacagagaccccaucugaauuaaaaacauauauaauguaaugaucugccuccuuuguuaacuugacuuuugaaaugggauugucaguaguaugaucauuguuuucuuggaugccgacuguguguaaaguguuacauuuugaauuaaaugucagaaugggugaacuuuacuaagauucaauucuuugaauacaaagagcauuuuauuuugaaguuagaauccuaauuaaaugcuuaugacacuuuaaaaaauuauuuuuuuuuucuuucagagaauuguaagugcucagagcuuggcugaagaugauguggaaugagaaacaaaugucaacauaauaaaaucucaguuaaaaauauuuuaaaaauucuugguaguugagcagcucugggggaauaagggcaaauaugcuuguuaugaacuacacugaaaucuaccaaaguuaauguuuacuuuguguagauccauuugucuauuuuauuuauuuuucccagugaaaaguguauuuugauagagaacuuuucauucuauaaauacacuaugaguuacuaaaauaucauggauuuuguuuauuccugaaacauaguuacauaguuaaacuguacauaugacauggcuuauguuaaaaauacccagugcucaguuuugaaagauaggcaaaaaaaaaaaaguauaggagaaacugaagaauguacacuuuuuuagagggcacauuuugcuguaaaucuggaaauuugauagacuugacuguguuugugaaaacugagcauuaaagguuuugauugauccuuucuuuccauuuaaucucugagacguaaauaugugaggugugcugcugugcuggguuaacagcuuccuucccuuucuguguagcagucuugaaauguucuguuuaaaucaguaggcuuaauguguucuggguauuuaucuccuuguauuuuaaauauauguaguugcaaauagcaccaggaauuagauuucuguacaccccuaaucuagccuugugagcuucgcuaguuaaugugugcucacuuucccuccauuuguuacgugagagaaugcgucugcugaucacugaagugucccuuuuagcuucugauucauuggguucuguugggcaucuuuaaauccaccuuaaccugaggaauguaugugggcaaccaggcccugcauuuuuuuauauucugaauuuugcaugcuugccugacuuaguauuucugaauugauguuuuuuuuaaugguauaacuaucuugauuuucacugaaauuauaugguucugucacuacucuguaaauuaauccgaaacuuuuaagguaacugggaugaucugcuuguaaaaaugcuuguugccuuuugcuuuaucuucaguguaccuccuuaauccugcuucaacuugauuaucuugugaaacgaugagaguaaguugcaaccuugugacugaaaacuugaaaagaguggagcaggugggaccucuuauucucaaauagugacauauucuccguagucacaguuucagaacugaguaaggauccuugguacuugguggcaucuguugaacugaggagcauuucucauuguaaagauugccuuuguucugucuaaaagucuggagaaaucccaaagacuuuuccuauguacuaggcauuuuauuuugauugacuuacaaacucuucuuaaucauuaucaaucucgguuuuuuuguggugcaguggaaggagaaauaggucuaguuucugccucugauuagccgcacagccuugaacaaaucacauuucaucuuugaacuuaccucuacuguuagacuaggcgacucacauuugaggacuuuucucggguaucuugaggguuugugauccugaacccuuaaacagugcuuuuuuguuacacaggagggcuuuuuuggggggaugaccaguacagacaugccaguuaguuuuacuagugggaucccaaauccaaagcaguguaguggugauuggucagugacuaaccaggcagcuaagaagucuuaggcagcagcccagacauguauagaggggcaguuagagggagaacaggggugggaaagggagcaaggggcagauagcucagcaaggaaagaaugggcucagaaaaaggagggcuggcuggaggagugaggggcagcuuaaguuuggggaggguagaaacgccguuuccuugggaacuggagugcaguaugagcugggugucacuuggcucugaacauacuggcuuugcuguaaugcuugaaaaggcguugguaucuucauuuuacaguucauuaacccaaguacguuuucuuauuuaaaugacaacuuuggugcuuuaaaaugagguaccacuuuuuaaagcuagcugugucgaguuaaagaaaaaaucagcaguuuuuucucccagaaauguaauugccaaacacuauucauccccaucuuaaguuuuacaaggugauguaaucagcuuguuguagugaugcuggccaaauggugcucagcaggugagaacaaaaaaaccccagaucucagugaacuaauacacagcuugagcguuuccaugugcuaauguugcacacuuacuaaaaaacuuuggaaauggaaaauaauguauuagugcaacaguugaugugcuucuuugggcaaagauauaguuuuguuccacaauuuguacuuaaaagcgaaagaacauugaaaacauagacuuacuggcuguagcaaugcuggccuguuaacugauaacuagaacuuagguucacguuuauguaaaguguguaaaaccuaguagagcuugcauagucggcacucaguaaauguuugguuccuuuugccccuugguaaguuuauuuuaccauccucccaccugccauucugacuuuauuaaaucaacauguggaccagaguguuaaugagauguuauugcagaagagauugagaaaauugguauaucaugcagauaacauacaaaaucuuuuuguaacguaaaaaaugcaguuuuauuauugcuugugccucaacuguuuaagugaauauuaaagggcuuggagaa

SEQ ID NO: 192008 - RNA, 8769 nt, Homo sapiens
agcugcagucugggagucuuuggaguaagaauggccuuggaagggaugagcaaacggaagagaaagagaaguguccaggaggggugaguggcgcgcggcacgaguaccuggggagggauguuguacguucccucgugcuggcgaagcgguggugcguggcguggcugaguuucugucguccauuucuagagagaauccugacgacggcguucgcgggaguccgccggaagacuacaggcuuggacaggucgccaguagcuuauuucgcggcgaacaccauuccagagguggcaccggucggcuggcgucccucuucaguucucuggagccccagauucaacccguguacgugccugugccuaaaguaagucacugggcuuucuucccgaauagcucguuagaaccacuuacauacaaagcaaucuucuuaccuaccgcgugaagcgugauuucuaaagggggcagacaggauucauuuuaaguaaccuuucaugacucuuacauaccagugagagagaagagauucucauuuagaaagacugaauuauggcuuagggucagaauucuagaaguauggggucucaaauauaacuucaaacuuuuaaaaagcaaaccaucaaaaaaacgaaacggaaugaggaggaagaaaguacaucccagauugaaagaccacuuucgcaagaaccugccaaaaaagugaaagcgaagaagaaacacacuaacgcagaaaaaaaguuggcagacagguugguaaaauucucuuauuugauguuaaagaaauuagaugguaaauuaacauuccuauacuuggaauauucgucaguuuuauuucauauuucuacuuucuuucaaaacuuuuauuauggaaaauccaguacauauagaaaaguugaaaaggcuaagaaaccccguguacucagcaucagcaauuacuaauauuuggcuaaccuuuuuguauuuuuaccccacucauauacccccucauuauuuguuuuuguuuguuuugagauggagucuugaugccacgcccaggcugcaguagagugcagugaucucagcucacugcaaccuccgcuucccagguucaagcgauucuccugccucggcccugaguaggugggacuacaggccugcgucaccaugcccagcuaauuuuuguauuuuuaguggagacaggguuucaccauguuggccaggcaggucuggaacuccugaccucaagcgaucugcccaccucggccuccgaaaguguugagauuacaggugugagccaccucgcccagcuaccaccucauuauuuggaagcaaaaugaaaauuuauguuucaucuauaaauauuucagcauguauauaaaagaauuugguuugcguuucuuuuuuuuuuuuugagacggaguuuugcucuuuuuguccagacuggagugcaguggccugaucucagcucacugcaaccuccaccucccggguuuaagugauuuuuccugccucaggccucccguggagcugagauuacaggugccaccaugcccgguuaauuuuuuguguuuuuaguagagacagaguuucaucauguuggccagguuggucuugaacuccugaccucaggugauccacccaccucagccuccuaaagugcagggauuauaggcaugagccacugcaccuggccugguuugcuuuuuaaaaaaaaaauuuuuuuuuuuuuuuuugagcuggagucucacucugucgccaaggcuggagugcaguggcgcaaucuugacucacugcaaccuccgccuccuggguucaagugauucuucugccucagccuacugagcagcugggacuaugggcgcgccaucacacccagcugauuuuuguauucuuaguagagacggggugucaccauauugaccagucuggucucgaacucuugaccucaugauccacuugccuccgccucccaaggugcugggauuacauacgugagccaucacaccuggccgaguuugguguucuuaaauuuauucauuucccucauuaacuuuuuuuuuuuuuuuuugagacaaggucuggcucugucacccagguuggagugcaguggugcgauugcggcucacugcaaucuuugcuucccagacucaauccagccgcccaccucagccuccuguguugcuuagacuauaggcaugccccaccaugcccagcuaauuuuuguauguuuuguagagacgggauuuugccauguugcccaggcuggucgcaaacugcuggacucaagugauccagucagcauuuuuuuuuuuuuuuuaguaaaaaaauagaaacagggucuugcuauguugcccaggcuaguccugaacuccugggcucaaaccauccuccuaccuccgucuccccaagugcuaggauuacaggcaugacccaccaugcccggccagcauaacguuguuuaacaguguauuugaaucaagaugcaaauagugaucccaucacguguaccuagcuaacagucuucauuccucucuucuuugccacucuccucaagccccuuauuuccuuuucccuuuucucauuucaacugaagaccuuuguaccaguucuggagcuguuaaucacugacaguugggaacugcuacuuuuuguccuauuuaaacuuaaugcaucuguacacagccauauuucuuccccucuuucuuagagcagagugucuucccucuuguccaagauuaacucaaccaccugggugcuguguguaccacauauguucugccuuuuuagggacugugccgucagauccauccacguucgccucuuucccuuaucccucguuuuuuuuuguuuuuuuuuuuuguuuugagauggcguuucacuguugucgcccaggcuggagagcaacagugcaauuuuugcucacugcaaccuccgccucuggguucaagcgauucuccugccucagccuccugaguagcugggauuacaggcgcccaccaccacacccagcuaauuuuuguauuuuuuugguagagaugggguuucaccauguuggccaggcuggccuugaacuccugaccucaggugauccacccgccuuggccucccaaagugcugggauuacaggcgugagccaccgcgccuggcccuuaucccucuuucugcuaauauagacgugcucacgauucuaaucuuuaaaaaggacauucccccuaaccgccaaaaaaaaaaacccauguaauugcaugucucuguuugcuaccauucccacaguccuucccuucagucuagcuuuuaagaaaaguagucuguucuuguacucucucccuucucuugaucuguucacccuuccacgcacuuggauucugguggugguggguuuuauucuccguccugacugugccacugaagcagugcccacugaggccacccugaccucucauauguaaugggcagugcagcuuuugucuuaugaguccucuguuaccuuucacguggcugcuuuucuuguugaagcuaccggauucucugagagaaaucucuucugauuguccucuugccaauucuuucuuaguguuacugugguaucuuuuccucugacuacucuuuaaaugugcauuucccucaggggucucauucuuggucauguucuugugacccuuugucacccuuuguugggggcaguaucucuugugcccaccgugaucucucuccugaucuccagacauguauguuuguuugccuccuggcauuugcaccucuuuauuccauauguaccaccagguaagaaugcuccacugggagcucaucauucucaucaguccuguuccuuggcaugagcgcuaccacuagccuucuaguugccuaaguuaguggcccgagagucauccugucuucuuuccucuccuugcuuagcuaaucaguugccgaguccugaugaugcuguuuuuuaauuaucucuuuaaucugccuuuucgucuucaccuccuucccugcucuggucagucuggucagucuucucagauacacacuguuguaaccaucuccuuacuggucucccuucuccaaccuuauccucuuucuaauuaucuuccacucuucugcccagaugaucuuuuuuagaugcucucaaagucuucagugucuccucaucuucaguaggauaaaaucuaagcacuuucguguaacacugaaggucucuccugaccugguucccaccuuacuguacugucucguuuccuuucacaccugcuagguacuuuauauacuguagugagcaaaacacuagacauggacccuguccucaggggaggaguaauagcagucagcuuuuauuggacuaugugccagacacugauuuccuccucugagaagccuuucucguuuauguuugcauaccauguauuauagcuguuaccauuuuauugugaacuuggucugucucuucacugcacuguuggaggccuuugauuguuucuuuaucuuuguauccucagagccuagaacugaguaggaacccgguaaguauuugcugaugagugagucauuuuuaugauucuuauuagcucuucucuucccucacuccuuaauauccuuuaguucuccuuucagauugaugcucagaccuugcuuauccauauccagcaauacuuuauauuguauuuaccguuucacaauuuacuuuugguaagaguccuuuaaauauuacagaaguauuagaaguagggaaucugguuuuuccuaucagccauauugcuuguacagaguaaguacucugcugccauauuaaccuuuuuagacucucagggagugugauagugccccuaaaggucuagaguagaaaaugaaaucaggcauugauagaguguaaacuaaaucuccaagagcuuuaagugaaucagcuuuuguauagaugaacuugcugcugcuguugcauggcagauuuaacguguucaaaaauugagcuucacuuauucuugccaggugcagugguucacgccuguaacccuagcacuuugggaggcugaggugggcgaauggcuugagcuuaggaguucaagaccagccugggcaacauagcaaaacccugucucuacaaaaaaauauaaaaggagacugggcgcgguggcucaugccuguaaucacaacacuuugggaggcugaggcgggcggagcaagaggucaggaguucgagaccagccuggccaacacagugaaaccucgucucugcuaaaaaaaaaaaauuagcugggcuugguggcaggugccuguaaucccagcuacuugggaggcugaggcaaaagaaucguugugaaccagagaggcggagguugcagugagccgagauugcgccacuauacuccagucugggagacagagcuagacucugucucaaaaaaaaaaaguauauauguauauauauauauauauauauauauauauauauauauauauauauguauauguauguauaaaagacuggacaugguggcucacaccuuuagucccagcacuuugggaggccaaggugggcagauaacuugaggucaggaguucaagacuagccuggccaacauggugaaaccccgucuuuacuaaaaauacaaaaauuagccuggcaugauggcagccaccuguaaucccagcuacuugggaggcuguggcaggaaaaucgcuugaacccgagaggcagaaguugcagugagccgaaauugcacuauugcacuccagccugggugacagagcaaaacuccgucucaaaaaaaaaaaaaaaaagccacgugugggggcaugcgccuguggucccaguuacuugggaggcugaggugggaggauugccugagccugggagguugaggcugcagugagcugugauuacgcugcuacacuccagccugggugacagagcaagacccugucucaaagaaaaaaaaaaagagcuuaacuuuuucuaaaucuugaguuaaaucauuuuuuuucuaaagauacuagucaguuucuagauagcgcugcucuaaaaauuuugauauauuugugaguaguaaaucuaggaaaauucagaagacauugggaaauauuucuagucgggaggguagggcugugcuuugucaaauacuagaccuaacuggcaugacucuuacugcuuauuuuauuuuuugccuuaaaaagggaaagcgcucuagcgagugcugauuuagaagaagaaauucaccagaaacaagggcagaaaaggaaaaauucucaaccugguguuaaaguagcagauagaaaaauacuugaugacacagaagacacaguugucagucaaagaaagaaaauucaaaucaaccaagaagaagagagauuaaagaaugagagaacuguguuuguugggaauuugccuguuacauguaauaagaaggugaguuuguauaugguaaaaguucagagaaguuaauaacuuuguucuuccuguguugaauaagcauucaauaguaagucauggauauaacuucauuguaaauuauuacauaaaucauccuaauaugaauggauuccaguauccacccccuccuuuucauuccuguagucccugccaauucaggcuuuugcagauuauauuugaauauugcagugaccuccugccugguuucuuucuuucagccuugucuccuguuauaugccacuagaaaguaagcuccauauguuuaaagaugucuuuccuuuuucuuuucuuuuucaggacagguucucacugucaccuaggcuggaguguaguggcaugaucauugcucacugcagccucaaacuccuggacucaagugaucuuacugccucagccuccugaguagcugggacuacaggcgcacgccaccgugccuggcuaauuuuuguguuuuuuuuuuugugacuauguugcccaggcuggucucaaacuccugggcuuaagugaucugcccuccuuagccucccaaggugcugggacuucaagcaugagccacugggccugauccucuuuuuucaucauucugucucucucucucuuuuuuuuuuuuugagacagagucucgcucuguugcccaggcuggagugcaguggcgcgaucucuguucacugcaagcuccgccuccuggguucacacccuucuccugccucagccuccugaguagcugggacuacaagcgcccgccaccacgcccagcuaauuuuuuguauuuuuaguagagacgggguuucacugugcuagccaggauggucucgauuuccugaccuugugauccguccgccucggccucccaaagugcugggauuacaggcaugagcaaccgcacccagccucguucugucucuugacaccugaaauggugccuugugcauaguaaauauguguuguuuaaagaaugaagauguccugaguuucuuccguugugugacgaucacugaagcaaaaccugcccuuugcuucugcauguucaugugauaguaacuguugcaauccuuagcucgguauccugcucauauuuugaaggacaguuuaaacucuacuugauuaaaaacaguagaaaaaccuuuuugaggccaggcgugguggcccacaccuguaaucccagcacucuggaaggccaaggcgggcggauccccugaggucgggaguucgagaccagcuuggccaacauggugaaaccgcuucucuacuaaaagucccaaaaauuagcuggguguggugacacaugccuguaaucccagcuacuuugaaggcuaaggcaggagaauugcuugaacccaggagggggagguugcagaagccaagaucgugccaccgcacuccagccugggugacagugagugagacucugucucaaaaaaaaaaaaaaaaguuuauuccugguuuaaaccaaugugaaaacaugagagaaucuauggaaguuauaagucuauccuuaauuuacaugugauaaagguuauaaaagauugaaagaaaagcauacauccgauggauacuaauaggagcuugaauuguguuuucuuuuuuuuuuuuugagacagagucucacaaguuucaguaaaauuuuuuuguucauccaacugaauagucaccuacuuuccugaaauguucuuaaaaacuggcaguaggccgggugcgguggcucaugccuguaaucccagcacuugaagaggcugaugugguugcaucaccugaggucaggaguuugagaccagacuggccaacauggcgaaaccccgucucuacuaaaaauacgaaaauuagcugagcaugguggcgggcgccuguaaucccagcuacuugggaggcugagguaugagaaucacuugaagccgugggggcggagguugcagugagcugagaucacaccacugcacuccagccugggcgaaagugcaagacucugucucaaaaaaaaaaaaaaaagccuggcaguagaggauuaucagacaauuuuucuuaauuccuuuuuguagcacuuauuugauguucugaaggucagcuaauguguauuuuuuuuuuuaauuuuagaagcugaagucguuuuuuaaagaguauggacaaauagaaucuguacgauuucguucucugguauguuucauucccccguaaaauuacauaauauuaaaauuuauugcauuuaaaucagaugaacuuauugcuguuagugagauggugaagcacuuuaaccuuuugaaucaauagguucaaauuuaacccaagaaaagaguugcucuuacuaucuacugcugacucuugaacuuuuuaaauaauguauugaguuuacuuaauaaaaugauacucuugcu

SEQ ID NO: 192009 - RNA, 63009 nt, Homo sapiens
aguuuucuccaacauggccgcgcccaggggagauggcgugcaaguauccgcugcgguguucuggugcuagaguggagaggcuggcaaagaagaaggcacacgcauggugagaauccggccugagccgaagcggagguguguggcacuucuuacuggcgggcauacgggcagcaaaucaccgcuuccucuuuucagccucuuccggucuucucuauccgccuugccagcuagggcugagaaccuagggaaaggggauggaucccagaggcgcccuuggugcagugugggcaguagggugucugcguugggugguucucucaguguuuagggugcauguguuuguguuugguucgggcgcucacguggugccugugucaaucuucuguuuucuuugggguuggagaggacgguugcaacauggggcguguuaguguggcgcuucuggggcuuuucugaccggugacaaucggucugauugcaucgaugcaaaggcagugcugaugaucugaucccuugcgcagcugagucuuccugugcucuuauuugagcaaucccugcgacuccuggaccucugguagcgucagccuguuauuuugauagauuucauugaauauuuauugucaguuguaugucaggcaccaagucugugcccuuaaauagaugacaguuuucuggccgaagcccaacacaaacaggcaauuauaauaccaugugagaacucuagagauagagguccaugcuagguguuaaugaaaacguugaagaaggccaccaaacucagaauucuggaggaggggagguuuaggagguaagacagcaaagucgauuuagguuuauucgacaaaugguuauugaguggcugcuaggugcuaaauccuguuuaagugcugggugcuacagggugaacaauagagacaaaaucucuacuucauggagugaguguucuuuauucaguuauggggaaagacagaauaaacaaauuaaugagaguguaagaaaauauguaguaaguguuauucaaagaguuaaaacggggugccgugacaagugauggggugaauuuuuuucuaaaaauuuuaaaucuuuauuuucuuuuuaaauagaugaugcaguuuaaauagcuacuaacuucaaaagucaugaaagaagaaagcucccuuucauuccuuuacucaucgauccauuuuccuucccuggaggcaacccauaucaccaauuucuuguguguccuaaagauuuauauguaaacucuguauaccagugccguacguuaaaauugggccucguuugauaggaaguuagauucuuucuaaucuuugcuauuaauuauuagguugugcaaaaguaaucaugguuuuugcauuuuuuuaaacauauaaguauaggaacauuugucuauacugcuuguuucauaauaggcucucuauuauucaaggagggcaugauguacauacuacuauuaccacguagggcaauaucuaguaggauauauuggcuuuaaacucacuaacaagcaaguagcagagcaugcauaaucuccaaacuuucauuaucccacagagaguacgcuuaggcuggagcuggcugaaccggacucagcauggcuaguaucauaguuaauagugacuucacuccaguaaugucacagggagcauccaaguaucugugcauuaguggaaacucuggccagggaaguggcuuugucagaagggggcaccuccagaccucagcagcugguaucagccuauccuuguugagaugacucagauauguugggccagcacauugccuagccacuggaaugguggaaaacugagccucaaaggccauuuagugucuuucuucacgugcaauaauauugcaugacugagggagagaaaaaggaaagggaugacaaaaaugugguuaugaggcuccaccugcuggugcuggacucuuaguggcagacauuuuaaaaagauauauuuagcaucguuucuuucucauuccuucuuugcaguguuugcucaugugaaauauuaaaaauucuguagugcagucaucccuuguucuccaugacauacugcaaaguugcuguuccacagaugaagaucuugaaauggaauggcucuaaaauagcuccuuugaagggccucagauauucuuuguuuuguuaagccauuuugaucugcugcuucugaaaaucaacaguaauaaauaaauaauaauaaauaaauuuaauucuaagaaagcuaugggauaggcacuauuauuuuuaucccuauuccuagauaaagaaacuggaacacagagcuauauaaccaacucaucuaggauuauacagcuaauaaucagugguugagcugagauuugaaccuggaacauggacuccuaaacacuguauuauauuaccucauagcacugaaugaggcucugugguaacuaagaaaagugugauuuaaucccgccuucagaaagcucacaguucaguggaaggggacagauacuaaaacaaauaauuauaauuaaugcaauguuagacauguccauucacuuauccccuuccugucuuaaugacgacugacuccuaaaccuuuuuaaccucaguuccuuuccuaggagccacuuuauuuugucacuugccagccagacauugcaacucuguaucucacaauaccuuaaacauuauucuauccuaaauaugacucauuaccuccuauacugagcagcucuuccugaaccuccuccugacuuuccaguuuugaagugguagcacucaucucuuagucacucagccucuaacugguuaacaaguaaucuuugauuccugucucccucauaucuggguagucaucgaggccucuugauuccgccugaacuuuucacucacccuuccucuuucuccucucccccuauuucgcuucuuucuguugcccccagccuagaucaggccagcauuucuaauuaacaagcuggauuauuauuauuauuuuuuuuaccucucaucucucugcuaugcugccagccagccugccugccucacuggccuuacauccuaguauguacccccugugcuaggaagcuggacugcuggcauuuuaagagacuuggcauuugucuucuauacuaaagauuaguaauuagaauuuugacuguuuaugauuucaugugaaauaagauaaauaagauuuuauuuaacccccaaauuuguauauuugguugacuuugaagacuuuaaaguccgcagagagugggaccggucuaaaaaaauuaugccugugucuuggugucuuggccaaacauguccauuuugguuuuagcuucugcucuuuacugccucacugaauacuuuccuuuuuauuugauucuauaguguucuuauccuucaguacauggcacaaaucuccuguuuugaggccuucccaacuuuuccaguuuacauacuuuuuuuuuuuuuuugagauggaauuucacucuguugccaggcuggaguguaguagcaugaucuuggcucacugcaaccucugccucccggguucaagcgauucucgugccucagccucccaaguaguugggacuacaggugcccaccaccacacguggcuaauuuuuuguacuuuuaguagagacagaguuucaccauguugaccaggcuggucuugaacuccugaccucaagugaucugccugccuuggccuccuaaagauuacaggugugagucacugcucccagcccacauccaucuuauuuuugucucuaauuugugucauaccuaaagacuguaccaucagcauuaaauuauauaaagaugugucauagucuuauuguuuaguguuuguuuuccacaacuaaguuacaaacuuguugaaagcauaaacuauguacuuuauuaugguugcaugcugcagggugcugagacuguguguauucacucauuuauuauucauuuagcccuaccaucaaauauuuauugagcaacuacuaugugcuggcauuccugcucucuugggauuuauaucaugauggaggaguuaagcuaacagaugaaucaucacaaauuauguuacauuuugugaacaaaauaaaagacuacugugauaaagugugauaaagcaugauauugggugcugauuuggauggugugauuauagagaccucuuugggauucuguuauuuaaaaaauuguagauauaaaauauaugacacauacaguuuuuaaaauaguaaaacaaacaccuacaccuaccauguaacugaagaaacacccuuugaugcuccuaugugucacuuucauguuaauuuccuuuccuuucacccacagaaauagccucucuccugaauuuuguguuuauaauuuccuugcuuuuuuuuuuggcacugcuauguauguauuucuaaauaauauauggcuuacuuuuugauuaugaccuuuauguaaauggaaucauacuguagagucugcuaauuuuuuguguguuauuucuccccccaccgcuccccugccugcuccuugccuugguuuacguuauaguugugaaauuuguguauggcacauuuuacuuaggaccucauaaguaaagaauucaucaccuaugaguaaaauagcacacuuaauggagcuaccacauuggaacauuuuuuagaaccaucagagcuaugcuauuagauauucuuagauauuuguucauuuuuuauuuaucuguucucacuucucuuaguugguacaagguaaaugaagcauuuuuaaaaaauugucacagaaauauugauaaacuauagaauguaugaauaacaucauuauaauuguuccuucaggacucuuaagguugacuuuuuuacugucuuguuuuuuuacaguuugcuauggacagcaaccaucaaaguaauuacaaacucaguaaaacugagaagaaguucuuaaggaaacagauuaaagccaagcauacuuugcugagacaugaaggcauugagacaguauccuaugccacucaggugaccuaaaacuacuauuauuauuagaauguaaauguacugacauguuaauguauuauauuaauauuugcuaauaauugccuaaggcuguaauuguucagucauguguuacauccauauuagagguacauaugauaugaacugcuaacuuucuauuuugguccauagccuauaguuugcauuucuauuuauuuuguuguuugaacuagaagagguuguaguuauauauuaauaauaauacugugcaaguuucucaguuuccuaagcauacuuauauucauuauuauauuuaauucccuagaaguccuuaugagauaggugagaaaacuaaaguucugagagguuaugauaugucuccauugauauaagcuaguaaguagcuaauagaaacuuaaagcuagaucuuccauauccuacuacagcccuuguucuucucuucccaaccuuaaccuguuuuauaaaguauuuugauuaugugcuguuaaacauuuuuauuuuauuagaccuuauuaacaaagucuuuucauuaucugcggacaauaauuaaaugagaugauaaaugugaggaucgugagauuuccuggguuaugaauuaggagaacucaguuuaacucuuagcuuuucuggacacgaguaguaguauccucugaccucagcuuucuucauuuuuaagcagggcauaguauugcauaccuuuuuaaccccauuagauuguuagauuccagagaaucuaauuguacuuacuggacauuaaauuacuccaugaauauaaggaguucuuaucuuuuuggcucauaaaguuauagaauaaaaguagaaaguaagcuuuagauaucauuuaauugagggguggacauacaauugagaagguggagcagggauuaaaacuuaggccucucaacucucagaccaauacucuugccuuaaugcuuacuaugcugucuucuguacaacaucauagcuugagaaugagcagucuguugaggcacauuugaauuuaggagguaaaaggcccauacuuggaguuaaauauuaaugucuucagagaauuuaagccacauuccuauagcaaggaugaaauagauaauagauuagaauuaauauguuugcauacacuuuacuguuucagucaagagccacugaggcugugagacauucagaagauuaaacugacauacacugcucucaucacuuuccaagagugacuuguguuccuuuccuuacaggguuuaugaagagaaguagcaagaaaaaaaaaauaggcuccauuucuuugaccccucugaagcuuguuucugguugggucugccuuuucuuuaggaucucuagaagcuuugauguccuucauggcuuccaaaguagcauuuuauuuaggcuuucuuuuuucuccauauucuuaaaggaaaagaauaaaauuguagauggaccucuaauuauauuuuaucuuuccaggggagagcaaauauuguuuuaaugauauuguauuagucuguugucaugcugcugauaaagacauacccgagacuggguaauuuuuuaaagagaaagagguuuaaugaacccacaguuccacguggccggggaggccucacaaucguggcagaaggcgaaaguccuggcuuacauggcggcaggcaagaaagaaugagagccaagcgaaaggggaaaccccuuauaaaaccaucagaucucaugagacuuauucacuaccacgagaacauuauaggggaaauggcccccaugauucaauuauuucccagugggucccucccacaaaaugugggaauuaugggagcuaaaauucaagaugagauuuggguggggacacgccaaaccauaucggauguauuauaauuuuaggcuccuuuguacaaauuuauggcauuacagauuuuucuagagcaaugauccucaaauugucaggaccaaagauaacuuaaaaaaaauucacauucucuacuucauacauacuccuccuuauuuagaaaauugcuugaacaauuauaaauaaaauaauaguuccauuuaauuauugcauuaauuauauuacauuuaguuaugacauuuaauuauauguaucucacauuuaauggaaaauaaguuccucuccucuucuaccgcacuuguuuuugugugguuuaccuuuagaguugcccacaaaacacucagacggcaucuuagaggacuucuaguauuccugaagucauacuucaucaucuuccauuccuagaugggguaguggacccucaacaccaaugaaaccuuugcucuuccauagauuuaggaauaugggaauguuuuugcaacuauggccacauauaaccaaguuauuuugguauuuuaauuaauaaaccucauuaagugagguccagggcaagccaucugagacuccauuuuacuccauaucauauaguauuguauuagugggcuuguuuauuauguauguauaugcuugcaugcauacaaaguacuggcugucccaugacaaaacaguuuuacuuuccuuauuguccaauuucauaauaauucuuuuauauccuuuucaaacaaaguucuagguauucuuauuuuguguaauaaaccaauacacaauguacuaucacugagcuuaguauaaauuaaggguuggcaaacuacuguccuuagacuaaaucaggguugugaccaaaauaaugaguuuuacauucuuaaaguguuaaaaaauaauacuaagacuaucugacagaaacuuuuauggccugccaagccuaaaauauuuacuaucuaccucuucucagaaaaacgucaucaacaccugguauaaaugaagaaauugaugagaguaggccauccauggcuuucuuuuguuauauugaaauguuuuuagaagucauagaacauaaauuaaaaaucuuuacauuguauagaaugguuaaguauagagacuauaugggugcuagaccaugaacaucagaauaaaaauaagagacuccucuuucaucccugcaaaauuuccuugaauaaaguuuagugcaggacuaugcaaacagcaggaaguaaucgugaaacuuacaaaggaaaaaguuuucauugugaacugacugaauuacuuagucugaauuuccuuagaggaaaauuuuuuccuaauuauguucaauagaagcuauaauugguuuuucuuugagguaauaguaccuuuacuuuuaauuuuuaguaaacauuguauaaugguuauauuaaaagugcggauccuggaaacggacagaaauagguuuaaacccaccccuaaucaccaccuuaaccuaauuugucagaucuucuucuaugaaauugggcugauauuacccaaauaaauucaauauguugugaagauuauguuaaugaggauugaguagauaaaagcuuauagaacagucuugccaaaaagcaaguguuauguaacuguccuuucuccucuccaccucuuucauuauguuaaauuuauauuucugaauaauagucauguuuuaauuugcauuuauggucauuuagaaaugaauauuuugugaaauuggcuauuuaaacaacacaauuuacaauauaggaguccuuuuuauuccccaaauuuuuaguaaauugguuuacauacuuuguaugaaauuagcaaaccaaacaaccacuacaaggaaaugcuuuuuuuuucuuaauuacaucuuuuuuaaaaaaaaucuuauuuuaaaacaaauggguugguaucaguugcucauguuacuuucuuuuuguuuguuuguuuguuuuuuaagagccugguuguugccaauggugguuuggguaauggugugagucggaaccagcugcucccgguuuuagagaaauguggacugguggaugcucucuuaaugccaccuaacaagccguacucauuugcaagauacagaacuacagaagaaucuaagagagccuauguuacccucaauggaaaagaaguaguggaugauuuaggacaaaagaucacucuguauuugaauuuuguggaaaaagguauuaucauacaauuaucuuuuaaaaaaugauucuucuggguguuuucuuuucauagacuuaaguugggagguucaguuauugugaaacaaaaugaggaagcagguuagcagcuccuuuuacuuuaacaaacauucuuuaagcaccuauuugugccaggcaugggacaaguaguugacaguacagaggugaauaagauacaaccugccuuuacaaagcuagucccaccagucaacaauauauuuauuaggcacauggcuuauuuuggaacccuccugccuaauuguguuuuucaaaauuuaauaaugaggguuugcauuacuaguuuauuucacauaucuacccaggagcuuugaauuaaucacuuaagaaugaaucgugauccaaaugaucauguaccaaucuucauauuuauagcagaacaccuguagcuaccaaagauuccuaaaacuuuauuuuuauuuauuuauuuauuuuuuugcuuuuugagacagaguuuugcucuuguugcccaggcuggagugcaauggcacaaucucggcucacugcaaccuccaccucccggguucaagcaauucuccugccucagccuccuaaguagcugggauuacaggcaugugccaccaugccuggcuaauuuuuguauuuuuaguagagaugggguuucaccguguuggccagucuggccucgaacuccugaccucguaauccgccugccuuggccucccaaagugcugggauuacaggcgugagccaccgugcccggcugauuccuaaaacuuuaugguggugcuguccaguagaacuuccugugaugguagaaauguuccugucugugcugcccaguucaauagccacuggauagucugauugaggaacugaauaauuuaauuaaauaaguauagcuuuauauauugauuuacagaauuguacaggaauuauuacuucugccccaugaaaaugagauguauugagaugaacuuagauuuaaacaucuaaucauauauucauuugccaccuauuuaggcaguaaaagagcccuguuuuagauauccuaggaguggguaggugacuauaaucugcucaaauuuauguuuuuguaaaauaagacucgaaggaaaacuuuuacagacucuuuuaaagguauauuuuagaaacuauauuucucagugcucauaugcauuuaauuuuaaaucugacuuaagcuuuacauauuuuggaaacuagauuauccucauguuuuacauguuucuggucaguuuuugaaaacugaguggcugaggaguaaguuuuaaucagaaaauagucauuggguuuacccccguccuccauggugaauauucaguaagaaauugcacaaaguaaguuuuggagugcucuuuauuugaaauucuucauuagauccauauguacuuuuaaggcucuggcaaucacauuuauaaccuugaaagucauuuuuaauugagaacagaagugugucacaaauaguuuuuuuuauuuuuuuuugagacagaguccugcucuuucaccuaggcuggagugcaguggcacgaucucagcucacugcaagcuccaccucccggguucacaccauucuccuuccucagccucccgagaagcugagacuacaggugcccgccacugcggccggcuaauuuuuuuguauuuuuaguagagacgggguuuuacaguguuagccaggauggucuugaucuccugaccucgugauccgcccaccucggacucccaaagugcugggauuauaagugugagccaccgcacccagccaucacaaauaguuuaaugcuuguuuagauaucugcuaccaggcagcacugaauaacaaauagaagagauauuuuuaauucuuuuuaaaacaacauauuucggaaacuaaauccaaauuacuuacacuguaaauuacuuuucuuuaaggaauucuuugcaaaguuuuccuuacauaauuugaauacauaauauaaugucuggcacauaguaggcagugguauguauuuagcaaaugauuuacuauucauguuucugaaauguuauuaauagaaucuaguaaauaguugcuauuuuugugaauuaaauaauucaaagauuuaaucugccuggcagaaaacuguccagcagaaaagcuucagagaucauguguauaacaugaaugaucagaucucuaacaauaaaugugaauacacuauucccuuuguuuaauagcagauucuuuuuucuuuuccuucuagagcuauaccuaucugaaacuuugaaggacacaggaacuuaaauuauuuuaacaucugcuaaauaauucuucauaaaugauauuuuguauuucuuuagaaaguuguauuuuauuuuacauuucucuauuauauuuucuauuucuauuuacuauagauaguaucaagagccuaagagcaaaaaugaguauuuaaauucuuguauucauuauuuagacuaucugacuuuuuaauggagaugcauacuguggauauuaugagaaaccuugugagauuuuaaaagugacuucaucauguucacaccggcuacuuaaauaaauacuguucuguuugcuguugguaauugcaguggauaaaguguaccaucauuuugaucuuggucuuuguuucugcacuuuuaauauguugggugccuuucagcaaucuuguuuccgaaaaugaggauuugaaguuuugugaacugauaaagaguuauugggcagaauuauuuguauauaggaacuuuaaguuuugcaugugacuauuuuaauuugguuucccauagugcaguggaaggaguugaggccucaagccuuaccaccaggacucaugguaguagaagaaauaauuucuucugaggaggagaaaaugcuuuuggaaaguguugauuggacagaagauacagacaaucaaaacuguaaguaaaacuuucaaaaucugauauuugaaaguuucugcaaaacucuucuuccuuuccucugucuuucaugguuuauuaauauuuccucaaaauuacugaaacuagcccggauccaauguuaggcaagucauaccaacaauucuuaggaacauuaauaauaaauaacauuuauauagcuaucaaauuuuaacuccaaacugauuaguauuauccaacauuuauauagcuuuuauaagccuuuucacuuauuuuauucauuccuccccacccuaaggcaaguuuuccuugaggaauuagcaguucaguaccacaauauuauaauauagugagagcuuccuggagauauuugcaaauuggaguuuuucugacucuuucuagcucauuggcaauguuguaaaugguaguguacauguuaguuuucagauugauuggguaaaacucuugaagaguuuguuacaauuuuagacuugaaauaacaacaaauauaaggcaaaaugguuaauuuuguuaaagaccauaauuuaccaauuaacagaaguugccauuacuaaacuaauccuuacucaaaaaguugacugaaauaugcaaaggaauguaauucuuuuccuucuuaauuguuuacuuuguucucuucacacagcucaaaaauccuuaaaacacagaagaguaaagcauuuugguuaugaguuccacuaugagaacaacaauguagauaaagauaagccauuaucuggggguaaguaauugcuaauacauaauaaauucuggcucaaaaauauuaauauauuaguagaauaugauaguugggggauuauguuucuuuugucauuuguagauaaacuuucugaacaguuuauuuaaaacacuuuaauuagauaaauuguauaguuuuguuguaaaaaaauuucaaacuggauagagcugaaguucaucauuauuauccuuauucccaugcugcuucucauuuuacugaaugauccauaauagcuuauucaaauaguucucuaucgauagacauuuagguuguuucugguuuuuagcuuucauaaguaaugcugcugugaauaucuuugaacaugccucugugcccugugcaagaguuucucaagggagacuacuaagaaguagaauugucauguugaaguuuauguucacuaaaaaacguuaauugauacugacaaauugcuuccuaaaacaguuguaccagcauauucucaccaaauguguaccuacuuccccauuccccaaccugugguguuguaaagcuuuuaaauuuauaauuucuugauuacugguaagguuggucauuuguauuuccuuuccugugaauuccuuuuuauauucuuugccaguuuuuucccaaugaagugucuaauugauuaagaauuuacuguauauucuggcuuuuaauccauugauauaauugguauaauucuuuguuggaguuaaauuuaucuauuuuuuuaaugacuuuggucucacuuaaggcuuuucuuccaucaugaaacaacauuuaugacuccaauaaaaguaaguuaguuccacuuuggaagauguguuuuuuuuaagggaaauaauuuaaaauaauuaaauuuaaaauaaaugguauaauuuaaaauaacaaaaaaagaaaguggacaauuucaauauauaguauauuuuuauaauuuuauugcuauuuuauaaaauaccaaaacuguuguuagaauuguucuuuuaaacuuuuuaucugaaaaaaaaucaaugaaaugacuuuaaaagauuccuaaauuuuuuuauuuuuuaauuuuguuuugcuuguggguuuauuaauggaccugacugcuaaauuaaaagcucagagauuuauaucacagugacuuuuaaaauuguugaguaaaacaagcaaaguaaauauuuuaauguuuugucuuuaugauuacucauuguaggucuuccugacauuugugaaagcuuuuuggagaaaugguugaggaaagguuacauuaaacauaaaccugaucaaaugaccauaaaucaguaugaaccugggcaaggugaguauuucuuguucaaaaauuuuagucacauauuuuggaacugaguagaugauauaauucucuaagggcagauauauuauuauuauuauuauuauuauuuuuuuuuuuuugagauggaguuucgcucuuguugcccaugcuggagugcaacggcguggucucgguucacugcaaccucugccuccuggguucaagugauucuccugccucagcuucccaaguagcugggauuacaggcgcacaccaucauggcccaacuaauuuuuguauuuuuguagagaugggguuucaccauguuggccaggcuagucucaaacuccugaccucaggugaucugcccgccucagccucccaaagugcugggauuacaggcaugagccaccgcgcccagccaagcaaauacauuauuuuuaagcucaaauuaacugucagauugccuugcuuauguuuguuacuuguguugacuucagucuuugcaaaucuacacuuuaaucccuugaggaacuugcauuucaaaguguaaacacacugauacaaaucacuguuugugauuuuuuuuguuuguuucccuuucaacguuuccuuuagagagggaagacauuggucugaaaaacauaggagacguguaauggaagaaaccaaauaauuuauagauagaagaaggcugauugguuggaugaucuuucucuucuuucuauuugauaauaugggagacaauugcaggaugacauucuggugaaaaaucuuuaugauacugauuucuuauacuuguuagcagcaucuucaucugacguuuauagcaaucaaaugauuuuaaggguuuuauuuuuuacuuuuuuuggcuuaaacaacagaaauguauuuuuucacaguguagaggcugggaaguucaagaucaaggugcugguugauuggguuccuggugaggccucccuuccuggcuugucaucagccaccuucucucaauguccucacauguccuuuucucugugugugcaugugcauggagagagagcgagcuuccacguguaagauuagggccccacacuuaugacgucuuuaauuuaaggguuuuauuaacggcaggaguuauggaguuuuguuuucuuuucuacauuuauuauaaugaaaacugauggcuuuagauuuguagcuguggauuugugaauacuacaccucugaauuagagagacaugcugaccuugucucuagcacagcgagacaacugaagcugaagcagaggccguuccuguagagcacagaggccggggccacucuuaaagacgcagaggccuguaggaugaaaugugaaggagcauguguuagcuccugcaaaccagcuggcucugaaaaugagagggaagggcugagccaaguaagcuugaccccagauuaacuagucagccagggcauuucuucuuugccuuucuuaccuagcugucuuuccauuggcuuguaagcucuuugaggacagggacccuccuacuggcuuuguauacccucaccguguagcaacauuucuuuuacuuaagaggugcugaguuaauguaaauugauagaucaguggagaaguccauaucguaauuauugauacgccuagucuuuauaccugguuauugcuuuuguucugcaaguacuugggaauccaguguuugaagguaaaaaugacuuuuguauuugucuuucacauuuuccucuugggcuggaauugaguuaaguguccuaguuaaucagugacuccugagccuugauuuuagaucaaaccccaauggcacuuuaacuugaaguuaagauauuuuuaguuuauuuuaguauguuuuagucacauucacccuaaauguuuccuuuuaaccaaaauuauaguaccuuccugauuaccaagcaauguuuucaccuuaauagcauaaggcuacauuuauagccaucuuaaaucuacuaaaggaaaaaaugaagugacguguuguccuguuuuccaucucaggaauucccgcucauauugauacacauuccgcuuuugaggaugagaucguuucucucaguuuggggucagagguaaauggucauuuuuauuagcuaucaucauauaucuuaccuuguacaaugcccuuuucaaagauuauccacauucuuaaugaaaaugaauuaagauuuaaaaaugaaaaauaagggcaccauuagcacuuugguuucuuuuaaauguccucuucuuuuaaauauccaaaauuuuaucugucaccucaucagaugccaggaaaacaacuugaaauuuaauuuuuuacacgaaacuuuuagcaguuaaauaagaucuagacuuuccuugguacaauguggcccauuucugaccuacuggugcagcauugccaucuaguggcaaaagauaguagcuucaugccauagaaaaaggaaacaaauuaaaauguguguucugaauuuugaugaacuuuuuccguauguuaccugauucaaucccuucaaaaacucugagaaguagaggguaauaucuucauuuuuacagaugaagaauaagagguucauguuuauucauugauuuguuucuguagcugcacuuugcuugagccacuaaaagaaaauauuacaugugaagugauccacgcaaccuacaagcagauuuuuggauagaaaucagaauuuuaggcugggugcgguggcuuaugccuguaaucccagcacuuugggaggcugaggcgggcagaucacgaggucaggagauuaagaccauccuggcuaacacggugaaaccccgucucuacuaaaaauacaaaaaaauuagccgggcaugguggcaugugccuguagucccagcuacucgggaggcugaggcaggagaaucacuugaaccugggaggcagagguugcagugagccgagauugcgccacugcacuccagcccgggugacagagugagacucugacucaaaaaaaaaaaaagaaagaaaaucagaauuuuaaaucuggaagaguccuuaaaacaucaggucaucuaaucuaauuagagucuguaucaaauucugaucuuguuccuggaggcaaaaacuauucauuuuuguuuucccguauuuguauaguuuccaucauuagaucuucaguguuuuggccucuuaacccuucccgagcuuguguagucauguugauacugucacuugacaauuagugguguuugauaugacacaaccaucuuauuaacuauguauguagauucuuaauacaggugcuuuaaaaaauaaugagaucggggaggaaaaaacacucuucucucucugguuucuuuuuuauuuuuaccccccauccuugcuucuagcuuuagggaccaguaaaggacaucuucucauuuuccucccaacuguguaaccaacugagaaaugagacaaaagauaauucgagaucagaguguuaacuuuacuacugagaaaacugauggcagaacaugacuuuagaucuguagccaagugaacuuguuaauacuucaccucugaauuaaagagacauacugaccuugucacuggcguagcuggacaacuggagaccuuccccauggaggcagaggcuguucguauaacaggacacgaaggagcuccucuaacaggacauguguuagcuccuacaaaccagcuggcucugaaaaugagaggaaagggcugagccaagugagccuggcuucagaguaaccaauaagcaaaggcauuccuuguuuucaggagaguuguaagugaagggguggaaaaaaacuaggagugugcuuucuacuuuuuauuccuagggaaguucccuuccuucccagggagauaugagaaaugaggacucaauaucccccccagcgcccuagaagaucauugcacagguuuuaauuagaaauuaugaagaagggaaaauuugcccuuuaguugaacugaaaaucugcugcauucauuaucucuauuuggugucucuggaagcauauaauuuucagcugccaauuugaaugacguuugguuaaagccaucuuuguaauggcuggaaagugugcauaaguuaugacaggaacaguagauuuucuuuuaaaauaccuuugagaguaagugaaucauuguaauuuugaaaaaugaaguuuauuuuuaugauuacuugaacauauucuuaaaacccuuauaauuuuaaguuuauaauguuuguuucagcuuauaauacuauuuaaaacaguccacuaaauuugggccuuuauuucaucuauaaaaugagauuaauaauauuucuuuccuggcugaaggauugugauagaaauaaaaugagguaauguaugugaaaguauuuuucaaauucagaguaauccaugcguguaaaggcuccuucagguguaucuguucuagggcuccuuacuuaaagccuucacuucuguaacaggaggaagcucauguucccacagccuagaaguaggauuucaaguggucaugagagagaugacuuuccacucuugcaacuugugcuguucuguuuuauugauugauugaugcuguguaauuacuugaauuucuccuagcaccuuacuccacaccuagaaucugaguacuauaccuuuggcccuauuucuuuacuuucuuaucuuugacauccucagucguuuuaagaacuuuccuguaaugccuauggcagcuuccauuucauuguaauaauuuugucaguggcauuauuguuuugguuuuuuguaaugcuuuuucguuuuguuuggcuuaaauauaaugucaaagacucagcuaaagucauugacguuauauuuaauacuuuacuuuucucucuuucccaggaaauuucuaagaucucuuucaauucuuaaauguuccaacucaugguguucccaugagguauucuuaacuuuaauauaauucuucaaugcuuuauuacuuaaaaugcuuuauuuguaugacuacuggagcauauucuuuuuaaagcucuuauaguaugucuaaaaauaguguacauuuuauauuaagcaaaaauagucuuguuuuuuucaaauacauuaguuuucccucuacaacuaaguugugauuuucuuuaaggcuuuuguaccuucgaaauauguaugauauguguauaagugaggaugauuuagcugcaauuaacagcagaaaacccaaauaaaaaugauuacaaggcaaaacaaguuaauaucucauauaacaagauaucucaaggaaggcugguuccaaaaguuuuaacuuguuggcucaggucgguaauuucaucaaggaaccaaccaauuucuuuccaucucaaauacucagugcuccccuaacugaggaugagcuuagggaaauauccaaggaguaggcugcaucggguuauaugacaauaacauauaccugugaagucuacuaggcuuuuguuuuuagguaauccuucacugaugaauuuguccugccguaaauugcagccugccuuugcuggccaggcauguuuugagagaugcccuugcuauaaccuuuuaugauaauaaacuaguaauguuguugggcagauaacucaguucaucaaguaccguaagaguuggucagcugauaaugaaaauaacuauuuaaugugcaucucccuaaaaccaauaccuaacuucuauuauaaauaaggaagaaaacuuuugauuaggacuuaucugggaaaacgaaacuaaaauuuaugaagaugauuuuuaaagaaaaauuuuauuuaacaauuuuuagguuauauuacaacuauguacuaauuuuuuagaacaaagaaugagucacgugaacuuuguuuuuggucuuguuuuucugauaaaauaugguagcaugauaaaaauuccuuuauuugacuuuuauagcuugauuauaaagagugcguuguuguguuauuugcuuuauuuuucucuucguugugaaaguccugacucugccagauuuucagauguuuaauggauuugcaugugauuuaaaugguccucugacaucccuuuuaucaauuucgggaaguccaucuuuugugagaauugcaauuucaauuaguuuuggguuugcauugcacuggcuaguauuuauauaaucaacauucacugaaagacugaccaaagggauuaccauaaugggcagagauagcugcugauauugaagagagagagagcuauuugggcaaguacuaauuuuauggaaguccguucaucaguaaauauuucuuauuaugaugacuuuugcaacucaguggguggggauaauuggauaguuggguaguaaagaccccaucugcugaauguuugcuauagaaggccacgucuuucaguauauuuccugcucucuuuccaggcucaugcuuucagcaaauaccuguugaguccugccugacuccuauguugagucauaggguacugaguaaaaauuauuuaugcaguaucuugaaauaccuagcugaauggguuuuuuuagucauuguuuuuuguuuuguauucccagucuggucaaucagaaugacucacaggguacuucuguucuaagaguuuauuguuuuaauggacaaauguuucauuauuuucagaucuuuagcacaaacuggaaaaaacacccagacauuuucuuuauaccacuuaaaacaacaauacagucuggaccgcagacauacuggcuucaucuccaaccucaaauucagcccucaauauuugccuauauaagcaauguuuacagccucagaagccaaacaaucucuucuuuuaguuuuuaucuugauuccaggccccauacuuuauucuuaucugagaguccuuggaauauuuucauuuccugaaguucugaaaaauggauugucucugcuguguagcuccucucuccuuucucucauucuuuauagcuuauuuaugauuuuuuuacucugucucuguagugccuuuagcauuaaaaagauagugaucuaccauccugguggguguguauuucuccuucuuugugugugugugugugugugugugugugugugugugugugugugugguuuguaucuaaagccauggugacuucuguauggcucuauauguauauugauguagaugugggaaaagaguguaauucucauguggguucuuuaguugcaucauaguauaauuaaaguggcauugggccaaucuucauuuuuccuuuuauccugugggucucuaacauucaaaacuucuggaguagacaaguagaucugcugguuugugggccagaaauaaauaaauggucuaccuuguuugaucaugucauuuuuuauacauugaauucuauuuuucacuuuuaagcacuuuccuuaguaacuuaaguucugaagauucuucuauuuuuauguaauuuucucaucuuucaggaucucuuggaagccagcauucucuuuugcauaaauuggucaaauaagacucaaugcugacaguucuuaacaggcacucuuuaucuuuuuucuguggagugggagcuucuuuagucaagccccuucaauaaggauaaugucaaagaaguauaccuguuucagccagcagucugcuaacaaagucuguuucauggcaugacaucauaaaauagaacaugcugcuguauuuggagccuuuggaguacugauucuuccaucuuuucaguuagaacuaugugcauuuacuuuguagcaagaaagcagcauuauaucacuccaucuggauuguagaacuagaauaaaauucagaaaaaucaauagaguucagaaaacuacaguagaagcccgcuuaagugguauagaugaaacuaccaguuggcugcacuuaaauuagggaauagucauaauaaaagauauguacauacugcagacauuuuaacacauauaaauucacucaucaauauuuuguugcggggccaaagucuuugcaucugugaggggccacagucugcuuugucucuccaauuucauuucuuuaaagugaagcaaacguuuaaagacaugaaaccaucugaaugugggguuuuacauuuugauguuuuuguuuccaauauuuuauaaucaaauuuucacauuuauuggaacauuaaauuuauuuuuugccuuuauugagucauucuacaauauucaacuuggcuucuauagaaaaaugcuaucuuuucucgcuuaauuuucauucauuuauguaauauuaaauuaaauaaaauaauuacaaugauaaggguaacuggcacagugauuugggaacauacacaauuugacuuguuaagcauauagcucuacuggugagaauagaagugcauggacauauuggagaguugucuaucaucaacaaauauucagggcauggguacacauuauagaaggaauggagcauguugguugguuaaauggauguugguuaaaagaacuuuuacuuaugugaccagcauuguccugugcauucuaggggauacagaaauaccuucaaccuugauuuuuuuccccucagauauuagaccugaauaucuaacauucuucuuuuuuuuuugagacgaagucucucucuguuguccaggcuggagugcaguggugugaucuuggcucacugcaaccuccgccuccggguucaagcaauucugugccucagccuuccaagcagcugggauuacaggugcccaccaccacgcguggcugauuuuuguauuuuuaguagagacaggguuucaccaucuuggccaggcuggucuugaacuccugaccuugugauccacccgccuuggccuauauccaacauucuaaaagggauuuuaacuugucuaaaucaaagcucauugucuuuguuuucagcgauucaccguccacugucauucucccauacggaacaaaaucuuugcucuuucuggguuuccugcucugguuaaugaccccacugucauuagaacauucagaacauggcaaauauuccuguuuuuugagacaggaucuugcucuguugcccaggcuggagugcaguggcacacucauggcucacugcggccucgaccucccagucucaagcaacccucccaccuuagccauccuaguagcagguacugcaggcacgagcuaccaugcccagcuaauuuuuguauuuuuuguagaaacgggguuuugcccuguugcccaagcuggucuugaauuccugggcucaagcagucugcccuaccuuggcaucccaaggugcugggauuacaggcaugaaccauugcaccugguuggugucaaauauucuugaaauguauuucaaugauuauaaauuuugcuuuuaaguaccgcuuuauugcaucccauguuuucuguuaaaaacugcuuuguggagauauaacugacgucccaagcacugcacauacuuaauaaaaagcucaugaaaccuucaccacacucaagauaaugaacauauccaucauucccacaagcuuccucaugcacuaauuuuuccucaugcacuaaagauuucaucuacuuuuuuguggcuuauguuauugcucuuguuacauuugagggugacuuuuguuuauuucucuagguucuuuuaagauuuuuugcuuuuaucuuuuguuuuauuuuuaugauccugcuuauucugcuuauuuugauuggcuuguuuauucugcuugggaauuaccagguuucuugaaucuguagauugaguuuuuccaucaauuuuggaaaaugcuuaguaauugccucuguagauuuugccccugcccccauucuuucuucauuuaccuuuuuucuacauuuuuuauuuuacuuauccugucuucuguguuuucuaucuuuugucucuccaugcuuuacucuaaauaguuucuucugucacuaauucuuuauuuugcuguguuaauaugcuguuaagcucauucauugauauccuaauuucaguuacggcauuuuucuguuuuagaaugucugguuuuucuuuauaucuacagggucucuuuuuuaucguuucuguucccugcugaaauguucaagcuuagcauuuauaucuuuaaacaugguaagcaucuuuguuuuauagccuguuucugauauuugaauauuugaggucccugugauuuuuuucuguuuccccugcuaggcuaucuuuuuccagagcagguacugugucuuauucugauucagaaugucugauauggaggcuggcuuucuacauuuauagaaagcucacaggugauuuuguuauuuagcuagauuuuauaccauugaguuagaaaaugcugaaaugcuaaagcuguguaguaucaacuccaaggacagugggauuuuagcuuuguucuuuaagacaaagaauaaauagaaauuaauauaggcccccaaugguaguucuaaucaucauucaauuaaauauuccagugcaauacuagaaacugaagaaguuaaagacuauguguauugguuucagauccugggauguuuguaccagggcugaauuaaauacuggacuaguugggggacuuggguuuuagcuuaucccuauuaguaacuuuuaauugacuauggagacaauuucggugcuuucugucuuaaauugaaguugacauguaauacuugcauuuuaauugucaucaggaguugauacacaguuaguaauaugaauaguagcuacuauggcuuuuacuccuuugaccaucagcacuaccauugccaugaucauuaucgccaacagcuaacuauucugugcuagagacugugguagaugcuauauuaagugaacuuuuccucauggggagcaaucuagggccucaggaauagauauacccaugacuguuguucuuauuacucuagcugucucauuuugguucuuugugaaucugaugguuuacuuugcuuaaggaggaaagcccagaaaauaaacaaauagaauuuaggaagucuucuguacaaauauaaaauauacaccacccuauuuguaaaaauacauuauuuaugaugaauucauucauucauucaaaaauauuuguugaauauaauuuacuagacagacuguaacaaguaaacaaagauacaauuuaaaauauuuuuuaagcuaaaauauuuuauuucuucuauaaccuuuucauauguaaaguaaaacuuaauuuuaucgaagugguuugugagcccauuuuugaauguugguggauuucacuucauaguuccugcaaacaaaugaagcaaauaaaugaagccaugguauauaagugagagcucaaagcaaguggucucaguguaaacacaucaacauaauauauuaucuguuaggcauuuaagcuaagcauuuauaauauuggaugugcaaugguggcuaaagugucuccaauuuagcauuuucuuuuuuagcugauuuuccaguuaugcaacauauauuuuguucuguauuguaacauuugacagugugucuagaccguuagccagaaagaugccuuuuauuuuuauuuuacauuacacuugagcuuagcuagacaaaacaguucaaagccaucuguauuugggggugaagaguaagagagggcagaaucuauuuguucagcagcugaggccuaguuuuggaagucaggguuguauuugaaagguggaauuugccaacuuuugcuauacaauagauuuuuuugugguguuuucuuuuuaacuuuuugcuggaucuaauuuugccuauuucacauaugcaguacugcaggcacauucccagauguauauacccuaaaugugugcaugguaccugauaacuaggaaagcuucuacaccagagaggcaaacgauguucugccucucauuuucucucaguagcaaugagaaauaagugccuuuggaccacagugguauuuagcugcugcccguaacacuucaucgcccacucuuugaugccauagggcaccauccugugcucaugugugcaguuuuucuccucucaugaccagauuauugaggcuuguacuuuaugaaauugccgcuggcuucagaacaagggaauagaacuuguuuucuuuuagucacuuucaaaugggagguccuguauguugauuacaggauguguuggugacauugccacuuuuccuucgagcuucauaagacuuuguaauuuggggauucuaacuuucaagacauuuagccaauggauuuaaguuuccuguguguggggguuguuuucuguuuuugcuuuuuguuguuguuuuguuuuuuaaacaucccuuaccaguaggaaucagggaagggaaacagguuuguggugggccuagauuuguuuuuguuuuuguuuuuuuuugguggauucucgcucuguugcccaggcuggagugcaacggugagaucuuggcucacugcaacuuccacuuccuggguucaagugauucucuugccucagccucccaaguagcugggacuauagacgcccaccaccaugccggccauuuuuuguauuucuaguagaaacgggguuucaccauguuggccaggcuggucucaaacuccugaccucaaguaaucugcccaccuuggccucccaaagugcugggauuacaggcgugagccaccacaccuagccagugggccuugauuuuaaccuauucuaaaggaggaggccauauggcauagguagaagguuuaaaggucacuagcaucagccauuagucuccaaggugucuccagggcaaaauuacugucaauuccucugcccuggaaaauaccagcaagcuuuucuuccaguuacuuuucagcuuagcaaaguguacuucugcggguaucaccuuuuguggaauuuccucuuugcuguuuaaaauaaaaaggaaacucuuacuucauuugggucaaaugaaauuguuagcacaacuauagaauauuucuguuugguagacugugggaaacaggugaacuuucagcuaugaaauauuuucucuaguuaaauauaguaaguucugcccucuuagcuuuuaucauucucuaugaaucacacaucguuuuucacaucauauuguccccuguccagcuauucuuuagggauuucucuaaaaagguuaaucaucucggccucuuucuaaccauuaaggaucaggauuaaauuugucuucuuucucagaaguguucccaguagcguauauucuucuuuauccuauuuagccaacauggagaucuguuuauuccuucaugugcuuuucuguuaugaauguuaacuuuucuucguugauagauugauaacugugucuggcauuuuuguucucuuguauuuuggaugugugaaaguuguauaagaugagaaugucuaaggguuuguuugcuuaggacugaacauuauccucagucaugcccuauaagcuugcugggcacuugaucuuuauugacucugccaucucagaaaauagguaaaaacaaaaagaauaauuggaaaaagcuccuguggagcaaaauuuucacauaacagaaugauucagcaguuucaggggaacuuuauugauugaauauuuuuuuaaagucuuuuuauuuuguggucuuuuaacaagcauuuaguuaaaguacagauaguuuaaauaugaugauacugaaaauacuuuauuuugaugauggaauguuguaggaaaaauguaauuuucauaggaagucuacauuuaauuuuauaaguaaaauuauaucuaaauuuaaaaaaauauacugucaaauuauaugccaaaauaaguuucagagauauaaaggauaaaauguguaaaaaaaaacagaaaaucuguaauaaaauaggagcgaauauuuaucugaucaagaugggggcuuuguaagcauaugaagaaauuguguuuuugugucuuguagucauaaaauagauugacaacauuaaaaaaaaauucagaacuuccaaggccggcuaucuaaauuguggggcccaauuccaaaugaaaguauagacuccuuauucaaaacauaggaaaauggaccagaaaggcacuaaaguauaaagcuuuuccuucuguggucuuucucaucuugucaaagugguuuuuauuuucuauuuagugccaucaguguaaagaaaucuaaauuuugauuuauuggcaugaauuuuaccauuugucuucauauugugugacacuaguuuuaaaugcaaauguaagaacauguaacucauauggaaucaccaaauuuuuuuuuuuuuuugucuucaacuuuuauuuuaaguucagggguacaugugcagguuuguuacauagauaaacauguuccauggugguuugcugcacagaucaucccaucaccuagguauuaagcccagcaucuauuagcuauucuuccugaugcucucccuucccccaccacccccuccaacaggccccagugugugauguucccccucaauguguccauguguucucaucauucagguaccacuuauaagugagaacaugugguauuugguuuucuguuccugugcuaguuugcugaagauaguggcuuccaacuccaucugugucccugcaaaggacaugaucucauuccuuuuuauggcugcauaguauuccaugguguauauguaccacauguucuuguucuagucuaucauugaugggcauuuacauugauuccaugucuuugcuauugggaaucaccaaacuuaaacaauuuguauuuuguacuuguacauucauuugugaucauuuuuaccagaauaguggaaacacugcacaaaacuaacccaacaauaaccauuuuuguuucacuucuugauuugugcaccuucugcuaacauugucugucuucuagaaggacuggaaggaaauggaauuaugaauuuucaggagucuggcuccaggcugaaacccuaugugauuuuucaggccucaccauaggugaugacaaaggcuuuaccugguggccucaugggggaaaaagcugcccuccucauaguagacuugaugcacagccagugcauuacagucuaaguggaguuguaaugaaggggucaaacgucccuggcugguuaugcucuuaugccuauuugcauuccuagccuagacaccuucauuccucgaacucuuuaucugaggucuuuggcugacguccucuucaggcaccucugccgaggccuuuuuguggaggagggaguuggaaaccucaaagacauuuuccuuacucugacuugguacuagcuacuuuucaauuccuagucuuucccacucacccuuccccuuaccgcugaguuuauaacacugcuggaaccuuucauucaggguucccucagcagugagacaauccccacauucaagaugauccaccucaaccucaagucaugcaguguucaguggagaaaaaugggacuggggggaguuggugcuuccucugguuuuagaccuuuguuuaugcuauuauaucacaauaagugaucaacuuucauuuuuggcuuauugcauuaauccacuacucugagcucuuucuuucagccuucagguuguccugucauuccguauucuucuacaucaucauuuucacuguuaagcaguuggcuaacacagggaaguaacaugaauaagaaaggauaugauggugggguuccuuguguuacuuuagacaaguuaaauuuaauugaguuuaauuaugcaaugaaugauugauaaaucaggcaaugcccugaaccagaauagguucagagagacuccagugcugccgagugguuggagagaauuuauggacagaaaaaguaaagugacauauagaaaacagaagugagguacagaaacaccuggauuaguuacagcuuggcguuugccuuauguggacaugguuugaacagauggccaccuuuauugugugaaacucagugauugguaaaauaguagguagcagucuguuuagacauccaguuagauuacaguucacuauguaugaagaaccuuuaggcugaacuuauaaggaggcaacuaacuuuaggcuaaauuuaauuuaacacuugauugcuuguguuucuuagaacaccauugucuucuuucuacauuugaagcaaguucuggaggacccucuaggcugucaguguacccucacucacucagugguagacauaaagugcuuacuguguacucugagucucggugaacucucacacuuucuguguucaugggacauuguggacacauuacccaaaugggccucaaggaacuguggacaagcauauugcgugcaucuccuugcuuaagcccauacuccauuguuacaucagacuucauuuaacacaaguucaaagauaaaguuaagaauuucaaucagugagaaaaaaacaaacaaucauaucaaaaaaugggcuaaggacaugaauagacaauucuuaaaagacaauauacaaguggacaacaagcaugugaaaaaauguucaacaucacuaauuaucagggaaaugcaaaucaaaaccacaaugcaaugccaccuuacuccugggagaaugaccauaauaaaaaaauuuaaaaaauaaaagauguuagcagggaugugguaaaaaagggaacacuuuuacacuauuggucagaauguaaaguaguacaaccacuuuggaaaacaauguggagauuccuugaagaacuaaaaguagaucugccauuugauccagcagacccacucccagguaucuacccagaggaaaagaaguuauuguacaaaaaagauaauugcacacacgcuuauagcagcaccauuugcaauuugcaaaaauauggaaccagcccaaaugcccaucaaucaacgaguggauaaagaaaaugugguauauauagacaauggaauacuacucagccauaaaaaggaacaaaauaaugacauucgcagcaaccuggauggaacuggagacuauuauucuaagugaaauaacucaggaauggaaaaccaaacauuguauguucucacucauaagugggagcuaagcuaugaggaugcaaaggcauaagaaugauacauuggacuuuggggacuuuggggaaaaguugcgggggugagggguaaaggacuacacauuggguacaguguacacugcucgggugaugggugcaccaaaaaucucagaaaucaccacuaaagaacuuauccauauaaccaaacaccaccuguuccccaaaaaccuauugagaaaaaaaaaaaagaugaggaauggucaauuugauacagaaaaagaaaaacauuuagcuuauuugguuguauauuuuuccuccuugaaacuuggcuuguauaugccaggacagguguuucaaaauuaacuaauaucauguucauauaucucuugugaguucuaaucacuuguuuaagcugaaauuuuccuauuugaaaaucacuacuguccguugaugggagggaauaaguuugaauuucacaaauacguauguauugugccuuuguaaaacauguucaauauuagccaaaaaguguaacuucuagguggauauagagcuugucucucuucacucuuguagccuuugauaucucaccaaacgauuaauaaaauuugucuaacaaauuagagucuagucuucuagaauauuuucccaucaugacaguuuucaucuggauaucugggcauggauuuccuuuaagccacagauaauugucucuaauaauaaauaugcucauuauucuuucgaggugugggccuuggcuucuauuaacaaaacugaaaccuauauaaauugguuuaaaaagaggccacugugguuuucccauuuccccccaacaauuuauuaugaauuuauuuauuuauuuauuuauuuuuuggugagacggugucucgcucuguuucccaggcuggaguguaguggcgugaacucagcucccugcaaccuccgccuccuggguucaaguaauuccccugccucagccuccugaguagcugagauuacaggugcccaccacuaugcccggcuaauguuuuguauuuguaguagagacaggguuucuccauguuggccaggcuggucucaaacuccugaccucaaguggucugcccaccucggccucccaaagugcugggauuacaggcaugagccaccacgcucagccaauuaugaauauuuucauacagaaaaguugaagaauuguacaguaaauacuuauaugucuacuagcuagauucuacaauuaauauuuuaauauacuugcuuuaccaaauaaucuaaccaucuucucaucccuuuaucuguuuauugguccaucuuuuauguauacauuuuaagaagguugcagguaucaauacacuucaucucuaaaaacuucagaauuaaucuccgguguuucgaaugcuuucaggguaugacuauaugaaauuauauguagacaucuggaacagauaacuguuaggaaauuaaacucuaucacaugacuuuauuuuccauacuuagauuggaaggauagguuagaaaggaagaaaacuacuuuagcucuguauacuuuuuuauaguuuacagagaauuuucauguguauuaucucauuugauccaauauuacuauuaauaguaauaguagcuaccauuuauugaaugcuuacuuuguacuagguacuaugcagguuuaccuuuaaggaagguacuaugcugaauuauuuucgucccacuuacaguugguugucauaucuauuuuucaaauggauugauuuguucccuuaaaagaauaguuuucagcccuauaguaagccuuuuaaguucauauuugucagcugcugcuauuuuuagacugaagucuuugguuuuugauggguuccuagggcacaagcauuuucuuggauauuuugucauuauagguugcuauucagaauaauauuugagcauaacuuaggaaaaguugccgaaaauguuccuuuuuuuuugauugucucuuuauuaaucagccucuaaucccaguauguuacauuacuuuaaaggugcauuuaauauuuauuucuucuuagauuauuaauuauuaauauucuaugaauaauaaaaacaauagcuaguuuuuguguauuuauuauacuguaugccaguuauugugauuaucuuuauaauugucuauauaauuuauguaaaauacuguaagaguugagaagcagagugggguuaaauggcuuguccugugucacguggcuaauaaauggaagagccaggauaugaguguuucagcuccaaagucccuguguuugaccucuacucugcuguuuucuacggugugauccugagaccaccugcuucauaauuucuuggggugauuauuagauguggagauuucugagccuuacuccagaccuacugauucugaaucucuguggaugaaauaccuuuuuuuugucauucaguugauucucauguacaguaaaguuugagaaccacugugcuaugcuuuucugcaagcauuauuauguuuuaaucucuguuagccuagaaaaauagccaaacucuauuaaucauucuuauccuuggaguauaugaaauuuuggauugaucuuuaugcuuuuaucuuugcuucaagauugucauggauuuuaagcacccagauggcauugcagugccaguuauguugccucgucggaguuugcuggugaugacaggagaaucuagauaccuuuggacccauggguauguauugaaauaugacaggauucuuuuucuuuaugagacuucucauucuucuguguuugagccacggggaccaugcccugugccugcagauugaggcuucuggguucagaacuccuaggggcaucuaucuaguuucguuuuuguuaaacauuaccuuuuuacuuggaaaaaauucuuaauuuauagcaaacuugcaagcauaguacagugaacucccuucaccuuucaccuucauuuacuaauuuugaauauuugggacauuuuuuauuucucucucacauauguuaucauuauuauuuuuacugaaucauuuuagaguaaguuauagacaucauggcuuacucuuccaugcuucauuguguauuuccuaagaacaaggacauuguguaugucagggauuggcaagcuauggcuagugggccacauucagcucucaggcuguuuuuguacagcucuugagcuaagaaugguuuuuacauuuuuaaagguuguaagacaaaaaaacaaugaagaauauuugacagagacuauguguggcccucagugccugaaauauucacucucuggccccuuacagaaaaaguuggccaagcucuguucuauaaaaccacagugcagugcucaaauucaggaaauucaacauugauaaaauacucuuauuauacucuuauacaauccauauucaaauauugcuaguuguauguuauagugcuuuaagcauucuuucugaucgaggauucagucuaugaucccacauuauguuuaagucuugucaauucuguuuagucuuuuauuugaaagaguuucucaacuuuccuuugcucuuaauaacauugacucuuuugaggaggccgguuguguuauagaauguuuugcaauuugaguuuguuugguuuaaucaaaaucuaaagaaauuaguaugugcuucugcuagggauacaucucuagccuuuugaggagagaccauuacacugcugcaauuuacauauacugucccucauaauacugcugaguucuguacuuauuaauucuguucugcuuagagauuuuagcugacauauuuuuauaaaaacucaaggaaaugaacauguaaaagaauuuauaaccuguccuaaaugugagccauuaaaaaaugaugaccugauuuugugcacuggggcuuaaauuuaugugauuuuuuuuucauggccauuaaaauauuugcacuuaaaauaaaaaaaaaugaugaugugauccauuaauuucaggucuucuuauacuucugagaauaaugacauuuucuuuucuggguucaagcauuuuugcuaucacuaauguuuaaacuucuuaaaaguaauaguauuacuacagcaaauacaaaauaagaaauuacuuuucauggauauauugugaaaauauuuuaaucuauucugauaaugguacagguuaauuuuccuaaaacaacauuugaucacauuauugucuuacugaaagcauguuaugcuauuaaauguuaauagaguugucucuggaaaguuagauuauagguaauauuuauuuuuaauguucgcucuggaaucagaauucucuacaguauuuuuaggggaaaaaacccucaguauuauuuuugaaggcugccauugauacacauugccuguaacaucacucuguguguguguguguguguguguguguguguguguguguguguguguguuaggaagagagagagauggggaaaugggggagagagggagggagggaggcaaagagaccagaggcaagaaagagagagagagagagauaaccaaugauacaccaaucauugagauguuuaucagaaucuuuggguggaaaagagaauagauuggaaaagcauauuugauacacuuaaaacauguauaaauaacaggaaauaagccuugauaaaacuuuuugauuucuaugcugaagaaacaaaagcacuagaaagcauuguagagggacauggauugaaaaaaguuaacacugccuuguaauuuuaauuccagauaccucaaucuaacuuuuauuuguucaaguucaaauuuacuauucuagccaucauaccuuaaaucaaagguggaagacgggcagcauagggguaaacuuaacagucagguauuuucuauuuggcugaugcaauaguuguccacaugguggcaguuuauuuuuuucaguuuucuacauauaaaaauuaggaguuuucacauaaaaauuugaauuuucagcuucucuugaaaauugagaagaucugauaacauugaaccuuaguauugcuuggcagcaguaccugaaacugugugucacuagcauucuuuaggugggggccuacuucucuaguucccuacaguuccuaccccuuucuguuacucccugaucuaaggcugagcaucaguugucauuuaacacugugcuuguacuauuguuuuuaucuuagaguuacaugaaaauugaguauuucuugaacucgugucuguauuaaaaguaggagacagggccgggugcgguggcucaugccuguaauccuagcacuuugggaggccaaggcggguggaucacaggucaggaguccgagaccagacuggccaauauggugaaaccccgucucuacuaaaaauacaaaaauuagccaggcauaguggcgugugccuguagucccagcuacucgggaggcugaggcaggagaaucacuugaacccgggaggcggagguugcagugagccaagaucgcgucacugcacuccagccugggugacagagugagacuccauaucaaaaaaaaaagaaguaggagauggaaagcuagccugaaugagaauguauguuucaagaaaaauggcacagagcacucugcuuuuuugaaaugaaaauuaauccuaugauaaacaauauauuucuaaacaaguucaccuguuucauuuauuuaugccaucugacuggccccaggaagcauuauuucaugagauuaugugaaugcuccuuuuaaauuauuucuggagcauuuuccuugugccaggcauuguucuaaaaacuuuacauauauuaacucauuuaauuuacacaaucauagugggaaguuuguuccaugguuuuguccuuauuuuugaaggaaauuggagcauaaacaaguuaaguaacuuguacaaagucacgaagcaguaagucgcagagccaggaucagaagccaggcacucugguuucagaaucugugcucuuaccaaugauauuauggcuaaauuuguuugcucccuuuucucuuauccuguaccuucuaaccuucacacauuugccagcccuguaucuguuaacauauagcucuuuuacuuccuucauaauuuaucaaguuuuccugacuacauaaacuugaaauaauuuauuccuuaucuuaacuuuuaaagucuguauuguuuccuacuaccuugagaugucucuucuauuauauugaacuauuauuuaaaucuauaaaacuguuuuuauauucuuauugaauauugucccaauuugauuauaauuugagugcagggggaaaaagauguuuagcaguauuuaaauaaaucauuacuuuaacauauggauuaccuguucuuaaacauuugagauuguuggaaaagcaguuaggaacuccuuggccuuugcuuaaaguguaacuuuaggcaagugaaguaauugauuuaaaagaaccauaauagagaaugauuuacucuucaaaagaggaauuagcuugcuaacaagagcuucaagauacuuauuccucuaaaauaccuugacuuuguucacuaccauaguuuuaaucauguauagcucuuagaacaaaaguaauguaaauuugggcaaugauugcuuuuuuuugccucuacaaaauugccuuuaagacaagcuuuuuaaaaagagccaccugcacguugugcacauguacccuaaaacuuaaaguauaauaaucauaauaauaaaaaagccauucuccuacuuuguuuuaugaggcuggcauuaauuacccuugacaccaaaacaugugaaagacauuaaauaaaagaaaauuacaaaccaacaucucucauaacagagaugagaaaacccauaacagaacauucgaaagucaaauccugcaauauacauaaaaagaaaauauaaccuagcggaguuuauaccaguauuucagaguugguuuagcauuucaaaaaucaauguaauucaucacguuaaaggaauaaaggaggaaaagcauaaucaucuugauugaugcaaaaaguauauuugacaaaauuuaguacccauucaugauaaagcccggcaaacuaggacaagaagggaacuucuucauugcguuaaaggguauuuaugaaaaacccacagcugacaucauauacuuaaugguauucuauugaacguuuuuuccaaagauauugaacaaaucagggauguccgcucauacuccuucuauuuaaugcuauauuggauaucuuagccaguaugagaagucaagaaaaagaauuaaaaaucauaaauauuugaaaggaaggaguaaaauucuuuauuuguagauuacauuauuguggauauagaaaauccuagagaaucuacaauacaaguuccagaacuaauaagugaauuuagcgacauacaaggucaauauuuagaaauuaauuuuuagaagaugaaauaaaaaugcuauuuaaaauagcaucaagacucauaaauauuuccuuuccaguacucagaauuaauuuauugagauguuguuuaaaaagcaauuagccugagaauucuguuucuuacaacagauggagugaaauauggcaaugacaaaaugaaaguugagaauugaaauacauuauguuuuucauuuuaggaucaaauccaucuuaggucgacguuucucuuucuagaucaccuggcuguuauuauaguaaagagguaucaacaacuuaaguaaaaaauuauauuuuuauauaauuugcugagauccuucaggauuagcacauucccugcgaauaugaagcccacuuccauagagagauaaccuugccuggaguaaaucaagaagaucugagucuuaggaauaaguuuuuaaaagauaugcaacacacauagacugaaaauucuagaaaaauuauugcuaucccuaggaaacuuaaugugguuaauauaucaguuguccccaaaaucuauggagacaguguaauuccagucaaaacucuagaaggcuuuucuuuuuuugacaaaauugacaaaccgauucuaaaauuuauaaggaaaugugauugucaaaacaaucuugaaacaauguuaggggauuuauucugccugauuuuuaagacuuacuauauggcuauauaaucaaaauaguauuguuguacagauagacagauagaucaggaggacagcauacaguccagagauaacuccauacauacaaggucaguugauuuuugccaaagauaccaauguaauuaaauguggaaaggaaauuuuucaucagauggugcuggaacaacugaauauccauauggaaauaaaaugaaccugaaucuaucucauaccauucacaaaguuaaugugagguagaucauagauguaaaugugaaagcaaaaaguguaaaauggucuaaaagaaacuuuauaaaaaacuguuuuugugaccuugagguagccaaaguuuuuuuaaagagagauuucauaacacacuauuaagaaauaauaaauuagaccucaucaaaauuaaaaacuucugcucaucuaaagauaccauugagaaaacgagaaggcagccacacauggagagaaaauaccugcuauuuauuuauguuuacgucuauaucuguaucuaucuguaucuaacaaggaauugggcaaaaggguuggacagauccuuuaucaaaaaaggaucuaugugugucuaauaagcacaugaaaagauguauagcaucauuagucauuagauaaauaauaacuuaaaaccacaauuucauaccacaugccacucacuaaaauggcuaaaauuuaaaacucagaaaauaccaaguguuggugagaauguuaacuagccuggaacucucucauauauugccgguuggaguguaacauuuuacaacuaccuuggaaaacuagaaguuucuuaccuuaugacccaccaauuucacucguuauuaccuguuaaaacccaccaauuugacuccuagguaguuacccaagaggaauaaaacuauauauccaaaaaugauguguauaagaauguucacagaagcuuuauuuguaauagucccaaacuguggacuuguaauuaccauguaguuauuuuuaauuuuuaaaaauccaguccaguaaucuuuguucuuuaauuggaguuuuuaauacuuuuacguuuaauauauuacugauaaugaauuuaaauuuaccaucuauuuguuuccucuuggcaucaucuguucuuuuuuguuuuuuuuagaauugguguuaauuaaauauuuauuuuauuuucccauggaauaauuuguuguacauucuuuuaauauuauugucaugaagauaauuuccuuaaauaccuuuauuucuuuguuuuuccacaaugucuaacaauucagggaauccaauagauauuuguaauaaauucuucuagauuuucucuauucacuuaacauuuuuaaaggccugaaauauuuuuauuaauacaauguuaaguaaauuuuuuugacuauuguuuuuagaaucacgugcagaaaauuugauacuguucaagcaucugagagucuuaaaaguggaauuaucaccagugauguuggagacuuaacuuuaagcaagaggggacuacgaacaucauuuacauuuaggaaagugaggcaaacaccuuguaacuguaguaaguauauacucuuaucucgucuguaaaauggagucaguuuaauauaaaaguccuuuaagguccugucaacaccuaggagagcuuuuucugaaucucucuaauggcauuuccuguauuuugccuuguauugcacuuucaugcacuuuucuuaacgacccucauuagaguuuacauucuuugaaggcaagggucugcaucuucucaucuuuauuuuuuccaaacuuaguacuugaguugggugcccaauaaauguuuuacuuauugaaguaacaguuaagagugcuacaauugaagggcaauaaaauauuacuuguuuaaaaacggguauuguugggaaugguuugucaaguuucuaaauuauaucuuauuaauccaacagggaaguuggagaugacaaauuguucuauaguacauaacucuagggagauaagcgacaguuuauguuuuagucaauuugaaaacucagaagggaauaaaaacugcucaaaaacuugucaagaggaugcuauuuugaaucgucuguacaaguacaucauguucuggauuucuuugacucaauuaacagacaccucuuucauuuuguaaauaauauuuuguaaugauaguaauaauaaaauccuuuuuauaucuuggggguuuuaauuaugggugguaucuaccaacagcuuuuggauuuagucauaaucuugaaaacauuuaauuaaaaacucuuacuauaucuacaaaauguuaugcuuuuagaaaacuugaaauuucuauauuuuauauccugauguuacugaagcuuaaaagagcuuuuuauuuuacuaaaaguguccuugaagccuuaaaauaucaaauuuuaaaaguuaaauuuaaaauguuuauuauuugaugaauauugaacauugcagauagugaguuacaugguauagaaaaauaaagcauggcuccuguucuuaaggaacuuaaaguguaguuggagagacaagcuaguuuucuuaugcaaauguuuaucaugggcauuuauuaaauguaagaagcuguuauuggggauucaguuuacagauuuuuuuuuaagaugaauaauaauuguggcuggcacaguggcucaugccuguaaucccagcacuuugggaggcugaggcaagagaauugcuugaggccaggaguucaaaaucagcuuggacaacauaggaagacccccugucugcaaaaaaauaaaaucaaaauuuagacaggcaugguggugugugccuguaguccuaguuacuaggaaagcugaggcgggaggauugugugagccuaggaguuugaggcugcagugagcuaugaucgcgccacuugcacuguggccugggugacagagcaagacccugucucaaaacgaaaaaacagcaacagaaaaccccccaaauuauaaauguuuaucauguacaacaugauguuuuaaaauacauauauauuguggaauggcucaauugagcuaauuaacauguauuauuaccucacauacuuauacuuuuuugugaugagaacacuuaaaaauuuauucucggcugggugcgguggcucacaccuguaaucccagcacuuugggaggccaaggugggcagauuaucugaggucaggaguucgagaccagccuggccaacauggugaaaccugucucuaccaaaaauacaaaaauuggccaggcaugguggcacacgccuguaaucccagcuacucgggaggcugaggcaggagaaucacuugaacccaggaggcggagguugcagugagccgauaucaugccacugcacucuagccuggccaacagagugagacucugucucaaaaaaaaaaaaaaaaaagaauuuauucucauagugauuuucaagaauacaauauauuauuauuaacuauagucacauguuuuacacuagaucccugggacuuauucuaucucacugaaauuuuguauccuuucauuagcaucuccccggcucccaccccaacugcuccagccccugguaaccaccauucuacuacucucuauucugugagaucagcuuuuuuuuagauuccauauaugagugagauuguauaguauuugccuucucugucuggcuuauuucacuuaacauaauauccucuaaguuuauccauguuguaaauggcaagauuuccuucuguuuguggcugaauaguauucuguuguguauauguaccauauuuucuuuuuccauucauucacugauaggcacuuugauuccaugucuuggcuguugugaauaguguugcaguaaacaugugagugcagaugucuuucugacguacuaauuucauuuucuuuggauauauaccccauacugggauuacugguuuauaagauaguacuuauuuuuaauuuuuuuuuuuuuuuugagcaaggcagagaaggguuuuauugagugacagaacagcucuugauacgagaggggauugaaccugaaguggguucugugugagagggggcccgaaggcagguaguccccuguuucuaaguuuuugaagaaccucuguacuguuuuucauaaugaccauucuaauuuacauucccaccaacagugugcaagagcucccuucucuucuuauccacaccaacacuagguauuuuuuugucuuuuuuuaaagaccgucuugcucugucaccugugcuggagugcaauagcacgaucauagcucacugcagccuuggccccccagacucaagcaguccucaguagacuuauuagggaagaacuuuuucuuuuaacggauaaaucagagucugucuacccaccaaauuugcauugauuuuuuuuuuucauuuaagaaaacuugauaccuuaugaguuauucugauaaaaaggaaagguguguauugcuuuuucauuaagguuacccguuggucugugauagccagaggaaagagacuccccccucauuuccagagagugauaaagaagccucacggcuggagcaagaguacguccaucagguuuaugaagagauugcugggcacuucagcagcacaagacauaccccuuggccgcacauuguggaguuuuugaaggcuuugccaagugguucaauaguggcugauauuggaugugguaauggaaaguaucuuggcaucaauaaggaguuauauauggcaaguaauguugcuuuugacuuucuuuuugcuuaauuugcagugguuaucaucaucuuucuuccucaugauauaauccuguuuuuuuagaucauugccagaaaguuauaaccaacagauugaaaauuaaugauuuuuuuuauucuuucuuauuccucuaggaauuuaugggcacaccaucauuauauaauuuuuuuucucccuuuagauuuugcuuucuaccauauuauuuuaucaguaaaacuaucuuauaguuauaaaacucuuuacagauuagaaaggauuuuuauagaaaucauuuuuuggcuuggaucccccuaaguaugaagaagauaaagcugauauuuucauccaucuuuuguaaaugaagaaauuggggcucacagugaucauauuaauuuccugaugucauauaauuaggggacauaacuggaacuugaaccuauaucuucuacuccaaacuuuauucauaguagaaaaaaauuuucuauuuauugguaucuuacuguugaggaaaggaagucucaaacagauuaaaaacuugaccaagguuacagugcuagacccagaauuugaacccauuucugucugauuccagaaugucuguuuucaguuacuauuuuuuucuaugagccauuuuuuuucugcugugcuaagaaguaggauauucuuguuuuaguguauuguuguaaguaaucauuuuuuaacauugcucugugaggacuggagcuuccguuucucuagauuaggggauuuaggaugagaguaagggaguagguaaaaagaacgagagcagcugacauuccuggguuguuggaguaugucagauuacuucucaucuuuauuuuuacuccauccuagauauugugcaccuacaugaagaaaguuacuacaauugucccuugguauauaaaauugaagcuaaaucaaauaauaaauaaaaugcauauuuaaugaucauaaaagauuuagcauauaagagaaaagugauauaccauucuucuaagagauuacauuuuuaucaccccuacaugagcaacaguggcuguucuuuguggggccauacaucucaaaugccucuaguuacaaucaccuaggauucuacugaggaaguacaaagaauaccucaaaauaaguauauuagucccuugguaucuguggggaguuaguuccaggacccuguggauaccaaaaucuguagaaguucaagucucugauacaaaauuauguaguauuugcauauaaccuauacauauccuccuguauauuuaaaauuaucuauagauuacuuaugauauguaauacaguguaaaugcuguguaaauaguuguuagacuguauugcuuagggacuaaugacaagaaaaaagucuauacauauucaguaaagauggaauuuuuauuuuuuuaguauuuugaccugggguugcuugaaucccuggaugugcaacucauagauucggagggcugguuguauuacagcuuaggaaauguagaguuuguacauuaagaggcggauaaaagaauagccuuucaucaagauaagacauugauauucauauauuguuaccauguuuacaauuaaauuuuaauuuauaaagaauaaggccuagugaguuaaguuuguucauguugaagaggaaauagaucuuugauugugucacuuaaaaucacaacaaaccacaguucaaaacaaggugauauuuucuaguguuuuaaucuaaagauacguccaaaaauguuucucaguaggcucugcuuuugcacuuucuuguugauaauccaugguuuuaucuagucagguaucauuugugacagugaaacuaggucgaaaucaaauacacugauuuagucauagugauaacauuauuauguugcaauugagaagaaugauuucuugauaaacagaaaacgaacacaaucugcagcugauuccagagggaauauauuuggaaggauuagaaaaucauaaguacacucacucaguuuaucagcagcaguccguacauaauucuuuccugucuguuguucccuggagcuuacugcauugccugauuuccaggcauacgguacuuggcacaugguagaagcuuacuaauuaaugguuuguugaauggugaggagcaaaccugugaauuuaccuucagcuucuuacaugaaaaccaaaauauauacagugcuaugucuggcagccuuggaggaaugugacaaccucaaaaugggugggacuuaccgcaggauaaaauuaccuuuaggaucuagcuuucucuuuuuauguaggauccaggguacuccuuauuccuuauguuauaauaacuaacauuugcauagcacuucaaugguuaauuaaauauuuaguauagaucauuucauuugauucucauauuaacccugguaaauagguauuuuucucuuuauuuuuuagaugaggaaacagaggcuuugagauaguaaguagcucuccuagguuauucagcuaguuauugcugaaaccagaauucaaauucagaguuuacagguuuagcaucccuaauacgaaaauuugaaaucucgaaugcuacaaaaucugaaacuuuuugaguagcaacaugaugcucaaaggagauguucauuggaggauuucagauuuuggauuuucagauuagggacucucaaccaguauguauucugcagauauuccaaaauccaaaaaauucugaaaucuaaaauacuucgggucccaagcauuugaaauaagggauauucaaccuguaguaugcucuuuucaauguacuuuacugccucuguuuauuucucugcacuuuaaacuguauauuaccagucugauuuuccuacaguugcauauuuucuuaauaguuuuaaaaauguuguauauuuuuaaaaauaaaaauaauaggcugggcacaguggcuuaugccuguaaucccagcacuuugggaggccgagguggacagaucaccugagguugagaguucgagaccagccugaccaacguggagaaaccucaucucuacugaaaauacaaaauuagccagucauggugacgcaugccuguaauccuagcuacaugggaggcugaggcaggagaaucacuugagccugggaggcggagguugcagugagccaagaucccaccauugcacucuagccugggcaauaagagugagacucugucucaaaaaaagaaaacaaaacaaaaaauauaaccagcaggguacaguggcuuaugccuguaaucccagugaugagggaggaucgcuugaggccaggaguucaagaccagccugggcaacauaucaagaucacaucuccuaaaaaacaaaaacaguagcuaggcaugguggugcaugccuguugcugagaccagcuuggucagagagacccuaaccuaguggugcuagaggaauuaaagacacacacacaaauauagaggugugaagugggaaaucaggggucucacagccuucagagcugagagccccagagauuuacccacguauuuauuaacagcaagccagucauuagcauuguuucuauagauauucaauuaacuaaaagugucccuuauaggaaaugggauuaacuaaaaguaucccuuacgggaaacgaagggaugggccgaaauaaaggggugggucugguaguuaccugcagcaggagcaugcccuuaaugcacagauugcucaugcuauuguuugugguuuaagaacgccuuuaagcaguuuuccgcccugggcgggccagguguuuguugcccucauuccaguaaacccacaaccuuccagcaugggcauaauggccaucaugaacaugucacagugcugcagagauuuuguuuauggccaguuuuggggccaguuuauggccagauuuuggggggccuguucccaacaccuguagucccagcucuccaggaguucagggcugcagugaaccauaaucgcacacugcacuucagccugggugacagagugagacucugagucuaaaaauaccuacauacauacauaaauaacuaucauuuagaaaauugaugaaaagagagguauuugcauaauccuaucaccuuauuguaaugaauauccuucuaauguuuuuccuauuaauguuuuauauaauaaugaaugugcaauaauuugauaacucauuuaucucauuuauauucugauauauaaucuuaaaauguuucugaauuuuauaauacaguauuuuuucuguauuuuauuuuuaaauuaaaguuauuaaaaaugucuuuacaggacagaugaaauuauguguauuuauuguauaugauaugauguuuuaaaguauauauacauuguggauugacaaaaucuagcaaauuaacauaugcauuaccucacaaaguuaccguuuuguggggagaacauuuaccauccauucuccuagcauuuuucaagaauacaauacauguuguuaacuacagucaccauguuguacaguagaucuguggaauuuauuccuccuaucuaaaauuuuguaucuuuugaucaacaucuccccagcuucccauacuucaacugucucagucccugguagcuacuguucuacucuaguucuaugaagucgcauuuuuggauuccaaguaugagugagaucaugcaauacuugccuucugugucuggcuuauuucacuuaaccuaauguccuccagguuuaccuauauuguuaugaauggcaggauuuucuucuuuguuauagccaaguagcauucauuggguauauauaccauguuuacuguauucauccauugauggauauuuagauugauucuguaucuuggcuauuguauauaauguugcaguaaacaugggagugcagauaucucuuugaccuaccgauuucauuuucuuuggauauauaccuagcagugggauugcuggaucauaugguaguucuauuuuuaauaugucugugaagcuuccauacuguuuucccuaguggcuguccuaauuuacauucccaccaacaguaugccaggauucccuuuuccccacauccucaacgccguuuguuaucuuuugucucuuugauaauggccagaucuaacaagugugagguaaaaucucauuguuuuaauuugcauuuuccugaugguuagugauauucagcauuguuucauguacuuggccauuuguaugucuuuuuuaaagaaauauaaauuuuuaaaucagauuaucuguuuuguugccauacaguucuuugaguucuuuauauauuuuuguuuuuguuuugcuuuguuuuguuuuguuuuugacacaaggucuugcucuguugcccaggcuggagugcagugguaugauuacagcuuacagccuccuugaccuugcaggcucaauugauccucccaccucagccucuaguagcuggcacuauaggcaugcaccaccacacccagcuaauuuuuguauuuuuuguagagaugagguuuugccauguugcccaggcuggucucaagugauccaggccugggcuucagugauccacccaccuuugucucccaaaguguugggauuacaggugugaaccacugugcccagccuguugauauauuuuggauauuaauuccuuaucacauguauaguuugcaaauauuuucuccuauucuguagguugucucuucccucugaugauuguuuccucaaguuaaagcuuuuuaguuugaucuaaucccauuuguauauuuuugcuuuaguuaacuuuguuuuuggggucauauccaaaaaauuauugcccaggccaagaucauggagcuuuucuuguauguuuucuucuaguaguuucauaauuucaggucuuacauuuaagccuuucauccauuuugaguugauuuuuguagauggugugagauaagcauuuaauuucauucuucugcaugugaauauucaguuucccuaacaccauuuauugaaaagacuuggacuuuauuaauauuccauuaggcagaaguuacuggaaauuugguuguguucuguuuggaaguauucuaaauaacaccguaaugaacauguauauugagagucaaugggauaagaaggaagaauguggauuuuggaaugagaaauaccaggcuuuaaauuuuuguuucaccauuuaacgacuuucaacuuugagcaaauuacuuauuuucuuugaaaggaaguuuucucaucugcaauguggugaaaauaguaccuaacuccaaguguguuauguggcuuaagugcagugcuacaaagaaucugcuuuaaucuauaugcguacucaggaaaaggugguuauuauuagccugguuaguguuuucccuauuuugaauuauuuucuuaggauaaauuuuuagaaagguaacuauuggucaaaaauuauaaaccuuauuuucuuccuuaaaaaaugguuugccuaauugcucuuuuaaaugguugagccaauuuguauuuuguaugagaggaaguucuaucauacugacauugccaugguauauuuuaguuuuaaaauauuuuugauaguuuaauggaagaaaaauggaaccuuguuucaguuugcaccuuugcuuaucagguugaauuuuuuuuauguuuacuuguacuuccacaauuacauauuuaauauuuguugagguuuuuaaaaauuauauaaaaguauaggcugggcaccgugggucauaccuguaauccuagcacuuugagaggccgaggugggaagacugccugagaccaagaguuggagaccagccugggcagcauggugagaccuugacucugcaaagaaauuuaaaaauuagccaggcaugauggcgugcaccuguagucccagcuacucaggaggcugaggugggaggaucacuugaguccaggagaccaaggcugcagugagcuguguuugugccauugcacuccagccugggugacagagugagacccugucuccaaaaaaagaguauacauuuuaagcccaguauauguuuuaaugucauugaucuucacccagcacacagaaauauguagcuuuacgcaaguccuugaauauauguggguuuuuaucaagccauuuucuguccuguugacaugaugcaacauuauuagggagauuuuucaaacacuguacuauucuugguuuaaaaaauuuaaaaauggaaagagggaagaggagaaaaaauagugacugcaugacuauaguauauggaagacaggcaaaaaaaguaaaagaugaaaguacugagccaggcaugagucaggucguuggucaguggggaaucuacaucagaucugaugcuuuauugcuaaaauuggccuugcucuuucuuguuggugaaaaggagugcuguguacaaauagcuauaagagccuggcaaggagagggaaaucucuuguuuuguuuggcuguuguucuccauguucugucuuaucuguggcucucagguaauaacuuuccucuuuugaguaacuaucgagcccuaucccugagguuuuuuuuuuaauaggcagguuggauuucuuucuguugacuuuuagcaagguauagcuaucuuucagaguuggggcauacuugaaacuuccaauucuaugaaccgaauuuaaauguaacaaaaaaggaggcaagcaccaaaauauaauguucagauuauuugagugguauugucaucuugauauucugacuguuggcugauggcauagaauaugcaugaaaauaaauaauaaguaagaauccaggcauguaucuuacacagguaaagggagcaauuaauugggaaucaugucacuauuguuauuaauaggcccuuaguacuuuuuaucuuaaaauauauuaaagauaaauagcuguacuuuaccucuagcuugauaucuuuuauuucacuuuaaaauuaaagcagcuccaggauaaaauauagaagcuguuuaauaccgauuacaaauugagcaaacucauuaaguaugacuaguauggcaaugugauuuaacucaguaagaauuuuuuuuaauuuccauucuuuuauugugaauuuauaacauaaacucuguaauguaauguuucauuuuaagaucuuuuucuuccucuaaggaauuaauaacauagcacuuuaaggaacuuuuaauaaaaauacuguuuuuuuugguaaauugaaugucacuacuuaguaucagagacaauauuacauucuucacugcauacucauguaaauuucaaaagccugccugaaaucuauauaugcuugcuggucuaaaaaaaggccagauuaaauuuuuuuuuuaacuuuuauuuuagguucaagcguacaugugcagguuuguuauauagguaaauuguaugucacagggauuccguguacagauuauuucaucacccagguagucagcauaguaccugauagguaguuuuuuuuaucuguacaccaccccgccacuuugacccuuaagcaggccccagugucucuuguucccuucuucguguccauguguacucagcauuuagcucuuacuuauacgugaaaacaugcaguauuugguuuucggcaccugcaucaguuugcuuaggguaauggccuccagguccauccauguugcauacagcaagugacaugaucucauucuuuuuuaugguuguauaguauuccauaguguguaacacauuuguuuacccagucuacucuugaugggcaccuagguugauuccaugucauuacuauugugaauaaugcugcagugaacauaucagugcauaugucuuuaugguagaacaauuuauauuacuuuggauauauacccaauaauggaauugcugggucgaaugguaauucucuuuuaaguucuuugagaaauugccaaacugcuuuccacagugggugaacccauucccacuagcaguguauaagaauucucuuuucucugcaaccucaccagcauguuauuuuuuugacuuuuuaaaaauagccauucugacuggucugagaugguaucucauugugguuuugauuuacauuucucuaaugauuacugauguugagcuuuuuucauaugcuuguuggccacguguaugucuuuugaaaaguaucuguucauguccuuugcccucuuuuuaaugggaccgauuguuuuuugcauguuaauuuguuuaaguuccuuauagauucugcauauuagaccuuugucagauccauaguuugcaaauauuuucucccauucuguagguugucuguucacucuguugauaguuucuuuugccgugcagaagcucuuuaguuuaauuaggucccauuugucaauuuuuguuuuuguggcaguuguuuuuguugucuuugucaugaaaucuuugccagagccuauguccagaaugguauuuccuagguuaucuuccagaguuuuuguagucuuagguuuuacauuuaaucagucuuguguugauuuuuauauauaauguaaagaagguguacaguuucaaucuucuacacauggcuagccaguuaucccagcauguuuugauaugagcauucauagucuuuauucucagaagggcugaggaucagcccuaggaucagugcucauuauaucaaaaaauuaaaugaguaaauauacacuuuagguggccacuucuguuugacuaaaucugcuuauauaauucuuuucuguauuauagaguuuggcuaagaaaaaauuauccagggauaguuaucagugacuuaacauuucuuguggccuggugcagugguucaugccuguaaucccagcacuuugggaggccaagacgggcagaugacuugagcccaggaguuugaggccagccuaggcaacauggugaaaccccaucucuacaaaaaauaaaacaaaugcugggcauggugguacgcaccuguacccccagcuacuuggaaggcugaggcaagaggaucaccugggccugggagguggaggcugccgugggcugggauugcaccacuguacucgagcuuagguaauagagugagacccugucucaaaaccaaaacaaacaaacaaaaaaaaacccuuaaaauaaaaaagucuuaagccccucccauuuauuccccaauuuaugugggcacauuacaaaaugugugugugugugugugucuguauauuacauauauaugugauauucuuagaacuaagcagcaaaacuguguacaacaacuacaacaacaaaacuaaagagaaagaagaugggaaaucccagcuccuaaaaacuucucacagaaccagaugcauacauaaggcaugcuaggucucaccuguugagggagagaaaagcauacuccuagcugcccaccaugccaucaauccuguaggauuguuuggguauaugaaaagacuuaauuaaauaucauuuuauaaauuuugaauucagcacuuuauucuugauaaguuuugacauuuagcagaaaaagaguagcuuuaaaaaauaaaaaaaaaauugucugggcguguuggcuaacacccguaaucccagcacuuugggaggcugaggcgggcagaucaccugaggaugggaguucgagaccagccugaccaacauggagaaaccccaucucuaauaaaaauuaaaaauuagccaggcguguuggcucaugccuguaauccuagcuacuuaggaggcugaggcaggagaauugcuugaacccaggacguggagguugccaugagcugagaucacgccauugcacuccagccugggcaacaagagcgaaacuccaucucaaaaaaaaauuauuuugauuuuuuuugggggggauuuuauuuucugauuguaaaaguaauccauguugaaaaguauaaagaagcagaaaaaaaauugccuauccuucugcuaccugggacaucacaauauaguauauacgguaaugagagauaucuuagaacaucuuauuugcagcucccccuaaaagacugucuguguuuaugugauacuuuccaguuuuaaaugugugauauuacagaaacauccagauucagaauggucaucaauuagcuguauauuuggaccucccauuuccaccacuaucauuuuuauuccagucuuuuuguuucacuaauuggaguucuguuugauaucuguuaagguaauaaaugcugcccuguacaauuauauauucugauuuuauacuggcuguaagaaccgauaguaucauggucucagaccauuucacaaugaauaugguaucugucuaaugacuuuaagguauggaauaaguucauaguucuuaauuucaugugaaauuuaaacaaaauguuauggaauuccuucucuguuacagauugguugugaucguagccaaaaccuuguggacauuuguagagagaggcaauuucaggcuuuugucugugaugcauuggcaguaccaguccgcagugggucuugugaugccugcaucuccauugcuguuauucaucauuuugcaacagcaguaaguauggucuuucuuucucuuaagaacuuguagcuaaagcagcaggaagaguucaugaauuuugcugauuuuggacccuguuuuagcuuuucaguucuuuccguucucuuuucuugucacaguuuucccucuuuguaagagagcaugcagaauaaagaugggcaacuguuuaaguaucuucuacuuaaacagaggccugaugggacucuacccuuuauugcugcaugcuuucgccccuuuccuaccccaagucucauucacuucuaaaugccuuccuuuaaacccagagucacagaauuuuagcuggaagagaauuugagaucaucagcuccaagcuucuugaguauacucucuccucagacucuaugagucccuucuguauuucuuucucagcuuuucuuucucaacccauaguuuuaucccugacaugugaguguuacuucuuucccauucuguuuuucuuccuuuccuguucuuuuuuuucaaaacucugucuuuuuuagcugguaguaguauguugacucuuaguauguucuuaguuuuaaaauaaaugaauuuaauauuuaauauuuucuuucuuucuuuaaagaacaaaagaccacuuauuuuucuugggugucagcagucauucccuugauuuaugcaauagcuuuauagcucaccuuaugggucaccagcaguuucaguagaccuuaugaccuuaacugaguucaaaacaaaucaaaacaaaucagaaaacugucugcgucuuuagucuuuuuacuuuuaauaguaaccaagagauucugcugggcugcagcaaacaauauuagguuuuuuacagcaaaagccacuaggccucaguggcuuucagaggcaugacugcaaauagaggaaggcuugaaaggagcagcuauaccaguaaauuuaaaaauccgcuucauuuggaagaaauguuuggcacauauugguugcuucagcuacaacucaguuguuguauuauaacuuauuuucaaguuauaaaagacaauaauguacacaaauauaucuauauccauuuuuugcaaucacaaauauauguuggauacccuccccucuaugaaguucuauaugaucgucuuagaaaucugucauguccaacuuucucuacauaucuauugucauuuauuuaaaaaauaauucauugaccacauggaaaagaaugaaguuggauccuuacauuacaccauaugcaaagaaaaaccucaaaauggaucaaagacuuauacagaagagcuaaaacuauaaaauucuaagaagaaaacaggaggaaaaccuucaugacguuguauuuggcaaugauuucuuggauaugauacuaaaagcacaggcaacaaaacaaaaaauagauaaauuagaccaucaaaauuaaaaacuuguacaucaaacaacacuaucugcagagugaaaagguagcccacaaaauaggagaaaauauuugcaaauuguauaucugauaaggaauuaauauccauaauauauaaagaacaacaaaaauacaacaauaacaaaacaauuuaaaaauggacagaggacuuaaauagacauuuuuccaaagaagauauacaaauggccaaugagcacaugaaaagauacucagcaucacuaaucauuagggaaugcaaaucaaaaccauaaugagauaccacuucacauacauuaggauggcuauuaucggaaauauagaaaauaacaaguguuggcaaggauguggagaaauuggaacucuugugcauugcuggugggaauguaaaauggaucagccacuguggaaaacaguacagugguuccucaaaaaguugaacauagaauuaccacaugauucagcaauucugcuucuagauauauacccaaaagaauugaaagcagagacuugaacagauauuuauacaccuacguucauagcagcauuauucacaacagccaaaaggugcaaacaacucaaauguucauuaauggaugaauagauaaacaaaacaugcuauguaccuauaagggaauauuauuaagccuuaggaaggaaauucugacacaugcuacaacauggaugaaccuugaggauauuaugcuaagugaaauaagccagaugcaaaaggacaaauacuauaucauucuacuuacaugaacuacuuagaauaguuaaauucauagagacagaaaguggaacaguuguuaccagaggcugugggagggaggcaugggaguugcuaugauuuaauugauacagaguuucaguuuggcaugaugaaaaaaauucuggagauggauaauagugaugguugcacaaccauuaaguaugaauguacuuaaugucacucaguuguacacuuaaaaaugguuaaaauagcaaauuuuguuacauauauuuuaccacaauaaaaauaagucauugaggccagcugucguggcucacgccugucaucccagugcuuuggaaggacaaagcgaguggaucacuugaggucaggagucugagaccagacuggccaacaaagcaaaaccucaucuuuacuaaaaauacaaaaguuaucuggguugauuggcgcaugccuguaaucccagcuacucaggagacugagacaugagaaucacaugaacccaggagguguggaaguugcagugagccgagaucgugcccacuguacuccagccugggugacagagacuccaucucaaaaaaaaaaaaaaaaaaggcauugaaaaucaguuacacacugcuauuaagcaaauagcugggcacaagauggagaagacccagucccugcuucauagagcucauaguuuaguggaggaggcagcauuuauuuauuuauuuauaauuuguuggauuuauguguuguugguugaaugccauaguuauaauuuggacuuagagagucauugaaaggucuaacacaugggaauaccuugaugaaauaaaugccugauagagaucauuuuuauggcacugugaaagaugauauaggguagaagauaagauuuuauguggaaaaucucauccaaguauauggacacaacuagguaagggaauuaaaagagucuacugaccugugccacaucccuucacuacugcaguguucuuuucaacugaucccaggauaucucuauuuuaauccaguuuacauucuagugucagucucuucuucccugacaccacugcuucgacuauuugacauucuuuuuacuuuugugaccuugaacaaacauuuuuagugauuucugaauacuuagguugcucaacuguaaaacaaucucacaggccugucaggauaaaugagacaauacauaaaguacuuguuauagugucuuauacauaauaagagcucagaaaauauuaguuauuauuauuuuaauaaucuuuuuuucaaccauuuuuauaaaauggucucgucuuauuuuuuagcuuaauuucccgauauuucccagcuccuuaaacccaacuuggaaaaauccucacaaaguuuccuccuauuaauucacuucucuauguaucagucaugcugaagaugcuuccuccuauuuuaacauauaaccugagauuauuuccugggcuuuuuggccauuuugaaugggcuacuuggguguacaauacaauguguguuacuuugacaauuaaggaaggcauuaucuaaggcuaagagagcuguggaacuggaaauauuaauuucuguuuaucaaauauuguauguaucuuaguucucuuucauugccagccuuauuuccauaauguaguuuauaauuacauuuuuuccucuuuuguuagcuugcugacuagauauucuuucauuguuuuuuaaaugguuacccuagacaugacaacauguaucucugacauuauagucuaccuuaaauuggcaugauuaccccuuccugacaauguaagacuucauuaauaacauuuaaccccuucugcccuuuauugcauuauuauuauaugcuacuguuuuauuguuuuaagcucucaaccuucauuuauauuucuucacuuuauuuacccuuucugguauucuuccuuuucuccuacaucuucagaguuucagaggaaguaaguuucuuuugcucgaagaguucucugugcuguuuucuuuagugacacauucucucagcuuguguguaucugaaaccucuuuauguugccuucaucuuacaaauuauauuuuuaguagguauuaaauucucgauugacacuguuuucuguauuuuccccucuuuuucaucucugugcuucaaucuggguaacuuauacugacuugaacuauaguuuaauacuuaucuuuguaaauguaucuaauuugcuaaaaauuuaaauucaucuuguuuucuagaauuuccgacuucuuaauguauuuuaucauuacugaaauucuugaucuuuuccucugguuuuuugagcauacuaaccauaguuauuaaaaaggcuuugucuggggauuuauuucuauggucuuuuuuuuuucucuguuuuucaguccuuugguccucauuuuuaacauacuucauaauuuuucacuguaugcugggcauuuuauguuaaaagauuuggguacuuuuucucugaaggaaguuaaauuuuucuaaggagaagcagauaaaguauaagcagaucacuuucauucugcagagaacugguuuuaugcuuuauuggggaugauuuauaucuauuuuauuuuuguuccuacuucuguaauguagcccuucugggucucaagugaaagccuggaauguacuccaaggcuauuuuauaccuuggcagaucuuaaauuccaaugucugucucucuaacauuggcugcuaaaauuuuuguuuagcauuuuaacuucccagcugcuacucugcugaguuucuuggaauuucacccuguguacaugcugcuuagaaacuggcaaaugcuucaaaggguguuugcauauagauuuucagaauaauuuuccugcagcuucuccuuuaucugugacucugucccucagcugcuuugaccucccuguacucugagcccuaucuguucaggccacuaaggccucugcauucugcucauauucuguugucccacauuaugaauuugcagauaaucucagggaaaagcuggagugaaucuagagcucaccuuggcuuacuucccuucucucagggauuacagcccuucaaggccugccugcaguguuacucuccagugccuuaagcagcuguuuuauguauuucacccagccuuucugguuguuuucagugggagaauuaauacaaacaacuucgucaaggcuauaaguagaagucuccauaguauaguugacacgauuccuuuguaaaagcauuauauaaaugauuaaugucaaagugcuucauauuaccgcuuauagcccuagaagaagucaucaguuguuucauguauccuagccagacaguuaaggaaaagucacagggaagauuaacagaaauaaauuuugcuuuucuguacuuccuccuuccugaacacuuuuuuucuuaaucacagaacagaaugcucuuucuucuuuuuuuccuuuuuguuuuacauaagauauuuuguuagauauucuuauuguucauccuaauugaaaacaguccuauggucaguuuuauuuucugauuuccugucucuuccagguugaucauguguuuuguuuuuuuucauuaggagcguagaguggcagcucuccaagaaauuguucgacuccugagaccaggugggaaggcacucauuuaugucugggcaauggaacaagaauauaauaagcagaaguccaaguaucuuagaggaaacagaaauagccaaggaaagaaagaggagaugaacagugauaccucagugcagaggucacuuguggagcaaaugcgugacaugggcagucgagacucggcaucuucugucccccgcauuaaugacucucaggaaggaggauguaauucaaggcaaguuucuaauuccaagcugccuguucauguuaacaggacuucuuuuuauucucaagauguacugguucccuggcaccuuaagggaaauccugauaaaggcaaaccuguugagccauuuggucccauaggaucccaggacccaaguccuguguuucaucguuacuaccauguguuccgugagggagaacuggaaggugccugcaggacugugagugaugucagaauucugcaaagcuacuacgaucaaggaaacuggugugugauucuucaaaaggccugauuauuuaccugaacacaucauauauaaagaagaaaugcucacuuaaaaaaaaagagagaauaaauuaauuacccuuuuaauuaaagagaaaacuugugggaaaguaccaaaggaaagcugagaaaaauuuggaaguagggauucauuaggagacauucaaaugucuccuguuggcugacaucacagaugugguguuggcuccuccuacuucccuaggagaggugguuucuaaaagugauugaagcaguuugugcaguguuuguaauucuuggguaagagcccaggauuuugaagauaauaguuuuuuaguaaagugcuacuaaauguaguaaaucauguaggauuuuagggauguaauuauauguuaauacagaaaauaguccuggucaauagaaaauugucugaaguuuuaccuaugauuuuuagcucuguaaaaucauagacaauaaccauucuauuuccaugccugacuagcccagggcuggacguauagcggguguccaauaacguuuagucaaucagauaauacccagaacuuaguaggaguuucauucaaaaacuauuuuuugaacccaaccauguaccaguuacuauuuuaaguacugauaaugaagcagugaauaagaaagagcaaagcucuugcccuuauggugcuuacauucuagacggggagacagacagcaggcaaaucaauaaauagauacuaugugccagauagugauaaaugccaugaaaaacauaaaaugagagacgauucaccuuggagcaaaagauuacuuuuaagugacugaaauaacuacuaauccugacuaauuuauuaucaagaguuaauugguauuccaaauucauugagcagggugcuaaaaacaacccaaaugugcuccuuuaacuccuuuguuuaaaugacaaaaguuagaauguggucacucagaccuaacugugcccuuagagccaaagcuguggugucauuauugguuauuucuaguugauucauaguuugucccaauccagguucaaucggguuauuuuuaagaucuguacaauauugcauaauaguaacccaguuaacuuaccacuuagguuagauuuccuggaggaacaaagguagaaauucaaccauaggucaaauuaucacauagaaggaaaaggcuuuuuuucaaagaaaaaauuuuuugaacacuuuacucccaguaugcauuacuuuuguaguaguaaugcuuaagacuguuuuaaagaaaaauugcuuucuguuuaauuaauguuuacuguuauuaaugcuagugauacuuaaucuugaagcaucaaguuuucagaaaccuauagugaucaauaaugggucucagaugagaggaugauuauuuuuuucauggaauuucaguccaacauccugguguacuggucccucugggaugaauuuauaaggcucaugauauaggaaaaggaauauagggcuaaaaauaguuuuauuucugauauaaauucugguacuugacaccaaaguuugaagucaagucaugccaauaaauuuuaacauccaaaugaaauagaugauuuucuaugaagaugaaaaauaccaaaauugacucaagaagggagagaaaauggaagauguugaaaaauagcauaggaauucagaacugggcucuagaaucagauuuccugagaguugaauucuagaucugccauuuauuagcugugggauuuugggcaaauuucuugacuuucugugcuucaguuuucuuagcuguaaaauuggaagaguuguuaugaaaauucacugaaaguauauuuguauacaucauaggauaguguaagaauauaguauggcuuugagaaauguucauuauuauuacucccagaggaguuuuagguauuaagugaugccaaauauaauuuguuaauuguauaauaaaaaucuauauucuuacuga

SEQ ID NO: 192010 - RNA, 26641 nt, Homo sapiens
agcagaaccguuuggcagggaaaaccauacacugaaagcggaccucgccgcuaucucgggccugauggcgcggacgcaaacguggccccacccccuucuucccggcguccgugcgcaggggacgggccgucgcuacgcagacuggcccaccgacagcccucccagcccgcccccgacucagccaccuccucucggagaaagcagcugggggcggagacggagaucagcccugcgcuuugcggcauuguaugacgucaaguaggcgaggcuucggaggcgagcgaagggcgggaccaaggccaagagcccgacaguuacgccacucacacuugcggaagaguuaacgggacagcggugcaggccaaucgcaaccaguccucuggaggcagggagacugggguggagacuucggagacugcaguugcaggugggugagcuccggggucugagggaggagugggaugguagcccuuauucucagggucugaguuggccccugugacccacagagaagagaauguccuuggcuucagcugcuucguguacggggcacgagagguuuccaucucuaggagggggucugcaguggugcccccugcaguugugcaacgcaucagcccugaguuccuucuuucccugcccccauccgcaucagccuaagacccacccucacacaguacgcucccgacccuuagcagcagccuaccugaaacccucccuccgaaggccgagcagaggcacuauccccagugcgcaacacugaccccgccuggauccgaggcugccagcgagcagcugagcuaaugcuggcuguuuauuuggggcgaugaagcgacccaggugcuguuuugcuauugccaagccugggcuagagcacuagcgagaaaacaggauuccauuguugagguaucaguguuuccaucaugacagagguccuugcucuaacagcaacagaaacaaguaaauaacuuugcucaguuauuuucucagacuuugcgaagggucauauugauguaugucuguuuccuuaguuguuccguguaggcuguuguugacucucguaugaaagcccacgcgauccaagugcccugcagguuuugguccagggaaaaguuggucucugcagaugacuguaaaugacuaccuggaggucgauuaaagugcgguacugcgggauucagccgauuuccuucuuccucugacugcccggaaauaucagccaaaggccagcgguaguaauuaacacaauuaccugccuaugauuucuguccuauuuaagauggguucuauuauguuuuuaucuauacuugucuucauuaacuuuucgugauaucauaagccccccgaaucccucgaaaguagaugggauucugagcacacacacacacaaauucagauccccaaaggacaguaaaacgaauuauuggcuuaauauaucaucuuagcuaaccaaaagccugugucagcugccauguugaaaaucugcuuaccagcugcagggagcuuacaaucugguaaggcaaauaaaucauacgcauaaaaaguacaauaagagacaguguaaagauacguaagugauacuaauacccauaucagcaaugaucauaacucacuucuccauuuuuaacuaagaaucauauaaccuuuccuucuugucguuuuaaacugauuuuuauaacuuugauacauuacguuucuguuuccaaaacacuucuguguacguuauugcacauguucugugcacuaguuauuacugauggagacaaugagcucagaaagagaauuuguuuaaauucaggaauucauaucccauuauuuuaccaucgagcaagaucucuguguauuagaucuauggagccuaauacacagacaguaacguagggauuauuuguacuuggucuagaaucuagaauauucuccccuucucccauuaucacauuccuuguuuccucuguaucauucaggcccaaaucucauaccaaacagaaugucucuguucaccuagucuaaaauagcuuacucucuccacuuccaaaccucagccccaaaccuaucacccugugaacauauuuuauagguuuguuuaauccccuucccugugugguuuuacaaauucuccagagcuuagcuuaaaccuucucuuagggccuacuucagaguaccuuuuuccaaaacaguauuguuuauguaauucauuuggcaguuauucuaguauugccuuaugacgucucuccuauuguccugaauuauuuucauguguguuaucuugcaaaauagaauguacaguacuugagagggaaugucauguauaccuuuuacaaauaguauacaugaguaaauguuauuaaugacuccacaauagauuuauuacugucaaggguaacacugcuuuuuauauucuaucugccuuuacuucccucacuuuuauuaaggaaauauaaauaugcaguucauaacuugcuuaacuauauuaaaugaacccaacaauuuuauuaaaauauuuuuuacugcauuggucaggggaagaagaggacuaaaguaauaggggcucacucagucuguaaugaucaucuugcuuggugcugaucuguggcuucuuagcaggauucugagggacucguauucuauuuccagcucuaccaccaauugucugugugacauuggucacacaggauccuaugugugacauaaccucuuccauguauuaauuucaauggaaaggcaucggaugagaucaucucuaagucuagguguuuuuuagauauacucacuaacuuuuuauugggucacaaacuuuauucuaccucaaacccuucuuuuuucccccaagacuuauuugaauagcuccauaauucuaccaguuucucaaggaagaaaccaugaugcugcucuucuuugacucccuauauccaauccaucuccaaguguuuuuggcucuauuucuaaaauacagaaaaauccauuuauuucucuuuauucccacuguuaacaaucuaguauaacccaccaucauuuuucaucugaaauacuaaucaguuuucuagccugccugagaaaggggagcacucucuuccaaugucuucuaugccauaagcacaacuugcuuucagagcuaaaucuagaaaucuaugcccuuaauucuuauguuacauugcccucuaauuagacugagaaggagaggccagcaagguaggaaaccugaagaauguuguggcacagaaacuaaaagacgaguguuucaaggacuaguuaacagugugaauuauccuaagaggugaaauaagaugaggagagagaagugagaauuuaccuucaagaugguaguguggugacauugacaagggcaguuuuaauggaguaaaagaaaggaauuuuauuguaguggguugagacgauaacuggaggugaugcuaccacagaguguccuuuaaagaaguuuuucuggauuuaggaaguagaaaaauggaaugguagcuagagggaauaaaaggucaaaggacagauuuuuguuugauguuuguuuaaagauggaagauacuagaauuugcaugcuaauggaaaaugucuaguagggugggagaagcucuuaauguaugagaaggaagggguauguguguggggggggguguucggcauucuaaaguagacuccaggguagaggaccuugucuauguuguuuuucgcuguauuucuaguaucuagaauaguaccugccacaauauuuguuacuccauaaacugucuaauauuuguugaauaaaugaaugacuuggacccuacuucucuuaccuccuuucaauucauucuugacauauuagcuagaaaaauauuuuuuaaaaaaaugaugucaugucacuguccaauuuaaaguaaucagucguuccuauuucacuuagaauaaaaucccagcuccugugacccauagcauccugacugagguagcaacugccuucugcagcccuaucuccuaacccucuuccuuucauuaacuacuccagccacacuggccgccuuuaauuuccuaaaacugaaggacuccuuuaccccuguagggcuuuauaugugauuucuuccaccaaccccuuaccuucuuaucauucaauucucaaaugacacuucagaaaggcuuucccuaauauuguaguggcugaaagcaagggcucuugagccaaacugaguucacauaccaacucccugcuuacuugcuauaugaucuuagccaaauuacuuaaauuaucaaagccuguuuucucuguuuguaaaaugaagauaaguaucuccuuuauccaguuuuuuuuuugaagauuaaaagaguauguguaaaacauauagcaugggaccaggcaugguggcucaugccuguagucaacagcacuuugggaggcugaggcaugaggaucacuuaaggccaggaguuugagaccaacuuggguaacauagugagaucccaucucuaaauuaaaaaaaaaaaaaaaaaaaaagcugagugugcuaaugcacgccuguaaaucccagcuacucaggaggaugaagugggaggacugcuugagcccaggagguugaggcuucagugagcugugaucuugccacugcaguccauccugggugacacagcaagacccugucucaaaaaaacaaacaaaaaauauaguacaaagcauggcacauuauaagcacuguauaaguguucccuguuaccccuuuuguuauugucugaaauugaaugccccauuguucauuuuuauuuccacuuccuacuugugucuucacaguacuuauaaaaauguauaauuauuuauuugccuacuuuauuuauuaugucauuuucaccagauacuggacaaggaaaaagcagggaccaugucugucuuuuauucucuuuauaucucuagugccuaauucggugcuugucauauacuuagcaucuauaauaaauauuuacuaaaauaggccagaaaucaugcuguauauugaaacaucagugacgaaacuaagaucacuguaggacccagugaaaucaaagcccagaucaggcagagcacagcuuuaguuuaacguucugcuuuuaucaaguggcauaugauuuuugucauuacuuuuuaucaaaggcuugguucuuaggcuugacucuucuaccuuuauucauucaauucuuuaaaucaaauuuuaauggaaggcuuuuaaaaaaaagaauaacaaucauuuuaaaaauugagucaguguuuugggcaggaagguguuucauugaagcugggguguaaucuuaaaaguacacuauuuuauauacuacuaagaaaaaaaaugccaacuauggcacaacucuuuaucacuaagaauuuuuucuacucaugcaaagagcccccuuuuaaaaaaaucauauaacacccuugcaccuacauacaaagaacaauaugagcaaaauucauuggcugaggcauuccuaaaacuucuuaacauucaaagugucuuuucauugauuuucaacucagagucucuguguccauguuuuauuuucauaauaucauucucuguuuagagcauuagugauauaucauuucuuaaaucaauguccauuauuaucuccaagguuuucuuccaacacacugauauccauucuucaaauuuaauacacauguaaugacaaauaugucaugacuacuacccaaccagagugauuuuaagaugccugucaguuucagauaagugugaaaaaauuugugucuuaaaaucaaugaaauagcauaauugaauuugaagaauauuugaagaaaaauaauugccuuauaaaucuuuugccaagaauugagaauuguuuaacuguuaauaauguuauugauuuuaaucauuaauauuuacauauaauuugacgauauuaacuuaauauucauuguaucauuuaagucucacaacaguccagugucauagguguguccacuuugcagaugaggaagccaaagccucagagagccuaaguaggagucacuaauaagugaugaaccauuuaggacuauuucucuaguugcaaaugucauauucuuuguuauuugcaaaauacacuuauacaaguaggauuuacucaaaugaaauuuaagaaauagaaauuuucagcuccuuagauuugucauucuguauagaauauacauggcagacuuuuuuuaaaaacaguguuauaaaagugaauagcuaucugugauucuuuauauuauuuuaggauaguugaaauuuucaaguaaaacuuguuuuuguuacuauuuauagaaauaaaaauaacuuuguguuuacaucaugugguccacuuauucaugaaccaugaggcucaauaauugacuuaauccaacacaagaucuaaauuacauacaugauuuucaugacaguaaaguuaauuaaaaaguguuugugguuagaguuuuaaaaauugauauucucaggaccuaugccacuaugcagaaauacaguuuuuauucuuuuggaaguaucuccuuuagucaccuuuuuacuguuuuauuuccgacuuauuuuacaauacagaggaaugauuuuauaccaauuaaauaauuauguuuuauuugcauuuucuauguuuugagcaagaagaaagcuggaacaucaaaauaguuucugaauugauugaucuuuuguuaucuuuuaauaucuuaaaauaauuacacaagaaguuguaaagauagaguuuccauguacccuucacccuguuuccccauaugggugcauacauaauucuaguaaaagaucaaaaccaggaauuugacauuaguacaauguguguguguaguuucuuguaauuuucucacguguagauuccuguaaccuaucuaaauuauguguaucaacacuucauccauuuuuaauggcgaguaguauuccacgguauggauguaccaugauuuguuuacucuuucaccuauugugcaacauuuugguuguccucagcuuuuggcuauacaaaugaagcauuaugaaacauguagaggcuauugcacacacacaagcuuuuauuucuaauggucagcagcaugauucuuggguaauaugguauguguauguuuaguuuuuuuaagaaacugccaaacuauuuccaccagcaauguaugggugauccagugucucugcaagcccucaagcauuugguguugucauuauauuuuauuuuagcuauuuugauagaugguuagggauauuuauugcagucuuaauuuccauuuccauaaugacuaaugauguugaacaucuuuucaugugcuuauuugccaucuguauauucucuuuggugaaauaucucuuugugccuuuugcgcauuuuuuaaauugaauugucugguguuuuuacugguaaguuuucagauuucuuuauagauuauuucuuuauuagauucaguuugcaaauauuuuuuuccuggcucauagcuugucuuuucauccucuuaaauaaagggacuuucacagaggaaaaauauaauuuugauauaaaauccaaucuauuaauuuuuuucauuuauguguuaugcuuuugaugucuaagagcucauuaaugagacccugguugcaaggauuuucuucuguauuugccucuaaaaguuuuauauuuuacauuuaaaucuaugaccguuuugaguuaauuuuuacauaaaguaugaaguauaggucaagguucauuuuuuuguugccuguggauauccauuuucuucagcauuuuuuguuaaaaaagauucuuuuucuuccauugaauugcauuuguaccuuugucaaaagucacuuggcuguacuguauggggcuacuucucaauuguguauugcauuccacugaucuaugugucucuccuuucacuaauauuacacaguauugauuaccauagcuauaguaagucuugaaaucagguagacugauacuucccucauuauuauucuuuuugguuguauuagauauucuauuuucuuuaucauuacauauaaauuuuacaguaaucucaucuguauauacaaaaaauugugccaggauuuugauaaaaaauguguuaaaccuuuauaucaguuuggaggaaauuaaggggacaucuuuauuaaguugacuuuuccaauuugcagacauggcaugucuuuccauuuuagucuucuuuuauuuuuuuuuuuagcauuuuauauuuuucagcauacaaguccugugcauguuuuguuagauuuauacguaaguauuucuuucacuucuuuuuuuuuugaacuauuauacuuuuaauuuuuguuuuuguuuuaauuuuuguuucuauguguuuauugcugguauauagaaauaugauugauuuucgugugaugcucuuguguccuguggcauugcugaacuugcugauucguucuaugagguuuuuuucugguagauuccuuuggaguuucuacauggacuaucuuggaauuugcaaauagaggcaguuuuguuucuuccuuuccgauguauaugccuuuuauugaauuuucuuguuuuagugugcuugcuagagcuuacaugcacuuggaaacugaauaauauacuucuaaauaagugugaacuaugaugaauagcagugguaaggguggacauccuugcuguuuuccucaucuuagggggaaggcauuccauaauuuagcauaauguuaucuauagguuuuuuguagauuuuucucuaccaaguugagaagggggaacuuuuccccucucuuucucuuuuccuaagaguuuuccccauaacuggguguuguauuuuuucaaaugcuuuuuaugcaucaguugauauggucuuguguuuuuucuucuuuagcugccuaauaggauaaauuacacuaaucgguauucaaauauugaaacagccuuacauccuuagauaaacuuacuuagccauaguguauaauuccuuuuauauauugcugauuuuuugcuaauauuuuuuaaacaauuuuugcaucuauauuugugagguauauugguccauagugugggauuuugguuuuuguuuguuuguuuuggguaccgucuuugucuggaguaccacaguaauacucacuucauaaaauuaguugggagucuuccuucugcuucuguuuucuugaagaaguuguguagaacugguauuaauucuucuuuaaacuuuugguaaauuuaaucuccuuaaugguuacagggcuguucaaauuauauauuucauauugggugaguuguaguaauguaagcacuuaaugcuaaaaauuuuccucucacacuauuuuagcugcaucauacacauuuugauauauuguauuuuagauuuucuucaguucaauguauguuuuaaauuacacuugaaacuuucucuuugauccauggauuauuuagaaguguguuauuauguuuccaaguguguggagauguuuauguuaucuuuuuguuauugauuuuuaguuugauuucaucguggugaaagaauauguagucugcuguuguuagguggaguuuucuauaaauguugauuagauucuguugauugaugguguuguugagcucuauaugcuuacugacuucuugucuaguucuauuaauuuuagagagaagaguguugaagucuccagcuauaauaguggauuugucuauuuuuuuuucaguuuuaucaguuuuugcuucacauauuuuacagcucuaucauuuggugcauauauauuuuugacugcuagucuucucggugguggaugggcauuacauaauauuccuuucccuuccucaagucuacuuuaucuuguaauuauauugccaugccugcuuuauuuuaauuaaugcuugcauaguauaucuuuuccuauccuuuuacuuucaaccuacuuauuauauuugaagugaauuuacuuguaggaagcauaaaguugggucacuuuuuaaucuucucugguaaucuaucuuuuaauugguauauguagaccacuuacauuuagugcaauuauugcaacgucaguauugaagucuguaauuuauuuucuguuuucuguuuauucuguuuuuauuucuguuuuuucugucugucuccuguggcuuacuugaacuuuuuuuagaauuuaauuuugauuuagcuauagugacuuaugaacguuaucucuuugaauagaccuuuuuuuuuuuugacggaguuuugcucuugucucccaggcuguagugcaguggcacgaucucggcucacugcaaccucugccucccggguucaagcaauucuucugccucagccuccugaguagcugggagccuaccacuccaggugccugccaccacacccagcuaauuuuuguauuuuuaguagagagguguuucaccauguuggccaagauggucuugaacuccugaccucagguaaucugcccuccucggccuccccaaguguugggauuacacgugugagccaccaugccuggccugcauagauguuuuagugauuauuuagccuucuccaauaucauucuaguaggaggagaacgauagaagcaccucauuauagccugucauuagugaaauucuaggcucuccguuguaccuuugcaggcuuggguggguauagagccagaauuuuuuuguguggucuucugcucugguggagugguuauuuccuuaaaacuuuugucuuguuagguugcuccuuuucugguucugugauuaaagagggcaguuuggaggcuguuuaugugugugcccacugguguaucaggguugcagcuuuuguaggaucuagaacauacuaggcaaaaggaaaacccagggaacucaccaguauguuguuccucagaucacuagucagucugauuucaucuuuccacuuuucaucaucuucauuuauuugucuucauauguauguauauauauguuuauuuauauuuauauauaccuccaggguuuuucguuauuguuguuguuguuguuuuuguuuuuuuuguacuuagcaggagaaauagggaaagauacaucuaaaccuuacuggaagcagagucuuuuuguuuuuuuuuuuuuuaauagggauuauauuuuuaagaaucaaaucaaauacuaugugaacucuguggcacagcuuacuggcucaccaaauauuagcugguauuaucauguaugucauccuuauuaagaaugaucuuaaauugcugugguaacuuuugacaaguacauuuauaguuggaucuaaagagcacuaaaauugcuuucugagcuuucauuugauauuaaaauccagggucagaaugauucauuuuggaaauaacauggacauuuaguggaauaagcauguuucuacuaguuuuauguuuuuaggcauguuauuuaaucucugagccucaauuugcuguuugaaaaaguaauuauuaauaccaaucuuaaaggauuauuaugaguguuggaugaaauaacuguauaaauuauuuuugauaaaucccgguaccuucauucuuauuauaucacuaaacaacuaaacaacaaauaaauggcuagaaacggaaccauuuguuugccuaucaguguuuaccugucaacagaaauagaaguuuugcuguauaguauuguucuccaauuuauugguuuaaagguccaaaacauuuugcuguaugauguggauguagauauugaauuuagauuguugugaucauugucaaaauuucccuccauauaugcccuuuguuuucaguuuauuaacaugcacaaguuucucccaucuauaccaaagcaaaacaaaauuuccugguaucuacaugcuccucuaggccccaccugaugauuuuuuuuuuuuuuuuuuuuuugagacagucuugcucugucauccaggcuggagugcaguggugugaucucagcuuacugcaaccucugccuccuggguucaagcgauucuccugccugagccuccugaguagcugggauuauaggugcccacuaccaugccuggcuaauuuuuguauuuuuaguagagacgggguuuuaccguguuggccaggcuggucuugaacuccugaucucuggugauccaccugccucagccccccaaagugcugggauuacaggcaugagccaccgcgcccagccuugaugaacuuuuuaaaagaauaaugucuauaaauugugcccauuauuuccacuuaacuccacucuaauccguucucucccuauuuuaccccaaauuaucagugacuuuuuucccaucaccuuuugaugauauaggugacaacuucauacuugaaauucucuucccuuaguuucuacugccucuccugguuuuccuccauuucucucacuguuccaugugaauucuuccucaaccauauaccuugcucacuuugugucauucacaaauucuauuuuccacuauauuuucaauccaucuagaccagcacuggguauguagcaagugcuccacagauaacauguguacauaucgaucauguauagaacaaaaacaggccgggcgcgguggcucacgccuguagucccagcacuuugggaggccaaggugggcggaucacgaggucaagagaucaagaccaucuuggccaacauggugaaaccccgucucuacuaaaaauacgaaaauuauuauguauuuuugaacaaaaccauugugaaaaaaauauucaguaucuaccccacauccuuuuccccaugucuccccuacuggauagccuggaggaugggguaguaauuacugcuuuagaauguuccauguugaucaaauauccuugccaacaucuauuauucuaaucuuccagagaacuuuuagaaauccaguggaauauaagguuguaggagauaaccuaucuuuugauccucagugucuaacuucuucuaucacauuagagggauuuaaauacauaucuuuuaguggaugaaaauauagagcgauuccaaggggcauccaggcaaucuggacugagucacccgauucuguaguuauuuuagacaggccauagagauucccuauaauacuauuauagguuauggaugcccgagcucaucacuagacuggagaaugagaccaggaguaacaucuuggcuacacugugacacugagaagacaccuugauccuuugcacagcuuuaacacauuucugucaaacuaguauagacuguuuucaaucauauugucuguuuaucugcuuugcgugcccuuuugcauaguauaaauacuuccuggcuauuccuuuuauauuuauuuauuuauuuagaaacagagccucacucugucacccaggcuggagugcaauggcaugaucuuggcccacugcaaccucugccucccaggcucaagcgauccucucggugagccucucgaguagcugggauuacaggcagcugccaucaugcccggcuaauuuuuguauuuucauagagacgggguuucaccauuuuggccaggcuagucuugaacuccugaccugaggugauccacccgccucggccuccuaaagugcugggauuacaggggugagccaccacucccggucccuggcuauuucuuuuaaacauuuguuuucaucaucuuggaguuagggaggcuggcacaaaucucccaccaauucuuuauuauuuccuuugauucugacacuccagauuaaacaccuuugcaaugauagcgcuuguguucaacuucgcucuuaugcccuaggaauuauuagagagcugcuucucuugucccuuccuccaccauuuuauaaguguaaacuuauugauuaaugucaaugaaaugauuugcuugucuuuucuguuaaguuucuuagaaaauaagccuuaacuuccacuuauuuuacacacauuauaugcuaaauuacguuucuuuuugagacagagucucucucugucaccaggcuggagugcaguguuaggaucucggcuuacugcaaccuccaccucccggguucaagcgauucuccugccuuagccucccgaguagcugggacuacaggcaugcgccaccacacccagcuaaauuuugcauuuuuauuagagaagggguuucaccauguuggccaggauggugucgaucucuugaccaugugaucugcccaucucagccuuccaaagugcugggauuacaggcauaagccacugcacccggccaauuauguauuuuuuaaaauauucucaacaacacaacuagauagauauaguuuaucugcaguuuacaaaugaugaaaauaauaaaaaauuagaaguuauuuaccucaaauaugucacaaguaaaugcugaaccagcacuggaacucaagccugauucuaaugcccuacuuuuucuuucauuucgcauuguuaaaauaaaagcuuuagauaaauaaaauuuaacggaguuugagcaaagaacaauucaugaaucagguagcauucaaaacugaaggagguucagagagcuccacuccagcagugugaccagcaagcuuuuauagguugaacauggaaacaaaguagagaaauuaccugauugacuauggcuaggcauuugccuuauuuggauauugucugauggaaguucccuauuuguaaccagcagguugguuggcuguuugugauuggcuaaggcuuguuuuugguuuuugguuuuuaagucaguuacaauaaauguuuccaaguuaaguuucaguucucuuacauaagagggcuggcuacagaggguaaccucaggcuaauagccaucuuauuuaacaacauuauaucacacucuugggaagauguaugauuuuuauacaaacuaauauuucauaucuguguauuuuauaaauauuagaaaagaagagaaaacaugcauaauuuuaaaaacagucuuacaagugacuuaugaagaugccuugugagguaaagaauuaguucugggacauuagccauauauaauugucuuuaugccucacuguaauuugaaauacucuuuuucuguccuaggucauauguuaucaacauuguuaagucaagauuugaacuguugugacaguuaauuucauuuauaagcuugccugggccaucuggugcccagacauuuggucagacauucugaaugugucuguaaggauauuucuggaugagauuaacaugugaaucaggagaccaaguaaagcagauucuccuguguggugggccuuauccaaucaaaugaagaauugaauagaauaaaagacugaguaauaggaaauuuauccugccuauuugaguugggacauacaucagucuuuuccugccauuggacucaaauugaaaaacugacuccucuugggucuuaugcuugccagcuuuuggauugaaacuuacaccauuggcuguugugguucucaggccuuugcacuuguacugaaacuguacugucagcucuccuggguauccagcuaacuaguuguagaucuugggacuucuuagccucuauuaucacaugagcuuauaauaaaucaaucuuucacugucucucucucuugcucucucucucugcccucaucuucauccaucacauugguuuuguuuucucuaguuccuuuuccucagaaauaaccuccaagccuuucauuaucucucuuccuccaugauacccacucucauuuuuaauaugucucccuauucauaguuacucagaacacuacacacaaaaugauuucuacaagucacuuagauuuccagcaguacugccaguuacaaccuauuacuuucuccugcacacacaggcacauacacaccuccacagccacacacacauucacacaggcacgcuauuuuuccacacaguguaauggcuauccaguggaacuuucugugaugaugagaauguuuuauauuugcuuuguauaauauaguagucacuaggcagauguauuaaucugacuuauucagaaaaacagaacuaaagggauauauauauacacacacacauauauguauauguauuuguacuauacauauguauagguauuuuuacuauauacuuguauauguguuuguaauauauauauauggagagagacagacagaaaaacuauaaggaauuagcucaugugauuauggaggcugagaagacccaagauuuguagucagcaagcaggagacuuaggagagcugaugguauaguuccaguuugaguuccagcuugaagucaggcagaaagaaagaguucuuucuuauucagccuuuuguucuauucagaccuucaacagacaggcugaggcacaucuacaguggggaggacaaucugcuuuacucaguguaccaauucaaauguuaaucucaucuagaacacucucacagacauacccagaaguaauguuuaaccaaaaaugugggcacucugugucccaaacaaauugucacucaucacaccacauaugacugaccacuuaaauguggcuagagcaaugagggaccugaauuuuuaguuuuguuuacuuacaaguaauuuaaauagcuacacauggcucaugguuacuguauugcauagcacaacaguagauugucuugguccuggaauggagccuuaauugaugcuguaggacaauuuggacuacuucuccaguaucuagcuuccaccuaggccucuuggaacacccgcucugggagaaccaagcuucaugcaagaagcccagccacucugagacugucaugcugugaagaagcaccagcuagccacuuggagagggugcauuaagaaagagaaaacccuaaugaucagugaggaugagauuuuuuucauauauuuguuggccacauaacugucuucuuuugagaagugucauauccuucuuuugagaggugucauauucuuugcccacuuuuugaugggguuguuuguuuuuuucuugcaaauuuguuuaaguuccuuguagauucuggauauuagaccuuuuucagauggguagauugcaaaaauuuucucccauucuguagguugccuguucacucugaugcuaguuucuuuugcuaugcagaagcucuuuaguuuaauuagaucccauuugucaauuuuggcuuucguugcaauugcuuuugguguuuuagucaugaagucuuugcccaugccuauguccugaaugguauugccuagguuuucuuccaggucucuuaugguuugggguuuuacacuuaagucucuaauccaucuugaguuaauuuuuguauaagguguaaggaagggguccaguuucaguuuucugcauacagcuagccaguuuucccagggccauuuauuauauagggaauccuuuccccauugcuuguuuuugucagguuugucaaagaucagaugguuguaaaugugugcccacaugguauacagcuucacaaaagauugaauaaagaagcagauaugagaaucuaguugucuuccauuaagccagauguuaaagagauuugcaaaaauauaaaacaauguaacccuucucaagaaacuuuuuuuuuguuuuggaaaauaguuauuuuacaguuauccauuuauauauuuuuguaguuauauauaguuauauacauagguauguauauaaaauggauauauaugaauauguguauuaaauagauauaucgaauauaguuauaucaaauuuuuucuuuuuaaaugaaucaauaaauauuuaaguguucucagaaaaaaaaaacaaaaaaaggaagaaagauccccucucuucuagccgucccagcugaaucauaagaaacgugaaugaggaaaccauacuggacauguaacccagucagaccuucagauggcuucagccacagcugccauuugccuguaguuguaugaaagcucccaagcaagaaucaucaccuaaacucacaggaccauuagagauuauaaauuguugucuuaagccacuaauuuuagggugauaacuggaacagaaaugucgaaucaagguuuucuauuuuucugguucuccaaguucccaauccucuuuuccuuucuguuucccacuuccuugcuuuugaugaugcaacuuuuauguuuagagcugaauuugcaguucaugauauucacaauuaucugaucuuuaccuaucuuggauuucugaccucauguuuaaaaaaucuuucuuaauuaagauauaugugauuuuccuuucuacuuuuaaauagcccaacuuggaaaagugcuugccuuuuucuucuucacuaaagccauaacuaauuaaugcaaucuaacacugaucuuuuucaaccaauuaucuuguaaaagucuaaccucagaaggcauauagucuaugguccaagaucagcauuuuaacagcuacuuuguuaccagaagagaauggauuggaaaggagggggauuguguugggcauauacucaaaacuauguuagaaauaauaccucuuauguauaguaauaauauuaaucauguagugaaauccuauauaagcuauuuauacaacuuguacauuuugcuauuuaacacaauuauauagccuucaauguuagcccuuaugaaaaauauacuuuuauuccaaugagcucaacauuuaugaaaauucaaaaggaauuuaauauuaaaugucaggaaaacaaauguuuaaaacaaguuuuacugucuuauuauuuuucuuagugguuauuuuuguguauuugccaucaagagggcgaauuuuggagucugaaacuugcauuaggucucuacuacaucggugauuuuguuuuuauucuaguucuaaggacauauggaauuggcuauggauaauucauaugcuuucaaucaacgaagcacauguaauggaauuccaucugagaagaaaaacaacuuccuuguaucagaagaucauggacaaaaaaucuuaaguguacuacagaauuuuagagaacaaaaugucuuuuaugauuucaaaauaauuaugaaagaugaaauaaucccgugucaucguuguguguuagcagcaugcagugacuuuuucagguacuuuaccuugucuaugccucagauuuuaugauuuggauaauuaaguucuauuuuauacugcacucaaguuuuuccccacaagaacaugcaacaguaauuuuuaauucuaaaaaaaaaaacaaaaacaaaaccuaauuaggcugggcacgguggcucacgccuguaaucccaacacccuaagaggccaaggcgggcggaucaccugaggucaggacuucaagaccagccuggccaacauggugaaacuccgucucuacuaaaaauacaaaaauuagccggucgcaauggcgugcgccuguaaucccagcuauacaggaggcugaggcacaagaaucgcuugaacccaggaggcugagguugggugagcugagaucgcgccaccgcacuccagccugggcaauggagcgagacuccaucucaaaaaaacaaaaacaaaaaaccuaauuagaaccaagauuaacuaaugauuuuuuuuuuuuuuuagagggagucucgcucugucgcccaggcuggagugcaguggugcgaucucggcucacugcaagcuccgccucccggcuuccagccauucuccugccucagccucccaaguagcugggacuagugcccgccaccacacccggcuaauuuuuuguauuuuuaguagagacgggguuucaccguguuagccaggauggucucaaucuccugaccucgugauccgcccacuucggccucccaaagugcugggauuacaggugugagccacugcgcugggccgugauuuuuuaguaggagagaauuuaagacuaccuuuuuuuaacguauaggucuucccaggucagcauuucccaaaguucucuggaacauuaaucccuugaacuacgcugggacagaagaaauuuuuuugauggugucagcuuuguuugggggaucccuguguuguauuauuuuagaaaaagaagacgacagguugaacaaaaauggaagcaaaauuugaagaaaauaacucugcgagaaaagaaaauuuccguccuguguuguauucauguauuacggggagaggagggucuaaccgauuuaaaaauuuauccucuccuuagcaaauucauccucuccuuauauuagggaaaaguacuucuuagcuauaaggcauuucuugaaagcucucagcuuguucuaauucuaagcaaccuucugaauauaauuugguuucccauguagaucacccuaaagagaauguccuauucauaacacugcaguaaucacuaugaugacagcagauuuccauuucugcgaaguuaagggucagacacaugaccuugcaauuacuguguuaauuguaucaagguaguacuauccugugaggcuucuuggucaauagacaagccccuuuuggugaaacccugaucuucagccuuccuaguuauacuacaauaaacuuaaauccuaauugcaauauuuugcauuauguucauuuguggaagcaauuuuaauuugaauuaagcaggguuuaaaucuccaauaaacuugauuaaaaaauaagguuuaagauauagaaauacuaagaugcauauuuuauaugcaaguuaauuuauacuguuuugaauccucaauuuaacccuuaauuuuuuuuuaccaccaucuaauuagaucucauccuuauugccuuuagaguaaaucuuacaagcuagauuucauucaacaaacauuuacugauacauacuuccugcuaaacaccuguuccuguaggggcucuugcuuugaaauugggagcaauggcuuaguacugcagcacaguuuacuggggccauggaggcuacaacggucuugaacuagcuguuugccuaauuugacuauaugucuucaucuauucuuuuuauuucuucucucaguuaaucaaaguuguucuuugaacuucccuggggcccuuacugucuuauacucugccauucuuauuucuaccagugucuucccuccucucuuauaaccuaaguuuucuuccauguaacucuuuucugcccccauauccuucagguccccucuucaucacaggaagcugugugguacagugguuaaguagugggccucuuaauacauaugcccuaaaucuaaauccaagcucuaccauuuacuagacauguuuuauuaggcaaguuacuuaacuccuucaggccucaguuuccuuauuuguaaaaaaguaggauuauaaaaaugggacuuaacucauagaauuauuauauugcuuaaaugaaauaacauauaagugauaauuagcaccguaccuacuacauucaguuaauauuagcugcuaugauuauuauuucuaaaccuagcaaaaauauaaauaaucuggugugaacacacagcuugauuucccugugauguuuucaugcuaauaaaauacucuuauguaggcauuucaauuuauggaccugcacucuucuugaugcuauuuuuuauucaauuuacauauaauuuuugcacauauuucuuuguucagcuuacugcuaguuuuuuauaggucugcuuuuaguuuuuaaaauuacuguuagaacaauguauuuuuaaaguuuucuaccugguuuaaauaacaaaaauaucagauccuuuauuacauauaguacuuuauuaaaugaguacauaauucacauuaaaauauguacauauguaauagacauuugacaauuuacacucuccuauaaugcugcuaauucacaauaugaucaaacucacucaauggaauacugaaaauguaaaauaaaaaugucagaaaagugcacaaugcaugaaaauaucccucuuacaguguuuuuggaaaacaaaaauuauuacugagauggaaugucauuggagacaagaaauugaaaaggaaucacacauguuuuauacauacuuuaugauaagaugguaaauuggagauagauguuaacuggauacucuaagauuaauagaaugaaauauagaaauauaaucuuacacgugucuucucaaagaaaauguggaagccgauaguaaauuauaaauacaucaaaucugauagaaaacauuuuuuaaaauaaugauaccaauaaaagcuaauacuuugcaucaguuaacccauuuauucuucucagcacccaaugacauagauacuaccaguaccugcauuuucagaugaagaauuugaagcacaauaaaguuaagucaccuccccaaggccacacagcuaauaaguggcaguggcuacauacacuggcagcugggcccuauggaccauauagccagcugggcuacauggacucuuaauauuauccuaaacugcuguaggugucuuaauaauccauauaauuauuaucacagguuaauauuucuauugauauacauuacuaaaaaucccugcguaauguguaacauuuugcaaguccccucauauuuuucaguuggauguuguacuuuuuaaauagauuucauuaccuucuugaguagacucugauaaguaaauugguuuuccccuaguauacuuugggcaacuaggaacacugcucagaaagacauccuggacaauacuggcacaaauacaaaucauuauuaaaccagaagcaauaguaaaauacauuuuguuccaugcccauacauuuccaaauaauuuauguuuuuaccuaaacugagccaaagaaauucucaguuccuuagauucugucaacuuuaccauguagcaauaaaacaaaacuuauuaugaagaacuuucaagcuggucuaauuauucaaauuugagggccuaucucuaucucucagugccuauuaccaaacuuuucuuuuuuucaccuuuuugcuugaugugguacacuguuauuguuuaguuuuaggaaaucacauuccccuucuccuaaagaacuauauaaaauaucuuuuuagacauguaucuuauuuggugaauuuuccccacccaauagagucauuggagacaucagguaucuuacuguacucuuuucuguuucauuaaugugaaaucaaagaugaauuugaaagacacuuuuaaauccuaagcccuaaauaauuauauuuuaaguaauuuuaguuaucaccagcacagcuguuacuaauuaauccauaaauaaagaaauuuggccaucagcaagauuuugccccaauaguauuaauaauaaacaaguauacaaaauuugaaucuuuuuauagucuuuuuuuauuaguugcuauagcucagcuguaauguacauuuuuguaauauaggcauuuuguaauauguuuguuggcagauaaauaauauauuauauaauuauucuagauauuaauuaggaggcaauuaaaauaugcuuuuauaaauauauuuaagucaagaguaaggaaaccucuuuaagguaauauugaaaauaauuauggaauaaaauauucuugcuguuuuucuguguucuuuauuuuugcagggcuauguuugaaguaaacaugaaagaaagagaugauggaaguguuaccauuacuaauuuguccuccaaggcaguaaaagcauuucucgauuaugccuauacuggaaaaacaaaaauaacagaugauaauguggaaauguucuuccaguugucaucauuucuucaaguuuccuuccuauccaaagcuugcagugacuuuuuaauaaaaaguauuaaucuugucaauuguuuacaguuauuaucuauaucagauagcuauggcuccaccaguuuguuugaucaugcauuacacuuuguacaacaucacuuuucuuuauuauuuaaauccagugauuucuuagagaugaauuuuggaguacuacagaaaugucuggaaucagaugaauuaaauguuccugaagaagaaaugguacugaaaguuguccuuaguuggacuaaacauaacuuagaaucaaggcaaaaguaucugccucauuugauugaaaaagugagauuacaucaguuaucugaggagacacuucaggacugucuguucaaugaagagaguuuacucaaaagcacaaacuguuuugacauaaucauggaugcaauuaagugugugcaagguucugguggacucuucccugaugcucgaccauccacaacugagaaauacauauucauucacaaaacugaggaaaauggagaaaaucaauauacauuuugcuauaacauuaaaucugauucauggaaaauacugccgcaaucacaccugauugauuugccaggaucuagucuuucgaguuacggagagaaaauauucuugacaggugguugcaaagggaaauguugucgaacgguucgacugcauauugccgagucauaucaugaugccacugaucaaaccuggugcuacuguccagugaaaaaugauuucuucuugguaucaacuaugaaaacaccaagaaccaugcauacaucaguuauggcucucgauagauuauuugucauagguggaaaaacuagaggaucccgggacauuaaaagucucuuagauguugaaucuuacaauccucuuuccaaagaauggauaucuguuagcccauuacccagaggcauauacuauccagaagcaagcacaugccaaaauguaauuuauguucuuggaucagagguagagauuacagaugcuuuuaacccaucacuugauugcuuuuuuaaauacaaugcuacaacugaucaguggucugaacuaguagcagaguuugggcaauuuuuucaugcaacauuaauuaaagcuguaccaguaaacuguacacuguauauaugugaccuuuccaccuauaagguuuauaguuuuuguccagacacuuguguuuggaaaggcgaaggaucuuuugagugugcaggcuuuaaugcaggugcaauuggaauugaagauaaaauuuauauauuagguggugauuaugcaccagaugaaaucacagaugaagugcaggucuaccacagcaacaggucugaaugggaagaaguuucaccaaugccuagagccuuaacagaauuuuacugccaggugauucaguuuaauaaauacagagacccaugguuuucuaaucuaugugcuugaacauucuaaaacgaguccaguucuaguaaccuaaaguaaauuuguuaaccaaaaugauagguaaaaagaucuauacaucuuaaugaaauaaaacauuccugcuuuuaguuauuauguauguacaccauauaugaauaaacaguuuccaaaaacuuaaaauacaaaauauauuuuaccaaaaauuauacugaauauaauuuaaccuuggggaauccagaauacuuaguauuuucacaugaaacuacaaaucauagacucugacacuuugauuuuuaaaguacucuguccauaaaagauuuguacuguuuagaugggagaaaccucuagagagaguaaaaaugaauuacacuguaucuuauaugaaguaaaaaauaaaucagaggugagaauauuguuacugcggguaugaguuguugaauuccuaucauuugugaugauugguuaacuucuuuuagguacccuuuuuacccuuuuuuaguucagaaauaauucucccagcuuuauaaauaguacacuaaacauaguuuaacuuuuuuuaaugacucauuuuuucauuaaaagcauaauguaccauguuauaaugccauuagcaguuacuuaaaugcuuuaaaaauugcugauuaguuuucaaugucaguugguuucaauuucuagcucucucucucucucuccucccccccucucauuuucugguucaaucuuaguaaauuaacauucuggauuuaauuaguaguucuaaguuacaccuggccugaguuuauguuaacauguaacccucaauuggaaauuuuuggauucugggauggcaguacuaaaauacuuuuuauguaucauugcuagguuccagccuaauuaaggacauagaaaauugaccucuaauuaaguggaucauuauuauggcauuucuuaagcuuuauccaaauuucagcuacauaaaacauuucaggauuuaaauuaguaccauaucaauuuucugugaugauguauaccaacuauaaagcacuauguugguuuacuacuucaguaaauuauucuuagugaauuauuuucuaaauuaaaaaaaaugacuuggcuuuugguauugauaauaguauucacaaccugcaucuguuaagauguuugaucuuuaacccacacaauguaaggguacuguugucauuguucucagguaggugauucugccuuccaagaguauauguuucuuuaaucaguuuaaaagauaaaggcauuuuggguuuuaagaccccugcuuuacaucucagguaauguguagauuguacuucucuggaaccaaauguaguuuucuacacucaguuguaaauguuaaucuuucucaaaugugcacauucuuuaaaaguguguuccuaaguagaaauacaccuaaaugaagauucucuuauuuuaucauauaaauuuaugcaacgauaaguuccaaauguauuuuucaaaacagaauggaauaucagaguacauuuucaugaaguuuaaaaaucaaggacuguuccugauuagaugacguauuuauugguggccuucuuaucuaagcacaugaguaguuggcucugaacuuuguguauuugaaaaaggaaaauucaguggaggcuuuuguuuguguguguguggcuuugaaaacaaauuauuugagaaagaccauaacacagugaguagccuauaugugcauuuacugaauuguuaauuuaaggauauauauuaauagaguauguuuaaaauaaauauuguuuucaucacuga

SEQ ID NO: 192011 - RNA, 56720 nt, Homo sapiens
aaaggcuuccuuccgggcaccgcgaagccagcgugcucagcauucagggaggcagcggcgcucgccuucauccaggacaacaaaacugccauuuccgaagagaaaggaaacggcucgcgguuucugggguucccaagcgcgcgccugcgagggaggccgcgagccgagucgccacgcccagaaccccgagcccgcccccgcgccacccagcccggccccgccgccccggcugcgcacgcgacgcccccuccaggccccgcuccugcgcccuauuuggucauucggggggcaagcggcgggaggggaaacgugcgcggccgaaggggaagcggagccggcgccggcugcgcagaggagccgcucucgccgccgccaccucggcugggagcccacgaggcugccgcauccugcccucggaacaaugggacucggcgcgcgaggugcuugggccgcgcugcuccuggggacgcugcaggugcuagcgcugcugggggccgcccaugaaagcgcagccauggcggguaaguggcugcgggggucgucagccccguucgugggaggcagcgcgcugccgaggcuuggguucccaaguugggcucugguacagaaaguuccgcgugugucuggccgaacgcucggggcggacccagaggugaccgggcggggugggggaaacugagguuuggaccagucacccgcuggccccggggccgccugcugaggaaauugccuggugcuuccccucucgcuuuuuggaugcggcggucgcaggccgggacgggugcgcauaaccuguugaguuaccgcaaguugguuuuuacagccuuucccugaaguuaauguuugccgagguuagaguuucuaaggcuuccguuuguaaacaagauuagcugaguugaaaaauaugucuaccuaggcccgcggaaacgucucccaguuagucggggagcuuuucaagcgucccccaggcauuucagcgucuaauauuaugcaguauuauccagaugaauuacaaucuuuaggucccccugacgcucgaaguuagacuucggggcucuuggagcuaguugggagcuuuuggggagcgcgccccgcccucgcgguaguugaggcggccgcccccauggcggggcgcucuccaccccucgugugccauaaacacccggccgaggcgcgcggcagcugcgcagcguuaagggcacagcugcacggucgccgguggcccuugucgucgcuaguaaggucguaacaggaugauguugacuuugcuuuucuguguagggcggaauuuguuucguuuuaggcccuuggcccuuuggagacuucaaacagcccuuuuuggaugaaaccaggaaguugggauuuguuguguaaauacuguuuuccuuugucaacuguuagagaagucaggucccuagguaauggucaguaaacuaggauaaguuaaguaacccaagguuuucaugguuuuaaguucuauccauccacuguauauguuagccuuagguucguuuuauccagcaaaagaaaaaggcaguuuguaaaucuggaagguucaggcacaacacuugcuuuuucuggaauaaccugggugaauuaacaauuuuucuuuguuuugcugaaguuuuuuuguuugcuuaauugugcgugugacaaacuggcuucgcagaccuaauuuugagaucauuuaagaaaaaaagugguaaaaucauguccaucguguaucuugguccuaauuuuauaccaauuaucucaugaggugaggucuccauuuuuaaaaauuuguugcuguguuugugaagauaagccuuacuguuucaaugaauuaccgauuagagaaacugugagugaccaugcuuuucuuucuuuugcccugauaacacagauuuuuuuugcccuauuuuagcacuguuuguucuguuuauuacuuaaugucuuacuagagguuagucccauuugcaaaacuugaaaugcucuacaguaggcgagcccugaauucauaaacuaguauaaccaaccagagguggaaucuguuucuacagacuauauaaugucaccuugcaacuagacuaaaagguauacaauagaagauuucucaaaaaagcuaguaacuguuaaucguagucuucauguauaguguaaucuguauacaaugucauuacgaaguauagugauuuuuagccaucauacuaaaacucuuaauggcugauuuuuacuggguacauauucugugcaucccacgcuaugcuaauuuagguccauaaaucaucccauugaauccucacaguaucguccccauuuuauagauaaguaagcuaauuuauggcaaguaaaacaauuaauacauguuugguuucagaucaaaauccaaauuuucaauuaaccauuucaccacuaagccgcguuagaugaugauggcucuugaaguagauaauacuuuuauuccacaguauuaccauugccuagaauauugugggagaagauaaaaacauuauugaaauucugcuuuuaaaauauucuucacagucagcugcauagcuuuauaaauaucaguugaaggaggagggagacuaugagcaaguuugcaaaucagcaaacaggauuuauuguaguauuccaaugaaugacauuaacauuaacaggaugggaggggcggcuguuagucauuacucuuaguggcaagugacagaaacccaccuugaacaacuguggaaagaagggacuuuuuugacuuguaacugaaaagugcaaggauugagguggcuugaaaauggcuguauucaaguguucaaauaagucgccaagaaauuaagaaaucaucgcguuaagagcgacaauagcagggaaacaaaaacaggcuguuguguuagcccagccaaaagaugauggugaguggcaauggagauaaaaggguggauucuagaucuaugggggguugggacuaaucacuugcugauggauuggagggugggaugaggaagagagaagaaucaaaggaugaccucuugguuuugggguugagcagcugguaaugcaacaauugggaagguugggggaggagcagguuuauaguagaaaaucaguaguuccauuuuggcacucauaucugcaggcuuaggaaucaaacuaucugguccaauuccagucucugccacuuuguaucugggcggccuucucugggccucaguucuugucugcaaaacaauacuccuaagaauuguugagaggguuagaugagcuaaugcacauaacccuggcuugugguaagcaccuaauaauguuggcaauuguuugcuaucugcugcuaaauacaucuacguagucuguugaccuugaucuuuuucaaguuaaucuuacacuguauccuuuugugauaaauagaugauagucccaucaagaagaagaaauucucacaaagaagaaauuugcccaagaaguaaagauaaauccuucaaaguuacugcuuuucuuuguacuuggaggauuuuuuuuuaagugggggagaguucaucuuugugaaaaggacacaauaauacacuugcucucucccuauguguuauacauauuuaaucuucauuagacaaagacucaaaacgaauaaagcacucugaaaaguugcuuaauugggacauagaaaucucuuacauuuuuuccaaaucuaaagguguacuaauuuaaaaauuaaaacccuacugagaaggugcaguuaaauaagaaaauccuauuuuaucccuccauuguaugaaauuagggguguugguuggguggugcaagaccuagagaugccugugaguagaaucggccucuccugaaaugguccacuccacucagaagagcagaguccucaguggcagaaauuggcccaucuguccccaauuguguggguaaaugaauuuuggcaaagcuguugcauucgguggcugguauauaguaaguacuauguaaguguuuguuauguaagcuagauguuuaucuugaaaaaccugguaauacagucccuuuuacugacagcuucaagauauguuucauaacaacaggggccaaaguagaacuuccuguggaauaaucuacccuccugacaccacuaccccuacucccgcuaggcagaaaaccacauacugccaguauucuuaguuaaauguucuuucauaacaggauauuucuuuauuuuuacagcaucugcaaacauagagaauucugggcuuccacacaacuccagugcuaacucaacaggugaguuuuaaaagauuaaaaaaacaaauuuucauuugucuaggguacaugaaguaauaacagccagggaaguaggcauaagcugguucacugaccuguuuuaacccugaguucuucacccaugaaucccaauaaccugcccuagugcccuauaguagacaucaguaagugauaguucacuggauuaaucuuccucagucuuguaaagaugucaauaaauucuaaaacaaaaaguguaucggaauuucauguuaugaauuuuugaagcacauuuuuagaugugaggguuuuguaguuugccuguagauaugaaaugucagcacagaagucugcagguccuauugaugaaacaagucacuguaaacuagucagccauggcagccuuaauauaccucugcugacucuaaggagacccuacuuacauuucacccauuaggcagacucaacccaaacacuuggugaggcccuuacccugugauuuuaguuugggacaaagccuugggccucugaguucacuaacauggaaagaugcaagaaccaggcugaugucaucaauaucaguaguaaaucaucaagguacguuucuuguaaacaauuuuuaaguuaucuucucacugcccuuaaucuucacaguugacugaguuggaaacuagaaaaagguacaccaauccuaucacuaacuuguuuuguuuacuuuuagucagggaauauuuauggacucuaaugagcuagcacauccuagguucuaagaauacaaaauggaccaagccuuaacuucuaggaguuuuuguucuuuuguuuuuuauuuuguggcaaaauauacaugacauaaaauacauaaguaaccauuuuuuuaaaguguaaaggucaguggcaguaaguaccuucaugcugcuuugcaacuugcuggaguuuuuauuccuguggggcaucccaguguuucacuuaguuuauguucuugguuuacugcuguucuuuguuucauuaucucugccuuuuugacuggugucuggugguacguagucaggacauacuuuaauucuaguuuuaguaauucuacagaaaacguuuucauugagaggaaaaaaagucuagagggauuacuccaaaauguaauagugguuaucauuggguaguugugagagggucuuaguuaaaaaauauuuuauuacacuauuagauagcuuuuccuuuuguccuuuauugaaucuaauucugcacuacugaacuuuuaaccuuggguagacaaaggagguagaagaaacauaaagacaguaauauuagcaauagacaccauuuuugaaugccuacaacuuauaagauacuccucauacauuuacuaauuuaacaguggugagguaggugucauuucugguuuacacauggggaaauugaaacucaagagugguuaggaaaugcccaagaucacaugacacuaagugucacauucaggauuugaaacccaguuguauucuaaaaccuaugucucuuuaucacacugucugaagugugguguggccuuacuuuuaaaacaugcuuuucacugugaaugauuauuaaaaaucaacugaauacuuugagggcagcuccagagucagugggaugauuucaaaugccccuucuagcacagggaaauuuuuugagaaagaagaaaagcauugccucaaauuuuucuagaaggagaacagauaauacaacuauuaaaaauguuuuugcacaauguguuuuacgccucauaacugucgcauuccucuuuguaucuugaaaacacuuuugaaacauguuaaguuuguguauuuuuauaggauggaugcuuaacuguuuuucuuuuuaguuacauagaccauuguugaagcuuuguuucuuugaacauacuguuuaccaauuuauuuggugcuauuuauuuagugcaguuucuguggcgccauauuuccucucacuaggaaaauagcaucuuuggcaaauuccauuaugauguguauuccaggaauguacuguuggaaaaagcggagacugccugcaguacuccuuagaauguugggugucuaucacuuuuauaggacucaccacguuggaauuucagagaaucuuuuuuucucuuguuuuggucuccaaguuccuugagagugaaaucuaugauuuauucauccuaacaucucacucuaugccuggugcauaguagguaugcaggauauguauguuuuugguugguugaacucaauuguggagcaacauagauauuuuguaauugcugacuugccuuaucaaaacacuaauauauacauuuugcagauguguacugguuuaugcuccaauccuauacauuauuacagcuguuuuucuguuuauacaguaauauagguacuugaagucaauaggaauaaagguugcuuuccaauguaccacugaguuacauguaacaguucuauuuuuuuauguccucuaaucauuauuugaagacagcuguacuuuugacauucuugucugcagggacuuguuugacacacuuucagcuuauauagaaaauaauuuccccuuauuucauuugcagucagaguauuuagauucuguggauggaugaauuuacacuuuauagugcaaggaagacacaugcccagauuauuuuucauaauggguuugagcaaggauguaaggaaauguggcauggucuagauuggagugcacaucucaucaguaacuagaacagcagcucaauaucauucaggauacagccgucuccuugaucacauagcauugauacuucccaacagagggaucugagaggauuggguuaccaucauccaaucugaagcucuuuucuuggacauaacuugcaccaacuccuuuccaaagccguuuaucucuuaaucauguauguuccauuuauuacgauugccauuaguuugguuauucauccuuggccuagucauuugggccacucuagugagguuaguuuuguccauauucauggcagggauggguaguugugagagggucuuauuuuaaaaauguuuuauuacacuauuagguaccuuuuccuuuuauucuuuauuggaucuaauucugcacuacugaacuuuuaaccaccauuuugagcacuuggaccuggcuugcauuuagauuucuacagaagaaggcaguggaaauuugggaacagcuuauucuguauuccaauuuuuacccccgauugcaacaaugaaagucuuacugaaguggaaagaauuuaucagguauauaauccuguaugucacacuaccuucuucuguuuacuuuagauaaaauguuuuaugugugaaaagaauauuagauggaaacuuucugugaguuuguaagucagucaaagacaggaaccaauuggccugacagguugcuuuaguugcaaauggugauacagaugaaugauugauugacugauugauugauucacugauagaugcaaauguugauagauacaaacagugauagauacacagagagacauagagauaucaauacuaguuuuuaacuagagauuggauguagaaaagaauuuuucuaacuaaagaauucauaguacacuuaacugcuucaacuccucagaaaguuaauuguguucaacucauguuuuugagauugcgucugaaaauugaugguaauuuuuuuuuauacuucgaguucuaggguacaugugcacaacgugcagauuuguuacguauguauacaugugccauguuggugugcuacacccauuaacgcaucauuuacauuagguauuaucuccucaugcuaucccuccccccuuccccccaccccacgacaggcccuggugugugauguucccugcccuguguccaaguguucucuuuguucaguucucaccuaugagugagaacaugcgguguuugguuuucuguccuucggauaguuugcugagaaugaugguuuccagcuucauccacgucccuacaaaggacaugaacucauccuuuuuuauggcugcauaguauuccaugguguauaugugccacauuuucuuaauccagucuaucauugauggacauuuggguugguuccaagucuuugcuauugugaauagugcugcaauaaacaugugugugcauguaucuuuuauuuauuuauuauuauuauacuuuaaguucuaugguacaugugcacaaugugcagguuuguuacauauguauacauaugccauguuggugugcugcacccgucaacucgucauuuacauuagaugugucuccuaaugcugucccaccccacccccacccacgacaggcccuggugugugauguuccccacccuguguucaaguguucucauuguucaguucccaccuaugagugagaacauacgguauuugguuucuuccuugccguaguuugcugagaaugaugguuuccagcuucauccaugucccugcaaaggacaugaacucauccuuuuuuauggcugcauaguauuccaugaugugucugugccauugucuuaauccacucuaucauugauggacauuuggguugcuuccaagucuuugcuauugugaauagugccacaauaaacacacgugugcaugugucuuuauaguagugugauuuauaauccuuuggguauaugcccaguaaugggauggccgggucaaaugguguuucuaguucuggauccuugaggaaucgccacacugucuuccacaaugguugaacuacuuuacccucccaccaacagcguaaaaguguuccuaugucuccacauccucuccagcaucuguuguuuccugacuuuuuaaaugauugccauuguaacugcugugagaugguaucucguugugguuuugauuugcauuucucugaugaccagugaugaugagcauuuuuucaugugucuguuggcuaccuaaaugucuuuugagaagugucuguucauauccuuugcccacuuuuucaugggguuguuugauuuuuuucuuguaaauuuguuuaaguucuuuguagguucuggauauuagcccuuugucagauggguagauuguaaaaaauuuucucccauucuguagguugcuuguucacucugaugguaguuucuuuugccaugcaaaagcucuucaguuuaauuagaucccauucgucuauuuuggcuuuuguuggcauugcuuuugguguuuuagucaugaaguccucgcccaugccuguguccugaaugguauugcuuagguuuucuucuaggguuuuuaugguuuuaggucuaacauuuaagucuuuaauccaucucgaaugaaauuuuguauaauguauaaggaagggauccgguuucagcuuucuacauauggcuagccaguuuucccagcaccauuuauuaaauagggaauccuuuccucauuucuuguuuuugucagguuugucaaagaucagaugguuguagaagugugguauuauuucugagggcucuguucuguuccauuggucuauaucucuguuugguaccaguacaaugcuguuuugguuacuguagccuuguaguguaguuugaaaucacguagcaugaugccuccagcuuuauuguuuuggcuuaggauugucuuggcaaugugggcuauuuuuuuguuccauaugaacuugaaaguaguuuuuuccaauucugugaagaaagucauugguagcuugauggggauggcauugaaucuaugaauuaccuugagcaguauggccauuuucacgauauugauucuuccuguccaugagcauggaauguucuuccauuuguuuguguccucuuuuauuucguugagcagugguuuguaguucuccuugaacaguuccuucacaugccuuguaaguuggauuccuagguauuuuauucucuuugaaacaauugagaaugggaguucacucaugauuuggcucucuguuugucuuuuauugguguauaggaaugcuugugauuuuugcacauugauuuuguauccugagacuuugcugaaguugcuuaucagcuuaaggagauuuggggcugagaugaugggguuuucuaaauauacaaucaugucaucugcaaacagggacaauuugacuuccucuuuuccuaauugaauacccuuuauuuccuucuccugccugauugcccuggccagaacuuccaacaguguguugaaugggaguagugagagagggcaucccugucuugugccaguuuucagagggaaugcuuccaguuuuugcccauucaguaugauauuggcuguggguuugucauaaauagcucuuauuauuuugagauacguuccaucaauacccuguuuaaugagaguuuuuagcaugaagguuguugaauuuuguugaaggccuuuucugcaucuauucagauuaucaugugguuuuugucguugguucuguuuauaugcuggauuacguuuauugauuugcauguguugaaccagucuugcaucccagggaugaagccaacuugauugugguggauaagcuuuuugaugugcugcuggauucgguuugccaguauuuuacugaggauuuuugcaucgauauucaucagggauauuggucuaaaauucuuuuguugugucucugccaggcuuugguaucaggaugaugcuggccucauaaaaugaguuagggaggauucccucuuuuucuguugauuggaauaguuucagaaggagugcuaccagcuccucuuuguaccucugguagaauucggcuaugaauccgucuaguccuggacuuuuuuugguugguaggcuauuaauuauugccucaauuucagagccugauauuggucuagugagggauucaacuucuuccugguuuagucuugggaggguguauguguccaggaauuuauccauuucuucuagauuuucuaguuuauuugcguagagguguuuauaguauucucugaugguaguuuguauuucugugggaucaguggugauauccccuucaucauuuuuuauugcgucuguuugauucuucucucuuuucuucuuuauuagucuugcuaguggucuaucaauuuuguugaucuuuucaaaaagccagcuccuggauucauugauuuuuuuuuuuuugaaggguuuuuugugugucugucuccuucaguucuccucugauuuuaguuauuucuugccuucugcuagcuuuugaauguguuugcucuugcuucucuaguucuuuuaauugugauauuagggugucaauuuuagaucuuuccugcuuucucuugugggcauuuagugcuauaaauuucccucuacacacugcuuuaaaugugucccagagauucugguauguugugucuuuguccucauuggguuuaaauaacaucuuuauuucugccuucauuuuguuauguacccaguagucauucaggagcagguuguucaguuuccauguaguugagcgguuuugagugaguuucuuaauccuaaguucuaguuugauugcacugugguccgagagacaguuuguuauaauuucuguucuuuuacauuugcugaggagugcuuuacuuccaacuauguagucaguuuucaauaagugcgauguggugcugagaagaauguauauucuguugauuugggguggagaguucuguagaugucuauuagguccgcuuggugcagagcugaguucaagucccggauauccuuguuaccuuucugucugguugaucugucuaauguugacagugggguguuaaagucucccauuauuauugugugggagucugagucucuuuguaggucucuaaggacuugcuuuauggaucugggugcuccuguauugggugcauauauauuuaggauaguuagcucuucuuguugaauggaucccuuuaccauuauguaauggccuucuuugucucuuuugaucuuuguuguuuuaaagucuguuuuaucagagacuaggauugcaaccccugcuuuuuuuuguuuuccauuugcuugguagaucuucuccaucccuuuauuuugagccuaugugugucugcacaugagaugggucuccugaauacagcagagugaugagucuugacucuuuauccaauuugccagucuguguuuuaauuggagcauuuaccccauuuacauuuaagguuaauauuguuaugugugauuugauccugucauuaugauguuagcuggguauuuugcucguuaguuaaugcaguuucuuccuaucaucgauggucuuuacaauuugacauguuuuugcaguggcugguacgguuguuccuuuccauguuuagugcuuccuuuaggagcucuuauaaggcaggccugguggugacaaaaucucucagcauuugcuugucuguaaaggauuuuauuucuccuucacuuaugaaacuuaguuuggcuggauaugaaauucuggguugaaaauucuuuucuuuaagaauguugaauauuggcccccuacuuucuucuggcuuguggaguuucugccgagacauccgcuguuagucugaugggcuucgcuuuguggauaacccaaccuuucucucuggcugcccuuaguauuuuuuccuucauuucaacuuuggugaaucugacaauuauguguccuggaguuguucuucucgaggaguaucuuugugguguucucuguauuuccugaauuugaauguuggccugccuugcuagguuggggaaguucuccuggauaauauccugaagaguguuuuccaacuugguuccacgcuccccgucacuuucaguuacaccaaucagacauagauuuggucuuuucacauagucccauauuucuugaaggcuuuguucguuucuuuuuacuguuuuuucucuaaacuuauaaucuugcuucauuucauucauuugaucuucaaucacugauacacuuucuucuaguugaaucagcuacugaagcuugugcaugugucacguaguucuugcaccaugguuuucagcuccaucaggucauuuaaggucuucucuaugcuauuuauucuaguuagccauuugucuaaucuuuuuucaagguuuuuagcuucuuugcgauggguuugaacauccuccuuuagcucgggagaaguuuguuauuaccgaucgucugaagccuucuucucucaacucgucaaagucauucuccguccagcuuuguucuguugcuggcgaggagcugcauuccuuuggaggagaagaggcgcucugauuuuuagaauuuucagcuuuucugcucugguuucuccccaucuuugugguuuuaucuaccuuuggucuuugaugauggugacguacagaugggguuuugguguggauguccuuucuguuuguuaguuuuccuucuaacagucaggacccucagcugcaggucuguuggaguuugcuggagguccacuccagacccuguuugccuggcuaucaccagcagaggcugcagaacagaaaauauugcagaacagcaaauguugcugccugauccuuccucuggaagcugggaggugucucccaguuaggcuucucgggggucagggacccacuuuaggaggcagucuguccguucucagaucucaaacucugugcugggagaaccacugcucucuucaaagcugucagacaagcaaguuuuaagucugcagaaguuucuacugcccuuuguucagcuauguaugcccugcucccagagguggaaucuacagaggcaggcaggccuccuugagcuguggugggcuccacccaguucgagcuucccggccacuuuguuuaccuacucaagccucagcacuggcggacgccccucccccagccucgcugcggccuugcaguuugaucucagacugcugugcuagcagugagcaaggcuucgugggugugggacccucugagccacgugcaggauacagucuccuggugugccauuugcuaagaccauuggaaaagcgcaguauuagggugggagugucccgauuuucuagguacugucugucacggcuucccuuugcuaggaaaggggauuccccaaccccuugugcuucccgggugaugcagugcccugcccugcuucggcuuacgcucugugggcugcagccacuguccgacaagccccagugagaugaaccugguaccucaguuggaaaugcagaaauccaccuaucuucugcauugcucacacuggaagcuguagacuggagcuguuccuauucggccaucuuggaacccguugcugguaauuuuuaacaucauccaauuuuguuuaaaggaaugaaauguaggaaaauaaugcaauauuaugcucacuuacucagugaacagcuguuaguuuggacugcccacuccguuagucacuguuuuaggcacaaggcaugaagugguaaauaagaugaauaaguuccugcucucaugaagauaauauccagguggagagacguagacuauaaggaaguaaacaacuaaaaagaugauuuuggguugugauuaaaaauaaauaaacugggcacgguggcucauggcuguaaucccagcacucugggaggcugaggggagcagaucacuugaggucaggaaugcgagaccaccuggccaacauggugaaacccccucucuacugaaaauacaaaaauuagcuggguguggugaugugugcaugugaucccagcuacuuaggaggcugaggcaggagaaugcaugaucccggguggcagagauugcagugagccgagauugugccacugcacuccagccugggugacagagcaagacuuugucucaaaaaauaauaauaauaaauaaacaggguaaaacaccuaucugccuccaugcauaaagagggugauguggaaaaaagugacuaggaagggcuguagauugguuggucagggaagcccucucugagauggggucaucugagcugagaccugcaugacaggaaggagccagcccuacaaaugcuagggggaggaacauuccaggcagaagcccugaaacaggaugaggaacauguauuucaauaaaagaauuauauuuugagccaucaaaaacagagcaggccccagcagacaaggucagaaauguggauucugacgacuuagaauguggauucuuguuaaugucucugggucuuuuuaaauucuauagugauucuaaaccacugugcacucucauacacccuguacucucaagacagcagauacaauaauaaauuggaacugcacuggugcuuucuuuccugaaguaugccuccauucuuaaaguuguaaauaggacccaaauuaaaugcuuccaauucagauuaaggacuacugcuauucuuuauugcgaugugaacuaugaaagggaacauuuaacauuuuaaacguaaaaaaaauuuuuuuuuuuuuuuuuugagauagagucucauucugucacccaggcuggaguacaguggcucgaucucaacucacugaaaccuccgccuucuggguucaagcagucuccugccucagccucccaaguagcugagauuacuggugugugccaccgcacccagcuaauuuuuguauuuuaaggguuaaagagauggggcugggcugaguaaccagccugucauguaaauucugggaaaacccaggaaacacugaauuugccugugggauggugggaguagggagaagucaugaugaauggguguuagaagagauaaacagugagggaaaguacacaaacugaaaaagcacacaaaaaucccaaaaacgaagugcacaacagcaacaaaacuaacaggaaaacaaaacuugggggcauuuuuaaaauauuugguuuuuuuccuuuucaagaacaggaaaaacaaaagaugguguagaacauaaaacauaggccaaaaaaaguagaccuaggccagaaaaaucaacuaccaaacucuggguuccuguuguuuuuccauaaugcagccaucuggcucacaguggguucagucuaaauucuagugugaauaggagaaugaauucaauuggcauuuaauacuugacauucuuuuuuauugucuuucuuuugcauuaaauacuccuuuuucacagagagcaggcaggcuugcucuagauucccaugacuuccuucuuucagacuaaaauugaugacuuaccccaucauguugaguaacacaaagauuucucacgaauaauuuuucccagauguaugaaguucuuaggaagaaacuuugaguuaagcaguaaguagaguuaaacaauaauugguacugaacguuaacugcauggcucuucaucucuuuguguguccguguuuuuuaaauacauaauuuuguuuacaaucuuauuagugaaguaauucaugcaccagucuucuuggcuuugaauuacauuuauuuauaaggaguuaaauugaggcugggugcgguggcucacgccuguaaucccagcacuuugggaggcugaggcgggcggaucacuugaggucaggaguuugauaccagccugaccaacauggcaaaaccuugucucuacuaaaaauguaaaaauuagccaggcguggugaugcacgccuguagucccagcuacucugaaggcugaggcaggagaaucacuugaaccugggagguguaagcugcacugagccaagaucauuccacugcacugcagccugggcaauagugggaaacuccaucucaaaauaaaauaaauaaaaaauaaggaguuaaaccaagaauauuuucauaauggcuuuugguuucuucguuuugucuuuuuguuaaggaaacuucaugcauuuuuuuuuaaauaccuucacugagauguaauucacauaccauguaauuaaauuuauauaaucacacaccccauuucaaguguacaguccagugauuuuuaguauauucacagguauguuuaaccaucaccacagucaaguuucgaacaguuucaucaccucaaaaagaaacccugugcucuuuauuuaucacccccuuauccuaccugcuguucccccaccagcccuaagcaaccacaaaucuacuuucauuuucccguucuggacuuucauaugaauggaaucauguaguguguagucuuuugugacugucuuauuuccauacuucauucucuuuuauggccacacaauucacgcuauggguaugucacauaugguuuauccauucaucuguugauggacauuggaguugguuccaccuuuugauauuaugaauagugcuucuaugaauauuuguguaaacacuuuugcguggacauauauuuucauuuuuacugggaauauaccuaggaguagaauugcuaggucauaugguaacuuuguuuaaugaacugccaaacuguuuuccaaaguagcuacaccauuuuagauacacaccagcaguguauaaggguuuuauuuucuucauauccucaccaguccuuguuguuguacgguuuuuucguuguaucuaaccuaaugugcaugugauguguuuuugauuugcauuuccuugauaacuaaugaguugaacauuuuuucaugugauuauuggucauuuguauauuuucugugaagaaauguuuauccaaguccuuugccauuuuuuaaauuggguugucuuuuuguuagcuugucugugucuguuauuuuuugugauuauaaagauaauacagguucuaguggaaaauuauuuauuuauuuuuauagagauggaaucuugcuuugucgcccaagcuggucucaaacuucugggcucaagcaauccuucugccuuggccucccaaugugcugggauuacaggugugagccacugugcccagcccguuguagaaauucuggaagcaaaguauauauuuuuaaauaauuauucaauguacuuccaccacaaagcuauuguauauuguggugacuauagcucacaauauguuguauacuugaaaauuguuaagagaguagauuuuaagaguucccaucacacauugauggccaguugauuucagacaaaagugcaagaauacacaaugggaaaaggauagucucuuuaaugaauuauguuuggaaaacugguuauccacaugcagaagaaugaaauagcacccugauaucagaccacaugauuuccauauggaaaaaucaacucaaaaugaguuaaagauuuaacaugaauccugaaguuguaaaacuacuagaaaaaaauaggaaaaacuacacaacauuggucugggcaaugauauuuuagauuuggccccaaaagcacaggcaacaaaaacaaaaauagacaagauuacaucaaacugaaaagcuucugcauaaaaaggaaacaacagaaugaagagacaucauacagauugggagaaaauauuuguaagccauuuauuuguuaaaggguuaguauuaaaauauauuaagaacucaacucuauagaaagaaaauaaauaauccaauuuaaaaaugggcaaggaaccugaauagacagacauuucucaaaagaagacauacagauagccaauaguuacaugagaaauugcugaauauuaagaaucauuagggaaaugcaaauuaaaaccacaaugaaaugucuucucacaccuaugagaauggcuauucucaaaaagacaaaagauaacaaauguuggugaugauguggacaagggggacccuuguacacuguuggugagaauguaaauuaguacagccauuauggaaaacaauauggaaguuccucaaaaaauuaaaaauagaauuaccaugugauccagcaaucccacuucuggguauuuauacaaaagacuggaaaucaguaugucaaaaagaugccugcacucccauguucauuacagcacuauucacaauagccaaguguauuuaucuguucucgcugcuauaaagaaauauuggagacuggauaauuuauaaggaaaagagguuuaauugagucacaguuccacauggcuagggaggccucaggaaacuuauaaucauggcagaaggcaccucuucauaggguggcaggagagagaaugagugccagcaggggaaaugccagacacuuauaaaaccaucagaucucaugaaaaacugucacgagaacagcguaggggaaaccaccccuaugauucaguuaccucccaccagcucgcugccaugacacuuggggauuauggagauuacaauucaagaugaaauuugaguggggacauagccaaaccauauaauuuuaccacuggccccucccaaaucucaugcccucagacuugaugccuucccaacagucuuccaaagucuuaacucauuccagcauuaacccaaaaguccaaaaucucaacugagauaaggcaagucccuuccaccuaugagccuguaaaaucaaaagcaaguuaguuacuuccuagauacaaugugaguacaggcauuggguaaauacaccuguuccaaaugggauaaauuggccagaacaaaggagcugcaggccccaugcaagucugaaauccaguagggcagucauuaaaccuuaaaguuccaaaaugauuuccuaugacucugucucauauccagaucgugcugaugcaagaggugggcucccauguccuugagcagcuccaccccuguggcuuugcagaguacagcccccuucccagaugcugucacuagcuggcguugagugucuguggcuuuuccagacacagugcaagcuguugaugggucuaccauucugggggcuggaggacaguggcccucuucucacagcuccacuaggcagugccccaguggggacccugugugagggcuccagccccacauuucccuucugcacugcccuagcagaguuucuccaugaggccuccacaccugcagcaaacuucugccuggacuuccaggcauuuccauacauucucugaaauccagucagagguucccaaaccucaauucuugacuucugugcacccacaggcucaacacuacauggaaaccaccaaggccuggggcuugcacccucugaagcaauggccugagcuguacuuugaccccuuuuagccauggcuggagcugaagcagcugagacgcagggcacuauguccccaggcugcauagagcagggggccccugggccuggcccaggaaaccauuuuucccuccuaggccuccaggccugugaugggaggggcugcugugaagguaucugacaugcccuggagacauuuuccccauugucuuuuggugguuaacauuuggcuccuuguuacuuaugcaaauuccugcagccggcuugaauuucuccucagagaauggguuuucuuuucugucacaucaucaggcuacauauuuuccaaacucuuacgcucugcuaccucuugaaugcuuugcugcuuagaaauuucuucugccagguacccuaaaucgugucucucgaguucuaguuccacagaucucuagggcaggggcaaaaugccaccaaucucuuugcuaaagcauagcaagagugaccuuuacuccaguucucaacagguuccucaaaucugcaucugagaccaccucagccuggacuucauuguccauaucacuaucagcauuuuggucaaagccguucaacaagucucuaggaaguuccaaacuuucccacaucuuuuugucuucugagcccuccaagucucuaggaaguuccaaacuuucccacauuucccugucuucuucuaaguccuccaaacuguuuaaaccucugccuguuaaccagugccaaagucgcuuccacauuuucagcuauccuuagaguagcaccccacucccaguaccaauguacuagauuaaucuguucuuacacugcuuugaagaaauacccaagauggauuaauuuauaaagaaaagagguuuaauugacucaguuccacauggcuagggaaggcuucaggaaacucacaaucauggcagaaggcgccucuucacaggguggcaggagagagaaagugccagcagggagaugccagacgcuuaaaaaaccaucagaucuccugagaacucacucacuaucaugggaacagcaugggggaaacugcccccaugauucaguuaccuaccaccgggucacugccaugacacauggggauuacaauucaagaugagauuuggguggggacacagccagcccauaucaccaaguuguagaaucaaccuaacuguuuaucagcagaugaauggauaaagcacaugugauacauauacacacaauggaauacuauucagcuuuaaaaaagcaaaugugcaaauucugucauuugagacaacauggauggaacugcagagaguagaauggugguucccagaagcugcaggguggggaaaaaggggagaugaugguuaaaggauacagagccucagagaagaggaaaacuuucuuuuuucuaguucuauugcacagcauagugaauauaguuuaucguguaugguaccuuccaaaaucgcugaguaaaauuucaauguucucaccacaaaaauaaguauuugaggugauggauauguuaauuagcaugauuaaauuauucuacauguauucauaaaucauaacaucacuuuauaccuauaaauuuauacagcuguaauuugucaguuuacaaagauaaguaugugagguaaugccuauauuuauuuagcgauuccacauuguguacauauaucaaaauaucauguuguacaccauaaauacaguuuuuuuuuaaguaucccaccgacuauuuuuaguuuuucuuuuuuaauccaaugacauaagcacaguuuccuaaaaugggaacugacccucuccuacaaaacauuucauuaugguuauaucuucaugacaugaaaacaacuaguugaaaagugaugacuuuuuuagucuauuaccugacuguucaguaagaauugguuugacuacuuuuuucaccccacauugaauuugguucacuaguuuaguggucccucccccaugucauccccacccaguauguguauuauguuguauuuuggggaagauacaaagagaaaaauugcuuugcuguuaauugaauuugggcaagcuacuuaaucucugccuucucacuuccugcuaugaaauagagcugauuauagaaagauggcugucucaugcggcuaagagaguauagccaucucauggguuaaaugagguaacauguaaagcaccuggcacaaaaccaggaccuaaauaaacguguuuuuccuagcucuguggccacacuuaccuuuuugguuccuccuuucucugcccucucugccaugagaccuuugcauguucuguucucacuaccugaagagcucuuccuuucaucuuugccuuuuucuggcuaccaguuacccuuucagccuuuagauugcucaagcuuguuuccucagguccaguccuagaccucuaggcuuauaacugggauaccagccuucagaggaguuugugguuuacuggcuuauaguaauguaaugugaugcuucaucucacucugccuccccaacuagaaagucagcuccuucagggggaaggcugauuuuacucaccaccaccuucccagcacccagugcuguuuuuguugaaacaguaaaggauaugcgaaugcuaugggaggaguaaaccaguuuuugaguuuuuugcuugcuauaccagccuuaguugugagauggagccccuuggucaaaacaaaucaccaccugcacucuggucuucucacuuaacaggggagaauugccacaguugucuucuguggucccgggcaacucuguucuuugccucuuuguuuccauaaagaugaagcccauccagaaaagguacucaugcuggcugggagagguggcauggggaaggggauggacagagcaauuuggaagaucagagaggccucugccccuacgaagggccaugcuugccaccagucuuccugcuguguggugcucccaucgcacaggcugcuucuggagaugcucggguuguucaggcccuguggcuuuuggcaaggcaggagcaucugugcuucugcugacauaaaagaggguaauaaaagugacacaggaaagcgguguugugaggcuuuagugaugguggagcaguguugcugaagucccucagggaguuuggauuugauugcagugagucuggcuacaucugaagccuauaauaguuuacaguacaagaugcuauguauaagaugucaaacauuugcuugguagaaugcuaugauugucaggaguuuacuuuugcacugaaaauagucuuguugguuugguguaaguagagucacauugcagcacacacacaggcauucaugcuuuuauguuuguuaauuguaaggaaauguuuucucaaggcaagagucaaagguuagcagagugccaaagaccuucucaaagaggaaagucucauuuuagaaacuucauuuuguacgccaaaacuugccuuucaguagucucauguaauguuuuugcugacaugaguugaaaagugcauucuguuguaaaggaggaaaaaaacugaagaggaaccguaagcgugauuaugaagaagagaaaagagcaggaagaaaguagacaucaucccagauuuaaauuucauauuguuaaaaucauuugguugcaagcaguagaaauuuucuauaacuaacuuagauaaacaaggacuuguuggacaccugcuguccaacauucacaaaaccuaaagaagaaaacugaacuagaucuaguguggcuagggauuucagggacaggaauuaacaaaucuccugaggaggcugccaucaaaaugacuguguuaacuguuguccauccugguguauucuacucacauuucagacuccugcgagaggcugauugaccugguuugaaucucgugccuacccacucguagucccuccagaccccagggggugagcgaaggguguuugccugaaggaagaguggaacaggagcugggcagggaaaaaagaacagauguucauucuacuggccacauagccacagucagugguaaugauuuucccuggccagacuugguggccaguaguuacuagucuccuuucucuucagaaacaucugcucuugucagaguuauagccuauucuugaugagcugcagcaaaaauguaccacuuaaauuggagauggaucauuuccugaggaucucagaauaucuuuuucaguuagcuuuauaaaguaauuguccagauggccauuuaauuugugauaugggauaaaguaaucuaggggaaaaaacacuucuuuaaaaugacuuuuuuuuuuugggggggccgggcacacuggcuuacaccuguaaucccagcacuuugcgaggccaagcuggguggaucaccuggggucaggaguucgagagcagccuggccaacauggcaaaaccccgucucuacuaaaaaauaaaaaaaaaaaaaagcugggugugguggcaggcaccuguaaucccagcuacuugggaggcugaggcaggagaauugcuuaaacccuggagguggagguugcagugagcugagauugugccacuguacuccagccugggugacagagugagacuccaucucaaaaaaauaaaauaaaaugacuuuuuuuaaauugugaagaauauagguuaagauuauauugcaguaguaacguaauaauauauucaggauaaaaaauugaaguuagaucugaaauaucaacauccuaaacuaagaaaaaccuuuuaaauuaauguacucuuguuuuuuucuucuuagcuaauaguaaauaacgauagacucacacucccaggaagggugaggaagggacaauucagaccucucuagacuccaugcauggccugguuaaaucacuuuuuuuuaucagcaucucauuuuuccuuccagcaaguuuauauccucauugaggaagagugucuugccagaagauuauugugauaauuuuuauaagauauguauauucuuuucugaaucucagaguaaauauucuuugucuuccuaaaugaacugguagaauguuuacauuuucauucuauuucuguagaauuuuuuuuuuuuuaauugaaacagagucuugcucuguugcccaggcuggagugcaguggcgcgaucucggcucacugcaaccucugccucccggguuccagugauucuccugccucagccucccuaguagcugggacuacagguguguaccaccacgccuggcuaauuuguguguuuuuuaguagagacaggguuucaccguauuggccaggcuggucucgaaaugcugaccucgugauccaccugccucagccucccgaagugcugggauuacagacaucagccaccgcacccagccauuuccguagaauuuauagccucccuguugcagugagcugagauugugccacugcacuccagccugggcgacagagugagacucugucuccaaaaaaaaaaaaaaaaaagaauuuauacccucccuauuucuucucucccacuucugccuucucuuccacuucugccuucuccccuuguuccucauaguccuugggcaugugcuacuucagcagagaccuggguccucuuuugugaaauucagucaacaaaaagcucaaggaacaaguuaagacugaagacugaucgaguucauguaagugugguaggauugcauggugccauuugauauuaaaaggcauguauuguuuaagaaacuaaacaaaagccaacuguguuugaacaacaauguuugucagugagcuagcuagauauggaggauaaagauauguauaguguguuccagccacagacuagauugugaaaaagagaaccagcaaaaaaaaaaaaacccgcaaaacaaaaaacccugcaacuuaaucucagaguucucuccuguaauagacaguaauacauuuauaguuagaaaacuucaauuugguuuggcaauaucccaacuauagaacuucaaauaacugauauauauacccagacacaaaacuuuuuaucaacugaauagccaguuguggauuuugagcaauaaauggggggggggggggaacuacuuuaaaaacauuaagccaugaguuuauucaaucuguaucuuugucuucuaguaaguaaauuugcuuucauuguuaaacagcagcaacaaagggacaccaaagaucuuugcauaccuuacuugguuguaaacuuuuugaagucaaagguaauuuuucuaacuucuuugcaguagcuaaaacuuacauagcagccucuuuaagcagggaaaauuauuguaaagaaauugcucuuagauaacuuuccacucaaggguuuuaagcuuuuuguuuuguuuguaaaaucuuuuacgaugagcacuuuguaagucuacuaguuagcucaaagcaguucuccuugaggacccacaucuacuccaggcugggagacagagcgagacaccaucacuuaaaaaaaaaaaaaaagauaauaaauauagagggaaaugaauugugaugcgggcguaaaagugcugucugcaucggcucccuucuauuacugcuuccuaaaguuguugugaggauuaaaugaguuaauguagguaagcauucagaacagugccuggcacauaagugcuauggauguguuaacuguuauuauuguuaagaacgaucuaaacacaguggucaggaauggcaaagucaagaguucugauaggauacuaugguuauuuagacucaaaagcaaagcugccaaaauccagcugaccuuccuuuugauauuuagaggaaauucuguuaccuaagacugauauuucauuauagccacucaacaaauguucauuuguacauucuauguguugggcacugugccagguacugggggagcuacagagacaugacauaaauaucaccaugaggugcuuaaaauuuaauuggaaaguuaauaagaacaaaaauaacuauaguaaaaggccaguaugcuaaguacaauaauaaaggugcagauaauguaagugagcacucagaagagggagagcuuacuuucaguuaggaaaaucucgagggccgggcacaauggcucaugccuguaauuccagcucuuugggaggcagauugcuugacuccaggaguuaagaccagccugcacaacauggggaaaccugucuccacaaaaaauacaaaaauuagcuaggugugguggcacaugccuguagccucagcuucucgggugggugaagugggaggaucaacugagccugggagguugaggcuacagugagcugcaaccaugccacugcacuucuagccugggcaacagagugagaccuugccucaaaaaaaaaaaaaaaaagaaaaaagaaaaaaaaaaaaacaauccuggaggaaacagugcuugaccuaggucugaguggauguggcauugauagauggacaaacgaaaaacagacaaugcuuuuuaucaguaucauuggaggacacaacaugaacaguggugagggggaaggaaaugggucuaugcucaaaagaagguccaagccaaccaucuuuauuauuugcacauaaccuguuauaaaaugauacugcucguguucauaacaguggaccguaaccaucuguugagcaugaugcuguugccaagcguuguuguucaagguguuucauccuuguucuuacauuccauacaauaaccauaugaguuaaguguuauuuuagcuauuuuagagaugaaaaaagagcuacacagaagaugacugugccacaauuucagcacagaacugguuggcguaaaagccucuguuucuuucugauauuccugggugcugcuuggagaucacaaguauuugauugacagauauuagacacauaugcuaucaucuugagaauagaaauggauacaaauuaggauauucuucauucuugcuucuguauuuucaacaaacagguuuucugccucuaguguuuccuggaaacaccaaauaaaaacauauuuuugucuuugaccaagagugugcuucugaaaaacuugcucagugagcaugcaaucaguacagcauuggguguucuggagggaacauucauucuggcuguaguggcuugaggacccauaucuacaagcuuugacccgcucccuuuucugugccagguaaauagucuuaucuauauaaaucaaauuugaacucuuagaaugaaacucagggucuucugugcccugacuccccucgcuuacugaguuucuuuuuuuuuuugagacaaggucuugcucugucacccaggcuggagugcaguggugcagucuuugcucauugcagacuccgccuccuggguucaagcgauucucccaccucagcaucccaauuagcugggacuacaggugugcgccaccacgccuggcuaauuuuuuguauuuuuuaguagaugugggguuuugccauguuggccaggcuggucuugaaccuccuggccucaagugauccaccugccuuagccucccaaaguguugggauuauaggcgugagccacugugccuggcccugaguuuauuuucaaaucuguaaaauggcaguaaguguacuucuauaaaguauauggaauacuugauaaaguauucacugcuuuauaaauacaugauaaaguauucacugcuuuauaaauacuguuuuuauaaucauagucuugugagacaguuacaugcucagagguuucuuuauaaauacguaggggucuuuguuccuacacuugaguggcuucagauggcuuauauuagcuuuugucuccuuuuuggugacagacucaacuguugugucuuuguauuggcauuaugccucccucuaauagcccacuccucccucaauuugcugcuuuuaaucagcagucaacuaggaaaccacauaauagaacuuguuagcagugugucuaaaauuaaagucauuuuguucuuuucuuuuacaggagaugauuuuuuuaaaaaaaucugaauuuguuuaaaacuuuuauauauuuuuuaaaaucuugauagccuuuuaaaaauuguaggaguuaauaaugcacgcacuuaauauuuuaaguaaugcaaaaguguauaaaaaaauaaguaugcguuccucccucccuuugucuucccaauaccucccuagaaauaaucacuguuagcuggugugacuguacaaaaaaggcauacacauaauauuguacaacuugcuuuuuugacugaacuaugaauuacugauuuuuuguguuaauacauuuuugguuaucuauugauacauagcagaaccccagaacuaagugguuuaaaacuacgcuuauuaucucaugguuccuaugugucaggaguuuagaaguagcuuagcuggggucagaucugagguugcagucaugaaggcuuaacuggggauagagaauuuucuuccaguguggcuugcucacauggcuggcuauuggcagacagccucaguucucuauaugagguuccccauagggcugccugaguaucuucacagcaucaugccaggcuucccuaaaagggaguggacuuuaaagggagcugggagggagcuauccuuauuaugaccuagccucagaagucguauagcaucauuucauucugcccuguucucagaagagagucugguuagguccacccacaagagaaguggaaugaggcuucacuuuuugaaggggggcuuaucaaagaauuuaugggcauauuuuaaaaccaccacaguauguauagcuguaucucauucauuugcauguuugcacuguguuacauaguagggauauaccguaauuuuuccuuagccaugcccccauuugugguuauuuuuacucuucuaaacagugcugcagugaacauaaauacacaccuuuagcagcuugagcuaggauuuagcuagauucuuagaagugggauugucgagucaguagguguuggguucugagggccugagagguagcucuccuguaacuaaaaaaccucaauguguacuaacauguuuuaucuuucagcucuguucuggguagauuguucagaaagguauuggaguuaaucauugcaugaugccagacucauggaaacauaaaacaucuuaaaacauagcucuuaggauaaaaauuuuaaauacugugagaaaugaaugaaauagagcuaaagaugucaacaugagugaaauucauaaacauaauauugagugcaaaaagcaaauacauuuugcaugaugcuauuuauauaaaauuuuaauguaugaaaagcacgguauuauguugcuuagaaauagauuggugugaaguaaaaauaaagagaaaugugugagaaugauaaacccagaauucaagauagugguuauucugaaagggaugcaguugaggaggggcacacuuuuuggggauuuccuaauuggcagaaugaugagaacacagauguuuguguuauucucuucacuuuuuuuuuccuuuuauuuggagauggaguguugcucugucaaccaggcuggagugcagugacacaaucucggcucacugcaaccucccccugccagguucaagcgauucuccugccucagccucccgaguaacugggauuacaggcgugugccaccacaccuggcuaauuuuguauucuuuaguagagacaagguuucgucauguuggccaggcugaucucaaacuccugaccucaagugauccaccugccuuggccucccacuguguugggguuacaggcaugagccaccacacucggccauucuuuccaccuuuaccaucaacauuagugaugaaguguguacacuguauugauugaugaugauucuagugcagugaagauagugguaaaauuaaugccuaaucaauauguacaguuaauaucaaauacgccagacucuagaauucagguagauuuuuguuaagaaacacuaaacuaaugacaagagcaccaggcucagagcagcucaaagaccuaaguuaaagugucuucacugccaccuccaacagcacuucagggcauuuauuuaaccuucugggucaguuuucucaucugcaaauugggaggagcaaacccaucucccauugauguucuacagaucaugcgaaauuuuuuaaaaauuaaaaauaugaaaagcaucuagcauggugacugcacacagcauauguucaauauuugcuuccuccuuccccagauuacugccaucuucaguuugguaccauuacuaacauuaaacaauauguguuuuuaguaacuggcgaaguuuccauuuuuccuuugucuugcaagaaaacauguucaguauuaaauauuaaauuuucuagugccuuuacacaaugaauuaaaauuauuuacuaguauacuaaacuguacaguugucaucucuagggauuucuuuugugcugacauucgagcagacaguuuuuuuuuuugcugacugaauaucucuuuguuguggugcuuugagcuuguuaaugaccaaauucuuauguggcagcugcacauuacacaugcuuauuccccguguuuagaccauaaaucuucuguaacugagugacagcaccaccugcacagccuuucaggguugcaaauacagcucuaauaauguuauuucaaaauauuccagauguguuuuuucacacauuuuagucccgcugugacaauaaaaugauauuuuagaguaugagaaguuguuguuguuauuauuucauguggauuuuauaauggagacagacugauaguaugucuuguaugcagguuuauagaacauggcauaucaagaguauuugguacauacccaguggagguuuauaaaauacuuggaguaauucugagcuuguuuauguuguuauuuuucugccuaaagucuguuuauccccuaguuuuuuuguuguuguuuucuuucgagauggagucuugcucugucacccaggccggagugcaguggcaccaucuugacucacugcaaccuccgccuccugaguucaagcaauucuugugccucaaccuccagaguagcugggaucacaggcaugcaccaccccaccuggguaauuuuuguauuuuugcagagacaggguuucaccauguuggccaggcugguuuugaacuccugaccucaagugacccacccgccuuggccucccaaagugagccaccaggcccgguggcccccuaguuuuaucauucuuagucagcaauguguuaaagguuaacaguggaacauugacacauucacucaucuguccuaaccaaagcuucuugacuuugugauacugcuccuugugacuggcagccuaauagugaugaagugcagggacuccuuagccaaccugaggaagucuaaaucuuggcuccuccccuuacuaguuugugacccuaggcaaguuacucaaccucuuugugccuuaguuucaucuguaaaauggggaugacaauaacaucugccuccuaggguuaugaaaauuacaaauguuuauaaaauacuuagaacagcguucggugcagaaugagcacuguugaaguauucuuugaauacugcugggacagacagauaccuauagagcacacagggcucagcuuuugugagcucauuccaggucagaucuaugccuagacaguaaaagacauuugcuguucucuuagucacguuaguaauacaaacugauaagaauagugaggaauauaaaacauuaacaaugaugcuuucccuuuggccaaaccuaaccagaagccuuggggggcaagggagccugucagugcagucuguaagugucaccucucagggcagagagcaggcuggaugaggauggggaagggaucuggagaugcaaauaguuucuaagacagagugucuuaacuccuauauaauucauguuugugcauauuuuuauauaaaaaccauucuuccccauugccuuccaguauacuuucuaaguuucuacagaacgaaauuuggccucagcauguaacuggaagggaauauaaaaguucugaguugcuuacaguguauuuccuggauuaauauuucaaggcuuaaaacaagggagaagcaguucauuuucugccuaauccauaaaagccauuccaagcaugggagaaauguugaagagcugauggauagaauugauaaugcugccuugcagcuagaaaugcaggcagaacuacccaccccaucuuaauaccucuaauccacacuaauaauuuguguuccuaaauagaaaaauugaauucuccuuuuagauuaaauaaaucuguuccuuauucagccaucucauuauucuucuaauagagaccuauugagcucacuuuacuauuuaugucuucaaggguauaaugcuaguguggaauauacugacuuuuaaaaguaguuuaaaaaaugcuuuuaaaaagccauugucuaacagacuggacacgcaguugcccuggggaguuuagguagcugagagcugaugaaggaggagacuuucuaguucucuuggugauuucuugcuagaguaccauuuaaaacuccuucuggagguuugugaaggaaccuuucuugccucacaccauuggauuaauuucauguccaggcagguauacaagguacaugauuaacccugguuugacaauugauguugauagcuaaaaguacuuauucaggauaugaggaaacaugaauaaggauugaaauuaaauauggaugaaugaaugaaugaacguuuuuaguacaacguguaccuuaauuuuuagaauaguaaacaugaaaagccauaaacuugaaugcaugcacuuuuuguuuuucuuuuauuuuaggcucgaggguacaugugcagauuuguuacauggguaaaucaugugugacggguuugguguacagauuauuucaucacgcagguaaugagcguaguacucaauagguaguuuuuccauccucauccuccucccugguccuacccucaggcagguguugguguguuauucuucccuucuuaguguccauuguguacucauuguuuagcucucacuuauaauugagaacaugcaguauuugauuuucuguuucuguguuaauuugcuuaggauaaugccuuccagcugcauccguguugcugcaaaggaugugauuucauuccuuuuuauggcuguguaguauuccaugguguauauuauuaauaccacauuuucuuuauccaguccgccacuguuggguaucuagguugauuccaugucuuugcuauugugaauagugcugcaguuaacguaugugugcaugugucuuuauaaugauuuauauuuuggguauauacccaguaaugggauugcuaggucaaaugguaguucuauuguaaguucuuugugaaaucuucaaacugcuuuccacaguggcugaacuaauuuacauucccaccagcgguguauaagcauuccuuuuucuccauggccuugccaguaucuguuauuuuuuuauuuuuuaccauucugacuggugugagaugcuuucucacugugguuugauuugcauuucucuaauaauuauguugagcauuuuuuuaauaugcuuguuggcugcauguguauguuuucuuuugggaagugucuguucauauccuuucaauaaggguuguuuuuugccuguucauuuaaguuucuuauagauucuagauauuagaccuuugucagaugcauaauuugcaaauauuuucucccauucuauagguuuucuguuuacuuuguugauaguuucuuuugcaguacagaagcucuuuaauuagguugcacuuuucaacuuuagcuuuuguugcaguugccuuuggugucucugucaugaaagcuuugacagggcuaauggccagaaugguguuuccuagguuuucuucuaggguuuuauuuuuuuuuucugcuucccucccuuccugucuucuaggguuuuuauaguuuuagguuuuacauuuaagucuuuuuaauucaucuugaguugauuuucauauauggugaaaggaagggguccaguuucaaucuccugcuuauggcuagccaguuaucccaguaccauuuauugaauagggagucccuuccccauugcacuuuuuuuuuuuaaacuuuaucaaagaucagauggcuguaguugugaggcuuuauuucuggguuaucuaaccuguuccauuguuccguguaucaguuucuguaccgauaccaugcuguuuugguuacuguagucuuguaguauaguuuaaagucagguagcaugaugacucuagcuuuguucuuuuugcuuaggauugcuuuggcuaguugggcucucuuuuggauccauaugaauuuuagaagagcuuuuuuccacuuacggugguuugauaucaauagcacugaaucuguaaauugcuuugggcaguauggccaucuuaauaauauugauucuuucucuccaugagcaaggaaugguuuucuauuuguguuauaucugauuucuuugagcaguguuucauaauucucguuguagagaucuuucaccucccugguuaacuguauuccuagguauuuguauguuuguggugggggaagggagugcugcugugaaugggauugcauucuugauuuggcucucagcuugggcauuauugguguauagaaauguuacugauuucuguacauugauuuugcaucccgaaacuuugcugaaauuguuaaucagaucuaggagcccuugggcagagacugggguuuucuaguuagagaaucaucaucugcaaagagagaguuugacuuucucuugguuaccuguuaugacuuuuucuugguuuccuguuauuucuuucucuugucugacugccuaggacuuccaguacugucuugaauaggaguggugagagugggcauuuuugucuuguucugguucucaaagggagugcuuccagcuuuuggccacucaguaugauguuagccguagguuugucauagauggaucuuauuauuuugagguauguuucuuuaauaccuagauuguugaggguuuuuaacauaaagggauuuugaauuuuauuaaaagccuuuucuuuguuuacugagaugaucgugguuuuuuuaguucacauuaugugauaaaucacguuuauugauuugccuauguuuaaccaaccuugcaucccaagaauaaagccuacuugaucaugguggauuagcuuuuugaugugcugguggaucaguuugcuaguauuuucuugaggauuuuuguaucuauguuuaucagggauauuggccugaaguuuucuuuuuuuguugugucuuugccagguuuugguaucagaauguugcuagccuuauagaaugagcuaggguagaaucucuucuuaauuuuuuggaauaauuuuauauuuuauuaauauaugucugguagaacuugacugugaaucggucugguccaaggcuuuuccugauugguagauuuuuuuuuauuacugauuuuaugucagaacucauuauugaucuguucaggguuucaguuucuucuugguucagucuugggagguuguguguuucugagaauuuauccauuucuucuuccaggcuuuccaguuuguauacguagugguguucauaauagucucugaggguuuuuuguauuucuguaggguuggugguaauguuuccuuuaucauuucugauuguguuuauuuggcucuucucucuuuuuucuuuauuagucuagcuggagucugucaaucuuauuuauucuuucaaauaaccaacuuuugggcugggcauggugccucacaccuuguaaucccaacacuuugggaggccagggugaguggaucaccugaggucgggaguuugacaccagccuggccaacaugguaaaacucugucucuacuaaaaauacaaaaauuagcugggugugguggcacauaccuguagucccagguacuugggaggccgaggcaggagaaucacuggaacccagaagguggaaguugcagugagcugagacugcaccauugcacuccagccugggcaacagagcaagacuccaucucaaaaauaaugaugauaauaauaauaauaauaauaacaaccaccaacuuuugguuucauugaucuuuuguauguuuuuucacaucucaauuucauugaguucagcucugauuuugguuauuucuuuucuucugcuaggacugggguugguuuacuuuuguuuuucuaguuccccuagguguaaaguuagguuguuaauuugaggucuuucuaacauuuucaugugggcauuuagagcuguaaacuuuccucuuaacacugcuuuagccaugucucacagauucugauauguuguggcuuuguuuucauuaguuucaaagaauuuuuuuauuucugccuuaauuucauuguuuaccccaaaguuaguaaugagcagauuguuuaauuuccuuuaagagaucuuccugguacugauuuaaauuuuuaugcuguggucugagggugugguugguaugauuuugagaaucguaauuuguugagaauugcuuuauggcugagcauuugguaugugucaugugcaguuuuagaguaugugccuugugcagaugaggagaauguauauucuguuguuggguggagugcucuguagauaucuguuagauccauuuggucaaguguugaguucaggucccaaauaucuuuguuaguuuucugcuucagugaucugucuaauacugucagugggguuuugaaguccgccacuauugugugguuaucuuaagagucuauaggucucugagaacuuguuuuaugaaucuggguucuccaguguugaguguauauuuauaugggauaguuaaguugucuuguugagguaacccuguaucauuauguaaugcccuucuugguccuuuuugauuguuauugguuuaaaguuugucugaaauaagaauagcaaccucuguuguuuuuugauuuacauuugcuugauuuuucuuuaucccuuuauuuugagcccgugggugucauugcaggugagacuggucucuugaagcuagcuuacgauuagguuuugcuucuuuauccaauuugccauucuguaccuuuuaaguggagcaucuaguugguuuacauucaagguuaacauugauauguguggaugugauccuguuacuguguuguuaacugguuucuauguaaacuugguuguguaguugcuuuguagugucauuggucuguguacauaaguguguucuugugguggcuuguaauagcccuuuauuuccauguuuaucccucucuuaaggaccucuucuaaggcaagucuggugguaauggauucccuuagugcuugcuugucugaaaugaauuuuauuuuuccuuugcucaugaaguuuagcuuagcuagauacgacauucuugguugaaauuucucuucuuuaagggugccgaauauaggcccccaaucucuucuggcuuagaggguuucugcagaaaggucugcuguuagccugaugggguucccucuguaaguuaccugccccuucucucugucuuuaguauuuuuccuuuuguguuggccuuggagaaucugaugacuauaugucuuggggaugguugucuuguaugguaucuugcaggaguuuucugaguuuccugaauuugaaaguugaccucuuuagugaguuuggggaaauuuucauggacaguauccucaaauauguuuuccagauugcuuguuuucucucccucucuuucagggaugccagugaguuguagguuuuugucucuuuacauaaucccauauuucuaggaaguuaucuucauuucuuuucauucuuuuuuguuucuuugucugacugaguugauugaaagaacuagucuuugagcucugagucucuuuccucagauuggucucuucuguuguuaauacuugaaauccuugucaugaauuuuucaacucuaucaaaucaguuagguucuuucuuaaaauugcuauuuuguguuucagcccuugugucauuuuacuggauuccuuagguuccauggauugggcuucaacuuuguccugaaucuugaucuuuguugcccuccagauucuuaauuccaugucugauguuuuaaccauuucagucucauuaagaaccauugcuggagaggcaguaugguucuuuggagguaagaagacacugcagcuuuuugaguugccagaguucuugcgcugguucuuucucagcugugugggcuuugaaguugcuguccuuugaggcuuuugcuuuuauauucuuugaugcccuugauuugacuguggcauaaguuggguucauuugacuggcuuuauuucagaaugcuuucagggggccaaggcuuagcucagcacuccggggcugugugcucuaacccuggaggucugggaccaggccuacagcuuuguuuucuggccccucgaaguuaagcaccugccgugcuggagggacuuagguguuccugguccacuggcaauaacauuccaaugugggggugccagcaaaagcacuuugccaggacgguggcagcaggguccauguguaugugccaguggugaugggguggugggguccgugcacauguacaccaguggugcaugcacuuuuaauuaaacuuaucuagcuagaggaaccaucucgagaugguuuccaacaguuuugacagagcaaguuuuuccaaguucuuucucuugguguggauuaacacauaccuuaauagaaacuucugaaguauaagucucacauuuaagaggaauacagccuucaaaaguucuuaaauuucucugaaauggaaacauuuguaugaguugcuggaagauggugugcauuuuuuaagcuuacucucacaucaaaaguucauuuuaccuuucuuuccaauauaugcauuuuugcuauaaaucucucuaagcauaacuugaguugcaucccacaaguuuuuaggucauagguuccuuaucaaaauauuuuuaaauuaauuuuuuuacuuuaucaauaauugagaaauauguuacuuauuuucucauccuuugggaauuagcgugugaagauuucuguaguuuuuagguacauugaagguaugugaagaagucagauuuguuaacauuguugagaaccugucauuuccuuaugaauuucuuggggucuguucuuuugcuuagagauguugacaaaaguccaacucuauaaaaaguaucuacuuuucuccaucaggucuaucguauuuuguuuuauauauuucucaucuuguauaugaaauauauuuuccuguuagauuaauccauuuaugagaugucuuuucuuuuuaaaaaauuucuagugauacuuuucaccuuaaagacuugcauaugauauuaauagaguuguuaucuuuuuuuucuggccaguaguuguauuguaaaauuucuuuucuuuacucuuacuuucaauacuuuuuagcauuucuauaucuuauauuuaaguuguauuacuuauaaacaguuaaauccagucucauaaucucugucuuuuaaauggccuguugauucuguuugcuuuuguuuuugaaauggaguuuugcacuguugcccaggcuggagugcaaugguacgaucucggcucacugcaaccuccgccuccuggguucaagugauucuccugccucagcuuccugaguagcugggauuacaggcaugcgccaccaugcccuaauuuuguauuuuuaguagagacaggguuucaccauguugggucaggcuggucuugaacucuugaccucagaugauucgccucccuugggccucccaaagugcugggauuacaggcaugagccaccgugccuggccucuauuugcuuuuaauauaccuuuaauaugauguauagacugguucuugaacaugaguagaauuucgcagagcugagaaugggugggaagcagcccaggcaccugaaguaacauaacaaagcaacagaaauaaaaaugaacugccugcuaggggauaggugguagauagaucuuccuccuggggcagaaggguaggcagcagagggcaacuggggccuugucuguaauggugaagaguucagacauaccuugggugccccccaacuguauaugcuccagacugugcuaggcacuugcacacguuuucccagaacugugucugacacuuugauagaaugaaaugaaaauauaagacaucguucuuacaauuaauucauuugaaaagauaaacaagaccugggaaaauacuguuucucuauaaucauacggcacuuccgacaccagauguguguuuuuuuuuuuucccaccucugccaguucucagacaucagcugaguguccuacaauccaauucaguucugacucuaucuacuaccuaucuggauuuagugucagaucccaccaguuaaggucucagcccacaagacugcccucaguuuagaugcuaauugcacguucagcucuuguacuccuaauuaacuauaaaucaggcuuucccauaacccccuccuuggguuagauaauuugcuagaauggcucccagaacucaaggaaacacuuuauuuacauuuauugguuuauuauagaggauauaacucaggagcagccaaauggaagagaugguuaggguaaggucuggguguggaggaauggugcgcagagcuucgauacgcucucugggaacaccgccgucucagcaccuccauguguucaccaacucagaagccccucagaucucaguacaggaguuuuuauagagcuuaauuucuagcuuucccaaagguugauggauggggcugaaacuuccaacccgcuaaucaccugguauuucuggugaggagcccauccugaggcuaucugugggcccuaugcuauggcaguugauuagccaaaaacucagguuugagcaaaaggggggguccucaugaauaaccaaagacgcucccaucauucaggaaaaucccaagggauuuuagaaacucugugccaggaaccagggacaaagaccaaauauauuuuguauuguaacacacaagauacauuaauuuuuaaaauaauaauaaaaguucagaaaaaugaacaguagguguucgauagaaaggaaauugccugaggaggaggugaaaaucaaacuggccccuggcauacauauuguaacuguguuguuuccuucuuguccuuacuagaccacccuccaugcugauaaggaucacgucucuucugugugugcagagccuccuagcauaguucucgguacagagaagguacuaaaccagccuauggaaagacaugagggaggagcaagcugucagccuaacaggggugugauaaggaggaauagcagagugaauucugcucccuggagagcaaggaugccaggaugagaggcuuggggaguuuugagcaggaacagagggaaaauaucagucuagccugaugcucuuguggcugugauucaugcuuuuuuuuuuuuuuuguaacuaacagggguuauuguggauugagucuguggaaacggaauggaaugggcaagaccuaugggaaaagcguaaggaagccuggacacugucuacagugccccgucaacuuugcccaucugguagucucauccccuaggaagccaggcugcuuuucucacccucucugcucagcuucuuugcaguucaauuccaguucugggaaugaacaggaucaccuuucaggcuauguuuccuuacacagaccugaacuaugucucgguuguuaguucucaucguccuuaagacaggucauuaucacuuuaacuggaagugccucuuucauuuauugccagaggaaacaaacauccuauuuauguucauagauauuaguggaaugaaugauaguuuaacuaaaaugugguaguaaauuuacugcagauauacuguaacuuauuggaaucccuaguuguuacuuuucugugaucauauacaauuguuuuucccuuuuuaaauuuuaguuuuugaguuuaaaaauucaggaauuuauaaaacauuuucagaaaauguacaguucuuuaucaugaugugacuuuuuuuaagcucaguuuucucuuagauuuuuuuuuuuuuugaaucuagauuuaucuaguuuguuuguuuguuugugacggagucuugcucugucacccaggcuggggagcaguagcgugaucucggcucacugcaaccucugccucccagguucaagcaauucuccugccucagccucccggauuacagacgcccgccaccaugcccagcuaauuuuuauauuuugaguagagacaagguuucaccauguuggccaggcuggucucgaauuccugacucgggugaucugcccgccugcccgccugggccucccaaagugcugggauuacagguaugagccaccacacccggccugucuagguuuuuuaaaagaucuuuuuuuuuuuaaucuagauuuucaauaguguggauuuuugaucuccagguaauuugaauucagaagaauguuuagaaugaaucuguugacuccgugcaaugaggaaaggccucuuugcuuucuaagcaaugaauguuucuggaauuacacugauauuuaguugaugggguaagguuguaaauucuauaggaaagagauucucaagguuuucauguuuuaaaaaauucccagaaccccauauaagaguucuuaaauuuacucaagcugcagaccauucuuagaaucacagaccccucaaaauaacuauggcaccagaaauuuaugguuuaugucuugaauagcuuaguacuuuugacaacuauacuaggaaaugaaaagcugcuacugucccauuuaaaaauaacugagauuuuuaaaaauuggauguguauuuucaacucugguuuaaguguguauuugaugcccugaugaaaacaaauugucauccuuaacuuugagauauuuagguuaaaggagaauaauauuauuaaauauuuaauaaauauuuuuggacucaagguuauaggaauaagguuaaguuauuucaacacagcagagauagucggaaugaauccagacuuugaggaguacuuuuacuugaaacuagaaaaauggacugcuucacaguguccuuggccuuguugcaauaugguggcugucugguauuaacagaaaaaggucugggccucacuuucuucuuuuuggguguuugcauugauaaaucaaaaauaucccaguaguguguucuuccauaagauguuacucggaugguaguuacgguaaccaugggagcucggauaucucacagugccuacuccucagccucccauagggaauuguacagugcagcucuguaggggaguuacauuuaaugaaauuaaugguuauaaagaauuaauugagcacuucucagggacugugggaaguacuuaacacagauuauaucagugaauucucccagacucuugugauagcccugauuuauagaccagaaaggguagugaaucucagagagauuaaguaacuugccuaagguacccaagcaaguaaauugcugagcugauccagagcuugagcuuauacucaccaugccuagguaacauuaccaggcuugguaaaaagaagagccagcaaauggaagcucuaauucuaaucacagaaaaauuaggaguaauaauuuuaccaccaaacaggaaugaagaacugauugggcuguuggaauauauuuuuuacagcagugccagacaucacucauagccacgugugcauucuuugucgucuuucacugugggcugaacacugcagcugcugggaaggaaggugcauggaugguguuauuacagcccuuugcuucauuuuuccuguaauuauguuaguugaaaccaggaguuaaauagagaaguucuuauaucucugauugacaucuauagauaaucucaacuuucauuaaaacaaguuuugugagugguuugacaaguauuuauggacuuacuucauaucauggugacuaguuucaaagaucugcaaaaggaaccagcucaauagaaucacuagugccaguuguaccguugcacagagacauauuuuuuauaaaugaaaaaaccuuugaagcugaguguauuaauuugcuugggcugcagaaacaaaguaccagaaacuggguggcuuaaacaacagaaauugauugucucacaguucgggaggcuggagucagaggugaagguguuuacaggguugcuuccuucugggggcuuugagagaaucuguuccaugccucuccucuggcuucuggcgguuuguggcaauccauggcauucccuggcuuguagagacaucaccaugaucucugucuucaucuucacaggguguucuuuguguguguuugugugucugucuccaacuuuucacuuuuaauaaggucaccaaccauaauggauaaauaagccuaaccuaaugacuuaaugaccuuuguaaagauucucucuccaaauaaggucacauucugaaguacugugaguuaggacuucaaaguaugaauuugggcaggguggagaggggaacaauucaacccuuaacacugagcauggacaacuguaugucacacacagccuuccccugguggcucuacccucccaacugcacuagcugagguguuauagauagaauguccaauucacugaauaaguucuauuuaguagggugcagcuccuguccagaauaauaccaaaauaauaaaacucuacagugauucaaaauugaaacuugucccuucugccagcccaggccuacuucgggcuuagaagccuugcaguggcaaagcuaauguuguugacuuccuuguuccaccucuucuccucacuucugcuguuugccacccuuauggaaucaggccuagagaggcuuaagggacaaaagcuguuugguugauggcugggauguuuucauuuggcacaggugcccucuggauggcagaugugugguucucauugguagguuccugggagauccuccugcuaagccucccccuucagcucuuggugcagugggccucuccuccagcuggcccuugcuuuuggugcuccacccccuacuggugaccucccccucucuaagcuguacucucuugggaagcuaucuuuuuuuuuuuuuuuuuugacggagccucgcucuguugcccaggcuggagugcaguggcgcaaucucagcucacugcaagcucugccucccagguucacgccauucuccugccucagccucccgaguagcugggacuacaggcgcccgccaccaugcccggcuaauuuuuuauauuuuugguagagacgggguuucacuguguuagccagugaucgaucuccugaccucgugaucuacccaccucagccucccaaagugccgggauuacaggugugagccacugcacucggccccaggaagcuaucuuuuuuaaggcaaucucaugucaguuaucuuccauggaguuugauuugguccaugggaaacaagaaccuuugcuguuaguggagguguggucuacucccagugcagccuuuuaaacuuagcugauggguagauagagcucagucacagugucucauguuuguuaaggcuugaaucaaauccuacugucuguguccauccaaguccaguagaugcuuguccagcucuucagguagugcccuagaagccuucccaggcugguguaagguggaggauggcauucuccucuuuacccccauagacagaggagggaguggacacccugcacacugacacccuccagcaacauaugcgccucagauucuucaaccuuagcuuaucggaggcuggaggagacugaguggcuaagaugggcagacuuagauaaagcuucaccccuugcaagucccacagggaugguccauucugcaucucuuugcagguguuaacugugccacuccuagaggugccagucagcauuucaacaguuaagggagagggaagaagaccagaguugggaugguaucauuugcagaggaaaacaagugacuauuuacuuauuacagaagaagauugggucauccaaugugaauuuggagagcauccuugcauuucauuuaugcuuaaaagcaucaggaaacacaguuuaaugcaaaauuuccuuuugccuguuuugucaauucauagaaaucgacaaagaaauugacauagaaauugacaaaauuuuuuguuucuuuagcacauuuggauugacuuagcggagaacuaaccuauuauagcuuccuauuuuggcccaugugacuuuguacaguaucuuugaagaauguuuuauuauaccagagggcagggggagggguguguguguguguugaauccgaaagcagcauuguguucauuguuuuauucugcgggaucauucuauucuaaagauaggauauaaacguugguucuuugcuguauuuaauuucauugcaauagaauccauucagcauuuuuaaauaaaaggugauuauuuuaauguuaaauucuauuacuuauaucucuauagaacauucagacuugaauaagaaaagauuaguucaaguucauuugaacuuagugcauuuguauuaccuacuuggauauuuauuauuuauuugccuauguaguauaaaagcguuaauuccuuuggccuuauuaagaaaauagaucaggccgggcacgguggcucacaccuguaaucccagcacuuugggaggcugaggcgggcagaucacaaggucaggagaucagaucgagaccauccuggcuaacaaggugaaaccccgucucuaauaaaaauacaaaaauuagccaggcgugguggugggcgccuguagucccagcuacucaggaggcugaggcaggagaauggcgugaaccugggaggcggagcuugcaaugagcugagaucacgccacugcacuccagccugggcaacagagcaagacucugucucaaaaaaaaaaagaaaaaagaaaauaggucauacucaguagaagagaucacagagacccaaaguugaagaaaguaguagaaauuccaguaguaaaacccgauaugcaaguaagcagcacuauuaaaaccaacuuguuuugacaguuaagucaaaaauaaauauagcuggggccgagcaugguggcuuagccuguaaucccagcacuuugggaggccaaggcaggcagaucaccugaggucaggaguucaagaccagccaggccaacauggcaaaaccccgucucuacuaaaaguacaaaaauuaggugggcuugguggugcaugccuguaaucccagcuacuaaggaggcugaggcaggagaauugcuugaaccugggaggcagagguuacagugagccgagaucgcaggcaccggcccuccagccugggggacagagcaagacuguuucaaaaauaguaauaacaauaauaaauacauauaggggccaggugcaggggcucacaccuguaguacuagcacuuugagaggcugaggugggcggaucaccugaugucaggaguuugaaacgagccuggccaacauggugaagcgcugucucuacuaaaaauacaaaaauuagccaggcgucguggcaugugccuguaaucccagcuacugaguaggcugaggcacgagaaucgcuugaacccagaaggcggagguugcccugagccgagaucaugccacugcacuccagccugggugacagaguaagacuuugucucuaaguuaaauaaauaaauaaauaucaaucugucugucuuucaagaauaaggccaaaauaguuguggaagauaggauaauauaugaaguaucacuuuugguacuugacaacaguggcggggcaaggaaccuaaggcauugguacugcucucacugggggaaaggagaaagcagguccagugguuaauucuguguaccuuaaguauguggacauauauaauaaaaugggaguauaaaggugucuuaguacauuuuguguugcuauaaaggaauaccugagacuagguaauugauaaagaaaauguuuauuuagcucaagguucugcaggcugggaaaguucugcaagcccugguuucuggggagggcuuuuauaaagcugugccacaacauggccgagaaggucaaaggggaaguggguaacugcaaagauagaaaacccgaggagcauccuggcuuuauaacaacccccuuucaugggaacucauuuccacaggaacugauccaguuuugccagaaugagaacucacucacuaccacgugaagggcaucaagccauuuaugagggaucugcccccaugauccagacaacucccacuaggccccaccucccaagaccgccacauuggagaucaaauuucaauaugaguuuugauagggacaaacaaaccaaauccaaaccauagcaguaggcaacauaggaaaccaaaaaaccugaaaauaaacuaugagacaggaaaugaauacagaaauauauuacaucauauuaaauggacaaagacauauuaaaagcuuucauucccuagacauuguauccuaauagguaccuauaguuguaaacguuaguuaaauugucguguuaaaaagaagaugcaguaugaaauaaaauuaacacagaaagguuugcuucugguuauaggccauauuuuaugcaaaaagaaggaaaccuuugcuggaugaaaacaaaaguaaucgaaguuuauuuuaaggaguauuggccgggcacgguggcucaugccugugaucccagcacuuggggaagcugaggcgagcagaucacuugaagucaggaguucaagaccagccuggccaacaugguaaaaccuugucucuacuaaaaauacaaaaauuagccagcaugguagcaggcaccuguaaucccagcuacucaggaggucaaggcaggagaaucacuuggacccaggaggcggagguugcauugagccgagaucuugacacugcacuucagccugggugacagagugaaacuccaucucaaaaaacaaaaaagaaguuaaggagcauuaacaagaucuguaccuauauguuucuguuuacauuauaccccccaaaaaagaaaaacucaguugcagguaugagcaaagguauuguuugaguuguguauuuuaaaucacuaauuuuucuuuucauacaaaauuggcuuuuggacuuguaaaacuuucacagauaguuuuagaacuguccuuccaacuaugggaaauuauuauuaccaguaugacagcuagccacauucugugaugguaucucacuuccuaaugcauagugggaaguuggcuuuacuuuuacaaaaaauaacucacuuggacuucccauucuaccaggaggguuagaaacaugcagcuacugauuuauuguccucaaagccccuuggaagguauagcagagaacuggaaauuuaaaaaccauuuuuauauucauuaguuuauccauccauucaacagauauuuguugaaagccuauuaugugauaugaaauacguugagauguucagacagagaugauuaagacaugucccugcacugagggaacucugucuucuggguuguuuuuuuuuuucuucauaucuuccccaaaauuucuaacuuuauauaaauuuagacuugguuucuguugagucuuuuacuaguuugagacauuuuauugcaguauagugcaaaguauuaaugggcuaaguauguuaaaugcugcuguauuuguaagaucucuugcuuugucugugaccaugaaagucucagugaaaugggaucuuauucccuaaaucauagcucugguuuuaauguuucuugauauuauugcagagacucuccaacaugugccuucugaccauacaaaugaaacuuccaacaguacugugaaaccaccaacuucaguugccucagacuccaguaauacaacggucaccaccaugaaaccuacagcggcaucuaauacaacaacaccagggauggucucaacaaauaugacuucuaccaccuuaaagucuacacccaaaacaacaaguguuucacagaacacaucucagauaucaacauccacaaugaccguaacccacaauaguucagugacaucugcugcuucaucaguaacaaguauguauuaaagcugaccuuuuuuuuccuaugcugcaaguaguuaaaugccacauuuaagucauuauucugucuggcaaaaauaauauagaaacuuuauaugccuagauuucccuuaauuccuaauuaaauguucuuaacacagaaaaucagagagcuuuaauuacaauguuaaaaaaaaaaaaauaacgcuaaagcccuuuuuuguuuucuuuuguucuagucacaacaacuaugcauucugaagcaaagaaaggaucaaaauuugauacugggagcuuuguuggugguauuguauuaacgcugggaguuuuaucuauucuuuacauuggaugcaaaauguauuacucaagaagaggcauucgguaucgaaccauguaaguuuugaauggccaggacuuuuuaaaaaaaauuguuggugcacaucuuuaauuaugauagaauaucaagccagugcucaucucagggaugaauaauugauagauuuaugaguuauauucccauuaacccuuuuggcccaaaguaaauuguuuauguacaagcuugugauuauaauuauuugcaaaugaaaauggauguauauacuuaaaaaaauguauuuuacuagugucaaacacacuuuacaggagaccaaaguuaaccuacccugaaauuuucacuuacucauaccaauaaucguaagaaauaccaguucccagcaggcuuuugacuuaguaugucugugucuguugugguacuaaauagcauccuugguaaaaccauggcuuuuguuuuccacgacaaagacaaaaaaaauuccucugacagccucauuaucccugaaaauuuaaaugagugguuaguauaaauaauauaauuuaucauuuuaccuguagcaaaacucucuuuuuagaugugcauuaucaacaagaccuaauccauguuuacucuacauguagcucuauaggucugaugguuugaggauauauccaaacuuuuguugcuccaauaguccuuuuuguuuuuguuuuuuugagucuuacguguugucuuaguucaugcugacacaacaaaguaucauacagcugggugccuuaaacagcagacauuuaguucucacacuuccggaggcuuggaaguccaagaucagggugccaccaugguugaguucuaguaagggccuucuucacauggcagaaagaaggcgagcuaguucucugaccucuaauuguaaggguauuaauucuguucacgaggguuccacccucacgaccuaacuaccuucccaaggccccacuucaaaauaucaucacacugggauuaggguuucaacauacucauauugggugacacaaauguaagagcuaauucacuuuuuuuaguguuaauguauauaaauaccauagaacagaugacuguuuuccaaaauuugcccuguggguuaacauuugacauacaugugucccacacacacaguuccuauaucaaaaagugugggaaauguucaguugacuaaaguaaacuaagacaguuuacuauaagacuucucuaagccuuuaaaauauugauauacauuaugauuuuccaggauggaauacaguaugaacuguuucccaaauuuuuaaccaaaauacuuguugaaugaauaaaucccucccccugccccucuucaaugggagcuaacacugucuaucucuuggaacuaguauuguguggaacacauuuugggaaauguuggaauaggccauuggaaucuuccaguuuugacacuacauaugauucaguacacauaaaaguaaaucaaacuucuugauagauuuuaagaacauggaaguuucccagauuuucagguuacugacauaagcucuaaauaaacaucgcaucauaaaugaaaauuggaucuaacaguuauauuacuaauacuuaaacaaaaaugauaauuuaagaacagauuuuuuuuuuuuuugagauggaguuucccucuuguugcccaggcuggagugcaauggcacgaucucggcucacugcaaccucugccuccuggguucaagcuauucuccugccucagccuccccaguagcugggauuauaggugccuaccaccacgcccagcuaauuuuuguauuuuugguagagaugggguuucaccauguuggccaggcuggucucaaacuccugaccuuaggugauccucccaccuuggccucccaaagugcugggauuacaggcgugagccaccauaucuggccuuaaaaacauauuuuuaaaaguuauauuuaaaguuacguugcauauauuuaucauaucaaacucacuuuagcuuccaugaucacaugagaucagacacauucacaguggcauggcuguaggcucaaacugauuuuaaaagaauauuaagguggugguuugucagauuaaaggcauauucagaaacauucuuuuuuaaggucaauacaugaaagaauacauaaaagaaaccaugacuaaacagagugcuuugcaguggcucugucacccagguuggagugcaguggugcgaucacgggucacugcaaccucagccuccugagcuuaagugauccucuuaccucagccugcugaguagcugggacuacaagcaugcaaugccacaccaggcuaauuuuuaaauguuuuauagagaugguagucucacuguuuugcccaggcuggucucaaacuccugggcucaagugauccuccuuucugaccuccuagaguucugggauuauaagcaugagccacugugaccagcuagaaagaaauauuuaauagggacuuacaaauagaagcuaugucugugucuaugauugcagcaagacaagaugguggauccccaugccauuaacccccagaucuuuaaccacuacaguauauuggauacuuaaggaacuuuacacagaacacugaccauuuugauugugcagcuugaaauuguucuaauccuacuuuacuaacaaauaggaacauaaguaguuuugacagaaaaaacaaaacaaaguaauuguaacuuuuaauauauuacagagaugaacaugaugccaucauuuaaggaaauccauggaccaaggauggaauacagauugaugcugcccuaucaauuaauuuugguuuauuaauaguuuaaaacaauauucucuuuuugaaaauaguauaaacaggccaugcauauaauguacaguguauuacguaaauauguaaagauucuucaagguaacaaggguuuggguuuugaaauaaacaucuggauccuuauagaccguucauacaaugguuuuagcaaguucauaguaagacaaacaaguccuaucuuuuuuuuuuuggcuggggugggggcauuggucacauaugaccaguaauugaaagacgucaucacugaaagacagaaugccaucugggcauacaaauaagaaguuugucacagcacucaggauuuuggguaucuuuuguagcucacauaaagaacuucagugcuuuucagagcuggauauaucuuaauuacuaaugccacacagaaauuauacaaucaaacuagaucugaagcauaauuuaagaaaaacaucaacauuuuuugugcuuuaaacuguaguaguuggucuagaaacaaaauacuccaagaaaaagaaaauuuucaaauaaaacccaaaauaauagcuuugcuuagcccuguuagggauccauuggagcauuaaggagcacauauuuuuauuaacuucuuuugagcuuucaauguugauguaauuuuuguucucuguguaauuuagguaaacugcaguguuuaacauaauaauguuuuaaagacuuaguugucaguauuaaauaauccuggcauuauagggaaaaaaccuccuagaaguuagauuauuugcuacugugagaauauugucaccacuggaaguuacuuuaguucauuuaauuuuaauuuuauauuuugugaauauuuuaagaacuguagagcugcuuucaauaucuagaaauuuuuaauugaguguaaacacaccuaacuuuaagaaaaagaaccgcuuguaugauuuucaaaagaacauuuagaauucuauagagucaaaacuauagcguaaugcuguguuuauuaagccagggauugugggacuucccccaggcaacuaaaccugcaggaugaaaaugcuauauuuucuuucaugcacugucgauauuacucagauuuggggaaaugacauuuuuauacuaaaacaaacaccaaaauauuuuagaauaaauucuuagaaaguuuugagaggaauuuuuagagaggacauuuccuccuuccugauuuggauauucccucaaaucccuccucuuacuccaugcugaaggagaaguacucucagaugcauuauguuaauggagagaaaaagcacaguauuguagagacaccaauauuagcuaauguauuuuggaguguuuuccauuuuacaguuuauauuccagcacucaaaacucagggucaaguuuuaacaaaagagguauguagucacaguaaauacuaagauggcauuucuaucucagagggccaaagugaaucacaccaguuucugaagguccuaaaaauagcucagauguccuaaugaacaugcaccuacauuuaauaggaguacaauaaaacuguugucagcuuuuguuuuacagagaacgcuagauauuaagaauuuugaaauggaucauuucuacuugcugugcauuuuaaccaauaaucugaugaauauagaaaaaaaugauccaaaauauggauaugauuggauguauguaacacauacauggaguauggaggaaauuuucugaaaaauacauuuagauuaguuuaguuugaaggagaggugggcugauggcugaguuguauguuacuaacuuggcccugacugguugugcaaccauugcuucauuucuuugcaaaauguaguuaagauauacuuuauucuaaugaaggccuuuuaaauuuguccacugcauucuugguauuucacuacuucaagucagucagaacuucguagaccgaccugaaguuucuuuuugaauacuuguuucuuuagcacuuugaagauagaaaaaccacuuuuuaaguacuaagucaucauuugccuugaaaguuuccucugcauuggguuugaaguaguuuaguuaugucuuuuucucuguauguaaguaguauaauuuguuacuuucaaauacccguacuuugaauguagguuuuuuuguuguuguuaucuauaaaaauugagggaaaugguuaugcaaaaaaauauuuugcuuuggaccauauuucuuaagcauaaaaaaaaugcucaguuuugcuugcauuccuugagaauguauuuaucugaagaucaaaacaaacaauccagauguauaaguacuaggcagaagccaauuuuaaaauuuccuugaauaauccaugaaaggaauaauucaaauacagauaaacagaguuggcaguauauuauagugauaauuuuguauuuucacaaaaaaaaaguuaaacucuucuuuucuuuuuauuauaaugaccagcuuuugguauuucauuguuaccaaguucuauuuuuagaauaaaauuguucuccuucuaaaaguuuuaa

SEQ ID NO: 192012 - RNA, 122963 nt, Homo sapiens
gccgccgccagggaaaagaaagggaggaaggaaggaacaagaaaaggaaauaaagagaaaggggaggcggggaaaggcaacgagcuguccggccuccgucaagggaguuggagggaaaaaguucucaggcgccgcagguccgagugccucgcagccccucccgaggcgcagccgccagaccaguggagccggggcgcagggcgggggcggaggcgccggggcgggggaugcggggccgcggcgcagccccccggcccugagagcgaggacagcgccgcccggcccgcagccgucgccgcuucuccaccucggcccguggagccggggcguccgggcguagcccucgcucgccugggucagggggugcgcgucgggggaggcagaagccauggaucccgggcagcagccgccgccucaaccggccccccagggccaagggcagccgccuucgcagcccccgcaggggcagggcccgccguccggacccgggcaaccggcacccgcggcgacccaggcggcgccgcaggcaccccccgccgggcaucagaucgugcacguccgcggggacucggagaccgaccuggaggcgcucuucaacgccgucaugaaccccaagacggccaacgugccccagaccgugcccaugaggcuccggaagcugcccgacuccuucuucaagccgccggagcccaaaucccacucccgacagguaaccucguugccccucuccccguuuccccgucgggcgggccucagaccgggggggcgcucgggagccgcggccgccagcucuggucaggggagggggguugcgggaacucuagcuggggugggggucccgaggcgaaguggaacuggagucguccacuccgccgcggugaccagcuccccacuccucccagaguccggggcugagauuuguuuuucccuucugaguuucucucugcgguugcagccccggggggcgugcuuucccuccuucuuccuuucuuucuucccgggguucccgagagguuggcgggaguggaggagggguggggaggaaggaaggggguggggaaaagucgggccugggccgcggugggcuugcacaaugcgcgcgccuccgcgcgcuccgcaccuucgcucccgccgggccgggcugggaaagggggaggggggccucuggcauuuguguguggguguguugccagcggcggccgaguuugugaaguugagcccugggccccuuuccuuugcggccucucgguccacuucagucuccugggggagucaaauaauuguucucuuguuuuccaguguugauuagagguggggguagaaccgguccauuuaguuuuuugcucuuucuuuccuuccccccucccguuuccccucccccucccguaagcauuuauuuuccucgcggcucaggcgauuucggaauacagguuucgggcuuccccugcccagacuuuccuggaaguuguuuauggaguucuuucaccccugcucuucccuuguguguuggaacuugggccggcuugcucuuaucaaacuuaguaggucgcguguugguuucccaguuguagacuauuauuuacagucggcugaaacgcuuuugaauuagccacaucuguacguugcgcaggaacugaguugcgcuuuacaguaccgagguuuuaacacaagccuuugauaauacacugcagguugacucauaggccaaguccugccuaguucaacugugauuaaaaguuaauguuugggaagcgaugacuaauucuaggaucgccauugcuuuuuaauucuuauugcggauaugaacauggcugcuauuccacauacacaauguucgauuauugugccaacuugauucagcauagaagugaaacuguuuauaaugaguguuaacauuccaauaggucccaguggauuuguuuuguguaggguucucucuuuuucuuucuuuuuuauuucuucuucuuuuuuuuuuuuuuuuuuuuugagaacuugcuucaggcuaaacuucagcauaggaacuuugcccaaaaguuaauagguuuuccaaauacugcaauguaguuagcccacucgggauguaacuugaguggaaagaagaguuaccgcccccacucccauucccucuccuauuugcaggccuguuguauagucuccugucggagaccaaaggguuuuggaacucagaaaaaaucacuuaaccugaugacaaaaacccggguuaaggaggaggaaagaaggaaaaacaauuuagcugcuugccuaaacacuucaauuugucuuagguaugcuuuuuucucuuaccccucgaaguggguuuauggacucauuguggguaaauguauguuggcaugcacccuacagacugcacgguauguuuucaaaguauaauacacauagauuggaucccccauuuuguggcaucagccacaaagaauuacaacugggaaguguacuuuuucuucuaguaaauaauuuuuacaagaauuuauauccagcaguucuaaaauucauaaacuauuauaguuuuguuuguuuuaaauaaguuuuuaacuaaguguuuugcaucuguaaauucgacuuuuauuucuccuaaugauuuccuaaaucauacuuauucugaugggaaacucaaaaagguguaucacuuuaaggcauuaaugacucuacugaguccuuccaguuuccuuaccuuugugaaucuaggaaauucuaacuuuuugauaaucaaacucuaaugcuaauuaaaaauauuuuaaaaacuaugcaagauuaugaauaguacaaaucuagguuguaaauacuauuguucacaacacaaacuggugacuguaaguucuuucauauacauccauuuuucuaucaugaaaacuauuuuauaaaggagaaaacaggcauauggaaguuaagauacuuguucagugucacacuagccaacuuagacuggaacucagaucuuuggggucugaaugcagaauuuuuucugcuuguauagaguuguggaugugugugaguucuuaaguuaaaauuggacugauaacaucuuuaucuucuacauacaaagauauaguuggguuuuuuucauccuguucauuguagauggcuuuuaagaacauuugggcaguucaaauuuguugcucucauuaaaauuuguguaauuuguuaugauuucuuuauugauggcauuuuaucaugguuggaauaaaugacgagggcuugauuuuucuugaguuugaccuagaaaaaaaauuaauuacuuaaaaccuaguaaaaaauacauauucuuuguguuguguuuauacuuagaacauuuuagaacuuggaaaagcacccauaacugcacugaccucuuaaaaauuagguuuuaaaauucacuauuauuuuuggaauguuuuauucauucaguacuaguugcccuuacaugucuaguguggaccaggggaaauucauuagauggacugcucaucaauacaauuacaaacauuuauaaaauuuauauuaaaauuauauaauauuaaaaguauccauuugaaaaccuguguucuccagugucgaauauuaaauguugaaauuuuccuuugguacuuagauauucggcugcaauuaagcgcugacugggaaauuuaaagggacucaguuguguuuuuucuuuuuuaauuuuucaucuuaauauucccuaauaggccaguacugaugcaggcacugcaggagcccugacuccacagcauguucgagcucauuccucuccagcuucucugcaguugggagcuguuucuccugggacacugacccccacuggaguagucucuggcccagcagcuacacccacagcucagcaucuucgacagucuucuuuugagauaccugaugauguaccucugccagcagguugggagauggcaaagacaucuucuggucagagauacuucuuaaaguaagugaaaauaauggugggagacaguuaucuaagacaaauauguauuggaaaacacaguaaaguggugucaagauacagaauaucauuuauuuuuauguuuuauuuaauauuuauguuaagcucuguagcucuaucuuccauauauauguuucaguuugguaugaccuaaauaccuuuguuaguauggguaauauuuugaaagcuuuacugagucuugguucugagccucuuuauaaucuuuucuuuuguggaaguuugguuauucucauuuugagcuugugccaaaccuuuuaauuagccuagcacaaaacagaaagaauaccaugaaaauuuucaaauucugggaauuacagggcuagcagcgucuuacaaaauacguauggugcuacuuguaucuuuuuaaauaaauauuuuauugguagagaacuacaaaauaaguagggcuuuugggggagucuaauuuuacaguauuuuaaauugugaaaugacaagcacuacaacugaagcuugaugugacuuaccaauauuuccccccaaaaauguaaagggaaauaaaaauuuuuagguuucauaugcagucgcucaguggcaaacuucuuucaagcuaguaggucuucacaacagaaacccuccucucugggaaaacaaaaacaugaccguuggguuguuuauuuauuuuuauuuuuucaguccuuuuguguuuaauaaaauggcagaauuacacuaggcugaaaagacauaaauagaauuuucucuccucugauuuugaaauuacagauaagaccucaauuuuuuucuggcuuguuuggaucaaguauauauugaaauguugacuaaaacuaauuaugauagacugaaauugaugucuuuaaaaaagcucacuuaauaguguuuaaucagguugagauaauaaagugaaaaacaguguaaguuuugauucggauaggucuugacagucuacuccuaaggcaaauguaacauuuauuuaucauaccagauaacaccauuaaggauguuuuguugugugaauccuaguauguguuuuauauugauugucuuccaggguggguugcuacuuuguaauguaagauagaaaguuuugugacagacuuacagaagagcaaaggaaaagguuugaucaugaaaaguucguacaguuuuuuuuugcccccuuuccugcaacuuuuucuuuucuuuucuucuuuuuuuuuaaaaaaauucauuuucugguguccugguauccauuucaaaggaucagguuucaaccagaacaguaaagggccugagacuggaaaguacacacaagucuggcaaacucaucugcaugagcaagaucauuuguucucaagcagacauccaaaguaaaugauugaaagagcugcuagcugugaaggaugugucuugaaggggaagggaguggaaacaaaccagguuguuaggaagaaaaagaaaggcugcacuuuuuugaaccucucccugcugggucacaugcugaccuggggagauuguuaaacagcuuaauagccugcuuuccuucuuucuuugguugaugcuguggcuaaaaguauaagguuaaagagcaacauuuaugcucuucuucuuaguucuuuguaucuuguaauaauugcuuguaggugauaccugccuacgauuucauuauuuugaaugaaugaucuuuuuuugagcugaaaucaguauucuagauacaguuggccuuccguaucuguggguucagcauucauggauucaaccaaccucugauugaaaauauuuggaaacaaauuacaucuguauugacuaauguacaaacuuuuuuccuugucauuauuuccuaaauaauguaacaacuauuuagccuuuacguuguauuaaguauuauaaguaaucuagaggugauauaaaguauaugggagaauauguauagguuauaugcaaauauuaugccaccuuauaugaaagaccagagccucuguggauuuuaguacauguaggagguccuggaaccaauccuugaccacagaugcuaaggaaugacuauucauuuuucaaaguuuccagugauucuuccuuugugaagaaauguuucucuuaaagguauugauauauguagauggauuaaugaaggguauauaccuuccaaccccagucaccucaauucaccccugucaacuaugggccuguaaggaagauaaaccaggcuaaaauaaauaaaucucaaauuaugucauaggagaaaagguugcaaggguagagagauauuuacccggaaaagaaaaaacugggaggaggagagauaagacaugauuguuguuucaguguuucuggggaacuuuuaugugggaguaggauuagucuuacuauauaagaaaugugaggaauuuugauuccauggaagaauuuucuuauauaaaacuuuuaagaacuagaagaguuuuccuggacagguaaaucuugcucaauaaauguagguaaaaucaugguuacuugguaucugucagggauucuauggaggccccuaaacauuggaugugggagaagaaugcugugggcuuauaaaauuuuguauuuuaaagaguaucugcuuuaugaacauuaugcaauuuggagaaaaguuaugaaauaagauuauuucaccuucuccaguuagcuacuuccaugauguuauggaccguauaguuguuacaacuucuuuuuguguacugaacagacaaaugagauuaauauccuaaccauuagucaaagaugaugauaaacuaagcuuuuggugccaaguuucuguugucaaaguucauuuuuauccuaguuuugauguuuuaaaauagggcugucuuuguaaucaauauuuauauacuuuccucuuguaucuaaagaggaguguuguugucaucagauguagaaugaagauuuaaauuaguugccuuacacuuguuuccgcaaugaaacauuuuauuuuaaugcaucuuuuuagauauuuguuggaacugacuuuuaaguuacaaagucuauaacuuauugagauuuauauuuggcaugaagaaccugacuauaaaugguccagacaggcaagacgauguaauuugagaaaaaacuuagaaauguuaagaaacaacccaguuguuggccuugugaccauagaugauugaguuuuugaaguuaguuggccuaucaucuaguuuccaggcagcaugauuacugaaagauuauaagcaggcaaucauucguuguuuuaaagcccuccuuaggucagugagaucuuguggaggagacucauaccuuacuuuggcaagugauacgguggaaguauggugcuaguuacauuuaucaguggcuuguuuucaagcucugggaugaaugugaaguauguaaacaaggcuuagccauauaauauuuguucuacuacauuuacuauucaaaacuauuuucuuuaccaucguauugagcuuucauuuuaaaagaauucauucucuuuaugacucugagaguuauuaccuucuucagcugucuuacgguuuuccuacaggaaauaguucuucaaguaguuggucaacaacuuccuauuucuuuauaagcugcugaauaacuuccugacucaguauucuauaauaucucugguuucaaggaguguuuuacuugcaaguuuauuuuauugacucugaugccuuauaacuauuaccauguucaaagauauguguucuuauauauaauguaccauguaggaccuuauaauuugauuuaaggaaucuggaucagugauuuuaaaaguuuguacauuugcauuguuuuaauaauguucuaauaauuuuuaaagcacaguuuuguuucauuuccauuguuuaucauuuucugaauaacuggccacaauguuuuuagucugcgaagauucaagguuuuuuguggcugugauuugauuaaguuauauugaguagcuugguauacaauuuaaaaaggauauguuuuucagagauuuuugacauugcauggcauaaaacuacccauauuccuauauuaauuugccuuguagaugugauugaucgcuauacauaggcugauucuuuuuucuuucuuuccuuuuuuuuuuuuuuuugagacagagucuugcucuguugaccaggcuggagugcaguggcacgaucucaacucacugcaaccucugccuccuggguucgcgugauucuccugccccaucucuacaaaaauacaaaaauuagccggguguguuggcgcacaccuauugucccagcuaaucaggagacugaggcaggagaauugcuugaaccuggcagguggaggcugcagugaguugagauugcaccacuccacaccagccugggcgacagagccagacucuaucucaaaaaaaaaaaagacuaugaacauauacaguguauguuguuaucauauacaguguaccugguauuuauacauuguauacagaacauauacaguguaucuucauaauaaagauuaugccucuuuaaaaggaaguuucaugaagaauaaggcuauacuguuucuuucuguaucaaguauaacccagaguuucccuuuaaaacugaaaagcuuguaauuuugccauuaaauguuaaguugcacacgugcacauguauacacaaacaaaaaaccaguucaaauugcaaucacgaaguauuucccuauuugagggaaggccagucucugcuuguuugucuugcuauugaggcugaguggagagagaagaugaaaguacgcccuuagcucuggggggugggggagagcuuacuucugcucagugggugggcaucccagggaagaauggcacacagugccacagugauuuagggagagaacccuggagaaacuguauucaccaguggcagaagaaaaacaguuggaagauaguagaugugacagaguaaauagaacauagagauuaacauauucccugggaaaaauaauggaauuuuuuuagugugaacuaagaaagaaguucacuagaacuucuuugcauuauuuaauuaauuugcagcaucauucaaagaacagacugucacuugguguguuuaaaaauuaugauucuuaguucuagaaagaauucuagaacuaucucuggaaguuuaaauguagcagacucaauugacugcaaggugguaggcuaauuuucuuuuuaaagucacauuuaaaaaaaaauacccuuuccuaaagcuuuaucuuagccauuaaaaaaaaacccaaacaucuagauagcauuuaaauaguugaaacuuggaaaaaaaaaaaacccagguuuuuacaacccuaaaauaaguccucuuuaguuauguagagaaauauuuuacuuuguaguuagaaaaauaaugugaauucacagcuuaaaauacucaggguaucaugacucugcauugccuuguaccuuaaggcuuugaggggagguaaacucuaaacuguuuuauugccaaaauauauauagaaauuuaagcuuaggaccaaucaaagugaagucauuuuaaaaaucaguugcuaagauuuaagauuauucaaacuuaaugcuacccucuguaauagcauaauuuagccauuaauuguggcuugaaaguuuuuaauaauagcugaguagcauuguauaaagggaggucuuaaagagcugugucguucuauaacugugguuacuaggugaugcacuucuuacaaaaagggcuucugauucuaggauuaaucagaacuacaagccaugaaagggacauugccguuucuaugaagaagaauugcuucaugguucugguugcucaagugcuguagcaccaaguuuccugggaacaaguacugccaccguggaagcacuuuuauuuacguagggcuugaccccuucuaaaugcaaacaaagaaguuugguuuaaaucacagcaguccuccccaccuccccuuuaauauucuagacaaggaaaauggucaguauuuaauccucauuuugcuccuagcaugagaagaaucauaauuuuuaaacacaccaaccaagugauagucuguuguuucuuugaaugauguugcaaauuaauaaaauagugcaaauggcaguaucuauuauuuggguuuucuucuaccagauauuuucagugcuuuauuugugguuagugccauuacuucaugugcugucacuuuaauuugucucucuaucucuuuaugggauguuagucacucgacuaucaaguucuucagcaggauucucaguugggggugggugaggggacauuuuauuaaaagcuccuuccuuugucuucuuccaauugauugcuuaaccuaaagggagaggaguucuguuuguuuuuaaaguaagguauuuauuuggccaguaaguauguuuagagaguugauacuugcaugaaaauugcugcagauuugauuugggauuuggaguaaagauagugugcuuguuaaaguguuacugugugcuuugacaaaauggaauguaguauagaaaguugcuugaaauucaacuucucguauauccugaacugacuaauaaggagcaggcuuuugggauaaaaaguacauacgcugccaccuaggaggugaagcaagauguggauuuuuuuuuccuguauauggaaauagauguggggguucuuuuguuuuauauuuauaaaacaguccucccucacucuuauuccuucaugugcgguagucccuccccaccauccaugaguuuccuuuccaaaguuucaguuaccugccaucacugugguguaaaaauauuaaaauggagaauuccagaaauaauucauggccagccgucguagcucacgucuguaaucccagcacuuugagaggcugaggugggcauauccuuugagcccaggaguugaagaccagccugggcaauguagcaagaucucaucucuauuaaaaauacaaaaaaauuagccgagcaugguggcaccugccuguagucccagcuacuugggaggcugaagugggagaaucaccugagccugggaagucgaggcugcagugauugugccacugcacuucagcccagccugggcaaugggagugagaccuugucucaaaaaaaaaaaaaacuaaaaacagaaaaccaguucauaaguuuuaaauugcaguguucugaguagcgugaugcaauccugcaaucuugugcuguccagucuggaaugugaauccucucuuuggucaaugcauccauacugucuaugcuaccucccaugccaccaccccauuggucacuuaguagccaccucaguugucagauccaaagacuguaguauauauauaggauauaggguuggguacuaucugcuguuucaagcauccacuguggggcuuggaucauuuccccugaggauaagugggggacugcugccucugauuuuaggcauuucuuuuaauaagguauauuauuuuuuuguauuuguuugguuuauuuugagacagucuuaacucugucacccagacuuggagugcaguugcaugaucacugcucacagcagcuucuacaucccaggcuugugugauccucccaccugagccuccugaguagcugggacuacaggcauccaccaccaugccuggcuaauuuuuaaauuuuuuguagagaccagguuuuaccauguugcccaggcuggucucaaacuccuggacucaggugaaccuuaggcaugaaccaccacaccuggccaggcauaugguuuuuguuauaaaacuaacauuuauuagagagaaucagaaaauucaggaaaagagaaagggggccuggcgcaguggcucaugccuguaauccuagccuuuugggaggcuaaggcaggcagauaacuugaggguaggaguucaagaccagccuggccaacagugaaaaccgaucucuacuaaaaauagaaggaaaaaaaaugggcgugguagcccaugccuguaaucccagcuacuccuuuugggaggcugaggcaugagaaucguuugagcucaggaggcagagguugcagugagccaacaucacgccacugcacuacagccugggcaacagagccagacucugucucaaaaaaaaaaaagaaggaaagaaaacggaaggaagcaccagauucuaccagugagagguguuugaagaaccuuguuuucauagccuguguguaaacguauauuuugaaauuuaauuuuuagggaaguaaccugugcauugauuuagaaaaucccuuaauacuguaagguuuauaaagaaaaagagcaggcuggguaugguggcucacgccuguaaucccagcacuucggaaggccaaggcgggcggaucaccugaggucaggaguuugagaccagccuggccaacauggugaaaccccaucucuacuaaaaaauagaaaaauuaggcaggcgugguggcaggcgccuuaaucccagcuacuugggaggcagaggcaggauaaucguuugaaccugggagguggagguugcagcagugaaucgagaucgagcauugcacucuagccugggggacaagagcgagacuucucucaaaaaaaaaaaaaaaaaaaaagcaaagaaaagagcaaugacccucuuuucuuuaucucuggcuugcagcuugcauucuucagaggcaagcacuuuccacuccuucuagguguuuuuuccgcugguacuuuuaaaaauuccauauuuauaaaauguguuacauugcuauuucuugaauuuucaucaccccucaaaauccuuuucuuuaauccucccauuauaaugacuauaauuguuuuguuaaauauuuuuacguuaugacaauucauguugugccuacagcagagucauauaauguacuaugauuuucuggaaaauucuguauuuccuugccuggccaacugugauuuuguuuuugccgugauuuuuuguuuuuauuucuguugcuuuuugcccaccuuggagcuauccuuagagucuuuuguuuuccugcucugugcuagacuuguugcuucagaguugucauguuaggaugugccuuggcuuucauccuggggaguuucugaaucacucuuauggguuggguacccaauuuuucucuuucuuuauuugcucacucuuugaguuuguucauccccuagaaauuugcagaagaaagggguacaugggagguagcuguguugagaucucuugucucuaaaacuaucuuucucuguuaacauuuagugggcaguuugguuguagcauuuaagcuuauuuucucgugaaauuuugauggcauuacuccguuuucuuuucuuuuuuuuuuuuucuuuuuuuuuucgagacacagucuugcucugucacccagguuggagugcaguggcucgaucucgucucacugcaagcuccaccuccuggguucaugccauucucuggccucagccucccgaguagcugggacuacaggcacccaccaccgcgcccagcuaaguuuuuguauuuuuaguagagacggaguuucaccguggucucgaucuccugaccucgugauccgcccaccuuggccucccaaagugcugggauuacaggugugagccaccaugcccggccacuccauuuucuuuuucuuuuuuuuuuguuuuuuuguuuuuuugagauggagucuugcuuugucacccaggcuggagugcaggggugugaucucggcucaucgcaaucucuggcucccggguucaagcgauucuccugccuuagccuccugaguagccgggauuacaggcgugugccaccaugccccagcuaauuuuuguauuuuuaguagaggcgggguuucaccauguuggccagguuggucucgaacuccugaccucaagugaucugccugccucagccucccaaagugcugggauuacaggcaugagcugcugcgcccggcacuccauuuucuucuagcuuccaguuugcuaauugaguguuugcuuuccuuggggauuuuaguauuuuguucuuuauauugggggucugaaauuucaugaugucuguugauaugcucuuuuaaaauucauugucaacaaugccuagucauguaucaguucauguaaagaaacucggucuucaauauggaugaugccccucaagauuuugcaguacaguugcccuaaaguacaauuuccaggacugucuuuucaggcauggaaucuuucaguccuggaaaacauuucuuucauuaguucccggguaauuucuuccagucuguuuuaucuguuauuuuuuuucuggaauucuugcuagucaggauaacuguuuuaauuuucuuaucuuaucccacuauuuucuuucacuuagcauuuuguuauguuuucugggagaucccuucaacuuuaacuuuuaauuuuucuguugauuuuguuuucuuuuguuucugagaugaugugggaggggggcggucucacucugcugcccagguucgagugcaguggcgccaucucagcuuacugcaaccucugccccuggagcucaagcgauccucccuccucaguguccuaaguagcugggaucacagauugcguaucaccaugccuggcuaaguauuuguguuuuugguagaaauggguuucaccauguuucccaugguuggucucaaacuugugagcucaagugaucugcccguguccaccuucagaagugcugggauuacagggaugagccaccgugccuagccagauuuuuuuuuuuuuuuagacaaggucuuccucuguugcccaggcuggaaugcaguggcacgcucagggcucacugcagccucaacuucugaaccucaggugaucguccugccuuagccuccccaaguagcugggaccggcuaauuuuuguguguguauguuuuguagagacaggguuuuaccauguugcccaggcuggugucgaacuccugggcucaaaugauccacccaccuuggccucccaaagugcugggauuacaggugugagccagugcgccuggccugauuuucuuuuuucccaaaaagcuauuucucauucuuuuuuuuuucuuuucuuuucuuuuuuuuuuuuuuuugagacagagcuucgcacuguugcccaggcuggagugcgguggcacaauuuuggcucacugcagccuccgccuccuggguucaagugauucuccugcuucagccuccagaguagcugggauuacaggcaugcgucaucaugccuggcuaauuuuuuuauauuuuuaguagagauggggauucaccauguuacccaggcuggucuugaacuccuaaccucaagugauccgccuaccucagccucccaaagugcugggauuacugaugucagccauaucacgccuggccuguguaucauucuuaauuuacagugagucuuuucugagcucauuguuuauuauuuuuaauaacaugcuguucuuauuuuaugguuguaguaauauaauaucucccuuaggauauuauacuguuucuuuuuauauuuugugcugaugccuucauugucuagguaggcuucauuggagaguaauacaacaggagccaagcccggaaguugcagggaccccugaaugccacugucuuaguaauuuccucuuuuagcagccacuaucucuagcuaagucugccagucuggagagcaccaguggugaugggaguuaggacugaauaccaguguucuugggcuugacaauguggggccucaucccugcucucagcuaugucauguguuugaauccagagucuccaggucuguuucucugaaaucugaauaaucgauuuccuccuugggccaagcagagagguaugcaguagguuuuuaagaaguuguauguaagcugaauuuuugugaauccaguuuauaauuacagguugacuauaggaaguugccaauuuucuaagcccaaaacagugacuauuagcaauuuuuuaugauuugguuuaaaccuuacaaaaucacuuuuuacugaauccuugauaugguuuggcuguguucccacugaaaucucaaugugaauuuuaucucccagaauuccuacauguugugggacaaacccagugggagguaauugaaucacaggggccuuucuuucccgugcuauucucgugauagugaauaagucucaugagaucuaauggguuuaucagggguuuccgcuuuugcuucuuccucauuucucucuugcccccgccauguaagaagugccucucaccucccgccaugauucugaggccuccuuagccauguggaguuguaaguccaauuaaaccgcuuuuucuucccagucuuggguaugucuuuaucaguagcaugaaaaugaacuaauacaguacauugguaccaguaaaguggggcguugcugaaaaauacccaaaaauuuggaagugacuuuggaacuggguaacagagguuggaacaguuuggaagacucagaagaagacaagaaaaugugggaaaguuuggaacuuccuagagacuucuugaauggcuuugacaaaaaugccgauagugaugugaacaguccaggcugagguggucucagauggaaaugaggaacuucuugggaacuggaccagaggugacucuuguuacguuuuagcaaagggacugguggcaguuugcccuugcccuagagauuuguggaacuuugaacuugaaagagaugauuuagguaucuggccaaagaaauuucuaagcagcaaagcauucaaaaggugacuugggugcuguuaaaagcauuuaguuuuauaaaggaagcagagcauaaaaguucagaaaauuugcagccugacaaugcaguagaaaauaaaaacccauuuuuugaggagaaauucaagccaguugcagaaauuugcauaaguagcaaggagccuaauguuaauccccaagaccaaggggaagaugucuccaggccaugucagagacuuucacgucagccccucccaucacaggccuggaggcccaggaggauaugguuuuguaggcugggcccagggucccugugcugugugcagucuagggacuuggugcccugugucucagccacuccagcuguggcugaaaggggccaacguauggcucaggcuguggcuucagagguuggaagccccaagccuuggcagcuuccacuugguguugagagugcaguugcacagaagucaagaauucagguuugggaaccucugccuagauuucagaugcauggaaaugccuggaugugugggcaaaaguuugcugcaggggcggggcccugauggagaaccucugcuagggcagugcagaagggaacugugggguuggagcccccacacagaguccccacuggggcacugccuaguggagcugugagaagagagccaccauccuccagaccccagaaugguagauccacugacaccuugcaucgugcuccuggaaaagcugcaggcacucagugccagccugugagagcagccagaagggaggcuguacccuguaaaaccacaggggcggagcugcccaagaccaugggaauccaucucuuguaucagugagaccuggagucacaggagaucauuuuggagcuuuaaaaugugacugucccacuggauuucggacucgcaugggcccuguaaccccuuuguuuuggccaauuucuuccauucagaauggcuguauuuacccaguaccuguacccgcauuguaucuaggaaguaacuagcuugcuuuuaguuuuacaggcccauagguggaagggauuugccuugucucugaugagacuuuggacuguggacuuuuggguuaaugcugaaaugaguaagacuuugggggaacuguugggaaggcaugauugguuuugaaauaugaggacaugagauuuggaggggccaacggcagcaugauaugauuuggcuguguccccacugaaaucucaacuugagcuguaucucccagaauucccacguguugugggagggacucggcgggggguaauugaauuauggggucuagucuuucccgugcuauucucaugauaaugaauaagucucacgagaucugauggguuuaucagggguuuccgcuuuugcuucuuccucauuucucucuugccacugccauguaagaagugccucucaccuuccaccaugauccugaggccuccccagccauguggaacuguuuaaguccaauuaaaccucuuuuucuucccagucucagguauaucuuuaucagcguugugaaaaugaacuaauacaauccuuaagugcuuuuaacaagcaaaugcuuacuucauuuauauuuguccuuaucaguaucaguuuugcuagcuuaccuuuuugcauguuagauuuucuuaaagggagaauuacagcugugacacgagagugguuagcauugaauggacagucuaagaauuuuguucagaagguuuggauucuggucagagagccuggagauauaauuucuauucuuauguaugauaagggagguaguccuaucuguucguuugccauuuccaaguucuucaucuaguuaauaugaacagcuuuaaaaauuagggcuuuaaaguaaaacagccuuauauaauuauuggccucucucucucuuccuuugucucucccucucuuccuuuuuuaccucccucccucccucucgcuucccuauccccaaacccuguguccccuccccagucuccugacacugucucuuucuuucucucaucaguauagauggugguaggaaaaauguuuauaucuaaauugaucaguaauuguaaauaugcaguauacugcauaaguuaacccugagauguguuuaacugaguuuuaucucaguuucucccuggcagguggugcucauuuaauagagaacucaaaaaaguagccuguguucagucccuaauagaccauuguugaugucauagaauaauuuuuuuuucuauauacuaucauauggucagguaagcauuuuuagagaaugaguuagaauuucaugaagacuggguuuagguuaaaauacauucaucugggccaggugcaguggcucucgccuguaaucccagcacuuugggaggcugagguggguggaucacgaggucaggaguucaagacuagccugaccaacaucgugaaaccccaucucuacaaaaacacaaaaauuagcugugcaugauggugggugccuguaaucccagcugcucgggaggcugaggcacgagaaucucuugaacccaggaagcagagguugccgugagccaagauugcgccauugcauuccaggcugggcaacagagcgagacucugucuccaaaaaaaaaaaaaaaaaaaaaauuuacccauagaugauggcugagauguguuaggacccuuuauuguuuuuuaucucaaguugaauuucuccagguuccauuuuucaguagucuuguccuuguuuagguaaaaagugauuacauaggaaaaucuguugggugaaaaggaagcaaaacuuuuuuuuuuuuuuuuuuuuucgaaauggggucuugcucugucacccaggcuggagugaugcaguggcacuaucucagcucacugcaaccuccgccuccgccuccuggguucaagugauucuccugccucagccuccccagcagcugggauuacaggcaugcaccaccacaccuggcuaauuuuuguagagaugggguuuugaacuacugaccucaaguaauccaccugccucagcuucccaaagugcugggauuauaggcgugagccacugugccuggccagaaaccuuuuaaaacugcauacaagcaaaaccagaccagagcaccauauagcagucagagaagaggguuuucugagucauaaauauugacucagaaaaaaaauucaauauuuuucugagucaaaaauauugaauggugugaggaagaguggaacagaauugguacaccuuaguucguguaaaauaaggaagugugucagaauagccaagugcuaaguuuagaaaugagcuaaauaaauggagauuccugagacccugccuggaaccaauucuuaccaguguuaaggucacaguuaaaauuucccaagcucucccggauaaugauugauugauugauugauugauugacaggcucucauuccaguugcccaggcuggagugcaauaguaugaucuuggcucacuguagccucaauccucuggacuuaggugauucuccaccucagccuccugaauagcugggacuacaagaaugugccaccacaccuggcuaauuuuugugucuuuaguagagauggagucuugccguguugcccaggcuggaaucaaacuccuggacucaagcaaucugcucacuucagccucccaaaaugcugggauuacaggcaugagccaccacaccugaccucuccuggauaacuacucuuuuuuuuuuuuuuuuuuuuuuuuaagauuuaaaaaaacugguaaagaguuguccaaauacagauguuucuauuuuuccucuacacauguucagacugauacagguuauguuuccaaaaucauguaguuuggauggguucacuuuuaaccccucccagcuggaggguaugcaggcuuuccuguuaggacuaguacagaucucuucuuaugggugagaaaauagucacuguuucuuugcaaugauauguaagugucauuguccucuguguuugaggauaaaccaugcccucuuuguaccugucugucuucuuugaguuggugcccaucauacugcagauaagaauuugcacagcuuaucaauaagccaguucucucucuucccucaaauacugggugguuuucucaaaaaagacccacaugguucgggauaaaguguuugguuacuugcuuugauguaguuauaguuucuaaaacuguagcccaaaagaguagccaaugcuuagucuuuaguaggccauugucgauguugcucuuccugccauucuuuucugugaacucacuauaagugcuuuugaucucuugauuuuauaaacaccuauguagugguuuuauguagcaggcguuguucuggaucccacucuguguaauagggacaaaauuaauaacaugccagucuugauggacuggauaggucucaaaacuucauuguaagucaugugucuuguuugccuuuucauugguaacugucccucacgauugaggcuaugaguucaauaaagagagaucuugcugucuuuguucagcauuauguguguagcucuugauacauuuauuggcagaugacaugcuauagagugcucauuuauuucagaguccauuggucgacagucuuccugauugaugacuguaguuucugcauaauuaugauugcccuuuucacucuugaaaguaucccacaauggcugauaaauuacauaugcgaacuagaguauuuacuauguguauucuaaaguuaauuuuaugaguuugagauuauuuuuaagcuuuaacaggaacuauuaaaaaaggguauuguuugucuucuggauauaaagugacaguaguucacuuugugguauuauaaauuuuguuccaugggcagugaauaucugauuucuuuaggauuaaaugaguaagaaauucuguuguaaaagugauaccaagccuggccaacaugaugaaacccugucucuacuaaaaauagaaaaauuagcugggcacaguggugugcgccuguugucccagcuacucgggaggcugaggcaggagaaucgcuugaauuuaggagguggagguugcagugagcugagaucucaccacugcaucccagccugggcaacagagcgagacccugugucaaaaaaaauaaaaaaaaagagugauaccggugagcagacaacucuggaaggcugagagaaaagucaugagguaguagcaugggucagauacuacucaagucacgcuuaagggaguuagcauuuucagcuagugauuguguggacauuggaggagucaaagacagagcugccaaaagguuuucugguaaaaccaaaggucuuuucccuccccaccuugaaugacauugcaucucaagagaguccucgcuugaugcuguuaauuaauuaaucucaguuuacuuugcauucugacuuuggguauuuuuuucauuuuuugaaaaacaguucuucugauaucaaaacacuugaaaagccauuuaaugacuugguuuuauucacuguuugagacagauuguuucaaagugaggacuaugcauuacacaaacauuguuaacuauaauuguauccuguauacauuuuuuaaagguuuguuuugauguuggcaccuguuuaagauuuuccuuuuuugcuucuuuuugacaccauuugucagaaaaugcugguugaaagggauuguuugcauuucauuuuuugguaaauucagcuucauguucauuuguuuaccaauaaauuuauuagaauugugcaaagugaauauaaaccguuuacacacauugguuacucuuguuucaguuaguaauuaucccugcaaauugaauuaauaguaaaauguguaaaacauuacaauuuuuuacuuuuuuuauuuuuuacuggcauaggggcccggcauagugguucaugccuguaaucccagcgcuuugggaggccgaggcaggagaucaccugaggucaggagauggagaccagccuggccaacauggugaaaccccgucucuacuaaaaauacaaaaauuaucugggagugguggugcuugccuguaaucccagcuacucuggaggcugaggcaggagaaucacuugaaccagagaguuagagguugcagugagccaagauggcgccacugcacuccagccuggcaacagagugagacuccgucucaaaaauaaauaaauaaacaaacaaacaaacaauuugguuuaaaaaauacuaggauuuuacuuaaaaagauuuuuaaacucgacaauucuuacuaagcucuaggauuuuaaguuuauuaauaaaacucuuguggcacacagaauuuuuggguuuuuuugggacagagucucacucugcuaccccagggauggaguacaguggcgaugucagcucacugcagccuccaccuccuggguucaagcaauucuccugccucagccucccgaguagcugggacuacaggcacguugcuaccaugcucggcuaauuuuuguauuuuuuguagagaugggguuucaacauguugccaaggcugguuucaaacuccaaggcccaagugaucugccugucuuggccucccacagggcugggauuacaggcauaagccaccacgccuggccuagaauuguuuaucuaaugucaaaguuuaauaugguuuuggaaggaaguuaugaguuucacacaaaugcuuauaauuaagaaauaaguuuagaugacaauagcauauuaggcuguuaagauuucaacucugcuguuuuguaggaagccacauggaggucauuuacgguuacuaguuaucuuagucagcuugggcagccauuaaaaaauaauacuguagacggaguggcccaaacgagagaaauuuauuucuuauaguuuuggcaugguagauuucauccugaggucucuucucuugguuuguaguuggcugucaaucucccugcaugcucacacgaccgcuuuuuguacauacaguaagaaaauacacacugucaugucauuuuuuuguaagggaacugauuucaucaugaggacccugccacucucaugaccugaucuaaucguaauuaacuccaaagacccuaucuccaaaugucagcacauugagggauuagcacuucagcgaugacuuuugggaggacacggauauuuaguccaaaacacuguuuuaacugaaaagaguuugcauuauggacguuuauguuugaaaaaucagcuauuuagguagugguggucucucacuuuauuugccauugacuuguuagggaaaccuuuugcuuucucauuucaagaugcuagauuaguaccuuauuaucauacuuaaucuguuaacugugauuuagaaauaucaggaugcuauaaacaacauggaauuaugugcagauauacgauugagaguuggauuuuuuuuacaucucaguauuguucugcauauuauucagagguauguacuuuguccuaauaugcuauguuauggcucuuuuuuuaaucuaugaaaaauuauauauauuuauuuauauauguauaauauauauauuaaauauauauauauuuaagaaugcauaaaacacacuuauucuaaauagugauuuugauggaaauacgcuuccagguuaaccacucuccagguuaauaaagagaauauugcuaguuccuuagaagucuuccacguaccucucacagaucacaucccuuucccucuauccagagguaacuucuggccuuuuauuuuaccuuuuuuuaaauuugagagauagggucucacucuguugcccagguuggaguauaguggccugauuacugcucacugcagccuugaccuccugggcugaagcgauccucuggccucagccuccugaguagcugggauugcagguacaugccaccaugccagcuaauuuguuuucuaguguuuuuuugagauggaguuucacuauuuuugcccagguuggagugcaguggcgcagccucagcucacugcaaccucugccuccuugguucaagugauucuccugccucagccuccugaguagcugggauuaaaggugcaugcuggcuaauuuuguauuuuuaguagauucgggauuucacuauguuggccaggcuggucuugaacuccugaccucagguggucugcccacguuagccucccaaaguacugggauuacagccugaccauaauuuuuaauuuuuaauuuuuuguagagauggugucucacuauguugccuaggcuggauuauuuuuuaguuuuaccaucuacauguguauuucuuucaguuaccuacuacugcauaacaaacuacccuaaaacuuacggcuuaaaacaaccauuuuauuguaucuuacaaauuugugaauuagggauucagucaaggcacagcagggugauucuuuuccaugcagcauugauggaggucacucagugccauucagcuggcagacuggauccaaagauagcuucacucauaggucuugcuugcacuuugauguggauggcuggaaggcugggcuuagcuggaacuguguaccagaguguguguacauggccuuucuagcauugcggucugaaggcaguuggauuucuuaaauggcagcugagauuuccuagagaggcagccucaagaggcuugggcagaaguuucaagcuucuucaaaucuaaccuuggacaucccauuguauuggucaggccaaucaccaagaccagaauggauucaagccaaaggaauuagacuucauuuuucaaugggaggaauaguaaaaaaauugguggucauuuuuaauuugccacaguucuuauaauaguucuaauuuuuaaaauuuuauauaaaugaagugauaucugcaaauauuuuugcaguuugcaucuuuugaucaauuuugugggacucgugaauguuaguauaguucauuuuuauugcuguauauuuucauagcuguguggcucuauuguauagcuagaccacaguuuauccauucugucauuaaagaacauuuguguuauauaaagaugcugcagugaacauucauguguaugucuucugugcaaggauuucucuguguacauacauaagaacuuuucuaggcuguguaagaguggaauugcugggucacaggguauguccagugcaugguacuuuugcuggucuucuguguuuauauuaguauaccacugugguuuuaacuuacauugcuugaucaccauuggaucugagcauauuuucauauacauuuuggucauuuauuuuacuuucuaaagcacuugcucaaauguuuugcccaguguucuuuugaauuuuugccccuuuuuccuguaugauaacugcuugcuuuuaauccuuccaugugccuaggacagggagccauuuuuccuuuuuuuuuuuuuuuaaaacagggucuccgucgccuaggcuggagugcaguggcacaaucucggcucacugcaaccuccaucucccaggcccaagugauccucucaccucagccuccuaaguagcugggacuacagguggguacugcuaccgugccuggguaauuuuguuuuuguuuguuuuuuugguagagauggaguuucaccauguugcccaagcuggugucgaacuucugggcuaaagugauccaccugccucagccucccaaaguacugggauuacaggcaugagccacugcaccgggcucauuuuucuauauucgaaaaguuucauauauaugucuuuaaucuucucagaauugacuauguauauaugaguguaggaguuuuuuucucagauggauauccaguuuuccuaggacgauuuacugaaaaguucacuccucacugauuagugauugcacuucuguccguaauaguugcauagaucuguuacuguauucuguuuguugucugucgcugugucaguagcacugucuuaauuacuaaaacauuagaauaugucuugauaguagaggaaguccuuuuaucuugucuuggcuguucuuuguuguagucagauaaauuuaagaauuggcuuguaaaguuccgcaaaggaccucuugaaauucugagauugcaaugaaccuauagaaaaauuuggagaauugguaucuuuacauuaagucuucuagucuaugacaaugguaaaaacaucugucuccuuugcccuuuaauguaaauguuucuauaaucugaagauggaacuaacaagaucuggguugaaaccucaguucugcuucuuacugccuuaggaccugaggcaagucacauaaacucucuaaacuuuaguuuucuuaucuauaaaauaagugguaauaccuacuaagcagaguuacuaagagaauaggguaucauguuaaaacccugaguguagaaacuagugcauaauaucucuuagugaauggaauuaauauacuacaucucucucuccuuaaaguuugugggauauucaguuuuaaacugggugccauauaauguuuuaauauccuuguuaacaaauuuaucaaaaucacauauauggguagaauuuaggugauggguauaugaauguucgcuguacaagucuuccaauuuugcuguaugugaagaauuuucauaaacuuuugagaaaaagacaacauauaugaaaaauauagaaugcuuaaaagacuuugcugccucucccugcuccaugugaaaucacaguaaagccaaguuaaaucugacuuuuuagguuaaauguuuuauugaaacuauuagcacacacaugcucuuguggguugauuuaguucuaaauauuucacguuauuagagucauugacuuuuuuuuuuuuuuuuuaaagucauggaguuccuuuucucaauaucauuaaccuuguaagaucuucuaaaaguguuuacaacacagcuuauaauuaacugauuuuuggagagguggaagggaacuaaguucuuuuuuuuuucuuuuuuuaaauuuccgagauggagucuugcucugucgcccaggcuggcguguuguggugcuaucucagcucacugcagccuccgccucccgaguucaagcaauucucuugccucagccuccugaguaucugggauuacaggcgcgugccaccacgccuggcuaauuuuuguauuuuaguagagacaggguuucgccauguuggccaggcuggucucaaacuccugacccugugauccgccugccuuggccucccaaagugcuggaauuauaggcaugagccacugugcccagcugauagggaacuaaguucuuuggugcauugguuaucuuuugcugcauuaacugacuauggaaaaaauuaguggccuaaaauaauaauucugucauucgaguugggcucagcugagcaguucuucugcugauacugccugaagucacucaugcaucuguaucugggagcuauacuggggcuggagggucuaggaaggucucucacucaaaugucuggugccagcucaucugggccuuucuuuucacguuuucaccauucaucuguuuaguccaggcuuccuuagguguugcugggaacauuccaaaagggggaagguggaagcuuuaaggccuccugaggccauuguacaauuucacuucuaccacauucuguuguagauuaguuuaggcaugaacugaaauggaaaauuuagcagaaauggauccuggauuuucugguacccguguuucguuuaauuacuuuguugcuuucucucccucccugaguucaauuaaguugagaaaaguguucauuguuauuacugauggauuagacuuuauuugcucuucauugaauguuucaguuaauuuacagacuaguaaauuaucugagucaucaaguuauguacguguauguggguaucuauauacauaaauauagauaaaauaaugcaggaggcgaauacuugcaguggcuuuaggaugauuguuauauuccugugguuccugcuucccagaaauguuuucugugauuacaucacacguguccagguuucuuaugaaugaacacuuaaggagcacugcuucacuggaggguaauuaacacauucucagacauuuaauuucaaaagcaaagcauauaugucuuucucuaaaggcccaugaaaacaaguuuuuuuuuuuucucuucaugaaauugagugauuauaaaaacugauuuaauccauuguaauuuuuuguuauccaaaaguugauuuuaaacagugaaucagauuucggcacugugauucauacucccaaaaugaguaacaugauuagcaggauauuccuaguuguucucuugacuuaaaaaaaaaaaaaguccauggugacuccuccauuuuugguaguggaguuguauugggucuaugaagaggcuuugcgagaaaaaagagcagcuauuuauggagcauuuccucaggccugcaauuugaagcuauuauagcaaaguugcugagcaaguccgugauugcaggccaacagucauucaagcccccauccugcagucuguguggagugaguucaaaacuacugcugugcaaaguuuucccucugcaguguuuaucaguugccuacuuuguaaagagcaaggguuucaggcauucuaaacccgcuuuguuaacugguagauuauuaagcaguuacaggauauaagcuaguuuuuggguguucgggagauuguucagcauuuaagaauacaaugauucccccauccccuacucccuuuuaguuacuuaaaaucaaaccaucuuaucauaaaaugcagauuuuaugcagauuuuuccagcaguuuuacuuacgcuuauaaaaacagauguuggguugucugucaaaggaauuauauccuguagaccuggaaucuguguuugaggggaauuugauuuuagauuguagauugcuuuguugccuaccuaugaaaacaucauuuauuuuuguguaggguuuugugagcuuuuuuuuuaaauggugacagaaaaugaaaauagccuaauuguguuuuuuaucaucaaaggaugaaauuggcuuaucugaauuuggcuggaaaauuugauuugguaucagcaaaugaugaacugaaaaucaaugagcuuuaaucugcucuggauaauauuaacagggguuuauccuaaauaggacucuucuaaccugugaaucuuagaaccuuuccacuuuuuggugucaaaguuuuaaagcauaguagcuuuucuguauauauagucugauaguguaaaaaaaauuggguguuguugcauguuauucucugucccuguaaaaaaaaaaaucuguauuuuuccauuguucuggaaaaaauucaauuucaaggaaaauuuuauauagcuacuagaaaauuaguuuuuagcaauaucuaugauuuucauuucaagaaagcaacaauugauaggaauuauguuuugaggauugaaaucuacucuaaauugaaaguguucacauuuaauauaauaaucuaggauauuuaaaagucauaugggcauucuauaaaagagaaguauuucuuaaucuguuucaguaccccccaugccaacaaaacuacgcaugauagcaacacacacuaaaaagagaaagaacagugucauuaaaggaugucccccagauuacuaggccuuuuaaaaaugacaucuuaggccuggcgugguggcucacaccuguaaucccagcacuuugggaggccaaagcggacggaucacgaggucaggaguuugagaccagccuggccaacauggugaaacccugucucuacuaaaaauacaaaaauuagccgggcgugguugugcgcaccuguaauccuagcuacuugggagggugaggcaggagaaucacuugaaccugggagguggagguugcagugagcugagaucgugcuguuucacuccagcgugggcaauagagugagauuccauuucccaaaaaaaaaaagacaucuuaaucccuacguucucuuggguuucaguaagauugggugaaauagugaguuucuuaacuguggcaguuacaacugagagaaauuuucuaguucuguuacauaaauugaaauugaggacauuucuauuucacugaaugguggcuuuugggaagugguccuuagauguuguugccucaccuuugugccucacccccaucuuuuccggaacgauuuaaaugaaauauacauucccuuaagauucagcucagguguuaauuccucuagagagucuaccuagauuuuuccuguccaaagucugccuugggagucccucauggccuuucacaacuacacugcauugggaauaugaguuuucacuuuggacuugauauugugucuugugugccuagcauagagaugcagcacaauaugaaugcucaccaaaaagaaguugagaacuauuuucguguucccagucauuucagaagcauugacuuauuuuuaccuguuuuggugucuuuauaaagcuucagcaccaugcucagagguaugggacaaggauugagagcaaugcagucccuguccucgguuaggaggcaaggugggugcaaugguaagaagugguaugaaaaaauauccaguuggcgcuaaacaaugugguaagcccuaaguaauguagcuuaggaacucaggaaaaaaagagagacuuacuucuguguuggaauucuuggagaaguuuggucuuugguuguauuugaaagauggauaagaauagacagaauaggauuuuauucuguauugaauccuuuuguugacuuugcuuuaucugucaugguuuuauaacaacauguaauuuuaguauuucugcauuugguuaaaaaaauuuccucucauuugaauuuuaggugccugauugcuuauucuccuccacuagaugugguaaggcccauuggacccaccauugugucuuaugcacuuagcauaguuugucugguaugcaauagauauuugagaauguggugugccagcugauuuacugacugaauucuggagcauuguuuuccucauuuguaaaauucggggauuggaauaugugauucguaagaacuuuugcagcucuaaaaugcugugaaauucaauagauuuccugugaauucucaagucuauauauauuuucuagugugauaacauuguauuugcaguguuuuucauguagaauaaaguauaaguuuaauauauaaauguuaucauuaauccagaagauuuaguaauguuggcaauaggaggaguauuuucagaaggauuuuucuuacuguuacuuaacugauauuuuggaggaaaaugaagaauaaaagcucuaacagugacauuauagaauuuagguagaaauuaagagggaguugauauuuagggcugaaaaagagagggccaaccuuucuagagaaagaucgaugauuaguuuuugguuguaguuuugguaagaaugcaaaguaauuuuaagcaauauuuguccuguuugagaaaaugcuaacauaucacaaauuguuuauuaucugucaaacuguggaaaagaaauuaaagaaguuugagauuuuaacuugcagcuguuucugauuuguacuuuucucuuagcaugaagacugaggcagucaccauuccugagagccaaaaaagggccgucuucagccuucugagggaagagcuauucauugaugucagagccauggcauagccagacacuuuccauagcuuugagaaucuauucuugacagucaguuuuaguuuuagacuguuuugauugucaaguacaacucagaaguuuuguaugugucacuuuccauagcuuucagaauuuauucuuuacaaucaguuuuaguuuuagauuguuuggauugucaaguaaaacuuagaauuuuuuuuuauuuuaugaguaggguaauaauuuauacuuagauuuaauuucaaagaaccguuuguggcuaauaagauauuuucaaacuuuuuuaguaauugauaggaacuucguuuugagcauauaacauuuguuuuauguccugcauuugauauuacugcuuugaagugagagcaacuguaucuuaaauacuuagguguagucucuuaacguguguuaccucuuuuaauccucuucauaguuaacuguuuuauaaauugggggccugcuuugaagagauuaaguaacuuaaacagguucacccguccagguaugugucacuccaaagcaggagcaguuucugugacccuauggcugccucucugcaaccauuaaaagguuuuuuuuguuuuuuuguuuuugcccuucaacaaguuuuggcauagguuaagagaaauauagacuauauugcguuuucuguaguaucucauauggcauacuuauucauuuggugaucaguaaauacuuguugaauuaaacuggggcacuugcuauguuccuuaaaagaaguggcaucaauaaggaagaauuaaguacuguugcagaagcucaccagaugauucugauguauccauccacuuaccaaauaguuguugaaugaacuggaaaauuuucagauuuaagauaugauuggcauauacuuuuucauaucaucaaauacauccaucaagccaugagauggguagacccucauuguacagauguggaaauguucaccaacauuagccagcacaccccccauaucugccccaacccucaaguuuccuugauuauuuuauguaugugcgauaaugugugauacuacuacuacauaaacuguaaagggccauauauauguuccccuuuauuaccugacuauugcuaacagcagaacacauaguguaggcaugaaaggaaggcuacauagccaucuuguuuuaucugaaaaccaguguuuuaaucgaacagguuacuuguuaguacuuacauauugacuuagaaguugauaaagauuucauuuaugcuuguguugcucaguuuuuguaugauaacugugaaaacaguagcaaauucaaauugacagucauuugucauaaccuccuuaauggaacuguccugcuuggaauuucccacuucugggaaugauaagcaauaggaaugauuucuuucauaguaccugauuaagauaaaguggccuucaucauaaagacguguaaagaaaacuaagcaaauguagaggcugacagauauuuguagagggcaucccagcauuggcaguccagccugagaagagacaggaugaccuccagggugcuuucuggcuccagaccugugaucaagaguccauaagcauagcugauugagcacugaaaguagugauuaccagagaaaccaauguuuaaugaaaagugaaaauucuugacauuguagaaaugauuauuuaugccuauauacauagagaaaucccaguaauauuuucucaacuauguacagaauuaguucagguuauauaguucuugucaugaucuuagggccaaauuauucccauaggaguaaaguacauauucaauuguauuauuuaaauuggagaaaaaaauuuauguaaagaaaguuaccuuaugccauuuuagaaccucugcuauuuaaaguaagucaccuguuguaugaauuuguaauguggcuuauugauuuuucuaggaugcauauuuuuaaagagcagaauaagcuucugcuuucaggaauucagccuaguauuucaaaugagagcucauguauugcaacauuauuuaucuauuuuuguaaagggcuguuaaucacuuggugccacccugucugaguugugugcuuguagauuguucacaugaaaucacuugauauggcaucucauuucugcaagaauuuuuucuguauuuuuagcccaccagccuagcaugaaguuaaauuauuuaauagaaauauuuagagaccagaagcuuacuuuuaauuuugcgaauguugccuuacccuuuuuggaauagguuacuguuuaaaaacgugucgauguaguuaugcaauauaauucauuuauccuaccuuuggccaaaacacacacacacacacacacacauacacacacucaugcucacacacucaugcucacacacacuuauucugucucucucucuccuucuccuucccucccucucagcuauuucugagcacagagucuuuuguuuaaaagagggauuaguaugucaaauuuguuucuauauuguauuucuggguuugaaguuuuacuggauacuugguuuuugguaaggcugucauuuaaugccucuugaauuauucugcaggaguauuagcaagaguuguaaaccggaguucauaugugaaaugugagacugugaccucuugauccagaggccaggacuguugccaacugaaccaaacccuuccuuuuccuaagaauagaagugcucugccuaaugauuggaguucagcucaguguuuuugguguucuccaguaauugguuagaaucucaccaauuguguuuugaguggccaagcaaguauuucuuuguagggauaaagagagguacaaugugaauaauuucuuuaaagaguucaugaaggaauucugguauaucagaaauaccacugauauguaugaccugccucugcuccugccccauagaaguugcuaucaaauguggaaagacacuguggaaagaaguguccauuuuuaauguuaaauguaaccaauuugauaagaaaccuauaauaauuguaucaucuaggucucuaauacuugaaaacuuaaguucuauaaauuauaaauauugaacugagaaaaaaauugaagguaaaagacguuauuaggacaaagaauuagguuauuugugaggcaguaaauguaaaauguugacuguauuuuauaaccuauuaguuugaacuguucaaaaucagaacauagugagcuucacaaguuuucaucuuauggacaggauuaauaauacuucauaaauucacuauucccauucucagauccaagaugccuuauauauauuucuacuuuccuuacuccuuugcucacucauuuugcucauuggacuuuccaguauuugcaguguuuugauuccugacugucuugaagucuuucaggacaaaaguggcuaugaagcugcugucugccagagagacuaaaagagaagcccucuucuuugacccagauaguaaagauagaucauuugaucaaaauucaguuaggucaaguuaguuaagucagaaugucaaggaaucaguuuaguuaguuaaguuaguuaaauuacauauaaguaauguacuuggacaagucauagaacgaugaccuacagauuaagguccauagccuggccccauaucaccuuucuagccucaucucucccucccucuuuuuuaauuaauaaaagacaaauagagacagggucucacuauguuggcuagguuagucuugaacucuuggccccaagcaauccucacaccuagaccucccaaagugcgaggguuacaggcgugagccaccacacccggccucuagccucaucugcaucugccaucucuccuccucacuccucucuccugccugugagacaccaccaauuggauguacugaagagaugcaccucuuuuacauguuguauauucaugcaugcauugguagcauuguaaaugcucuuuacuacuucagcuacuuacccugagaaggucuuacacaccccucauuuuuacuuuaucguuuaaggcucucagaucuaacucaaaugugucaccaucuuuuuccuguagcucguacuaauaacauuugaaccccucccuuaucccaacuucuguagcauuacuuuacucauuuuuauuccuauagcauuuccucaacucuaauaugucuauuuuuuacauuuuaaccucugaaauuaggguacuucuuacaauucaugggaucuuaguuuugauuaaacaagguacuuccauucugguggagaauugagauucugugcuugccuugcuucuggaacuuucauucuuggguccauaucucuaauuccucuuccagcacgacaacuaauaauuugugcucaaauguugcuaaauggaauuaaaauacugugucuggcuuuuacuauauucaggggaauuucaagggcaugauuuguucugaaaucuaucaauaauaacaauaaugauuagcauuuagagagucuuuauuuugugcuaggcacugcuuuaauuccuuuaucuggaguaacucagugagucuucacaguaacucuguuaucucuauuuuauuuuugagaaagcuaggguacaguucagccaaaaucguagaacuaauaaguggcacacuuaggauucuagcucuguuaaucuggcaccaaaguccacguaaccacuguuauauacuaaaauguauuugaauguuuauuuaaccagcucugcgcuuugugcuuuagcugcauuuuuuaauguaauccucauuauagccacaugaggauuuauaguguaguaugccagaacacuccaguagucaucuuuagauguaaauucuagucucuauucugauacuaugaagagauaaacauauuauaguaaauuucuacauguacaugcgggaguuugagggcuaauaagaugaucuuucuagucuuuucuaccuuuugaaaucauuaaauuuaauugcugaaauaaauccagacucugguggaaaugaacuaacauugagcaccuuuuaugcuuaaggcaggugcgcauuaucccuauuuacagaugaggaaaagaaguucaaagaugaaauaauaugaccaacuuauugaacaagaaguacaggcagaaucuguuucagcauugaaucuccaccccugaggauggcuucuacacaggcagagccucugugauauuauuuuuauuuuugggguuuuuaggaaaucuuuuuucuccaccauuuuuuuauuucaccauuaaguuaucuuaaaaccaggucauuagcugucuuuugcuuacguauuuuaguuauuuucaacagcuuuuacuaaacauuucguaaccauguacauauuacuuaauauuaaccacaccauuucucugucaucuauaccacaggcuuuaaaaacuggcauauuagagauauuagaaugauagucaugugaaaggagaagaaaaugucuacuauguagauuuuagaaauuauuggaguauauuguggaaguuaaaguuauagaaaggauuuugaaagcaucuuugaauuuucuagcauuguguuagcuuuaugacuauccuugguuauuuagaauaauuaacacagaguagucuauauuagacacuuaagaauuuugaaugcuuuuacucuguuuuaaaauucuagccaguuucauaacaugaaauuaauagagcaugcuuaaaauugggaaacuuugguguuucuuaguugacuuguaagagauugcagcuuugaucucuaagcugcaaguaaacaucugacuugucuauaaacacaugguuucaaggcuuugggggagccuaagaagaucauugguuugaaagcugaaauaaguguacauuuaugacacuuguguuucugcaaaaagagaagcuuuggauuaaguuuaucugagaaauguugugugauagacaagaacugaaaaaaacaagagcuaugacaaagacuuaggugguuuaguggugguucacucaguucaauaaaucccguguacuuaacgugugcuacacacugaugguuuuuggauggcauuaaugugccuaguuuaaggauuccaugagaguucaugauacucaguauuggugucaacuuggggguaaccauacagcacuagaaucauuauaaaguauuuauucaauauauuuuuaagauauuauuucucuuacuguucucuggacaagacaucaguaucugaaaugccuuuccucaccuucugucuguucuuggucauuauaucaaucuacuuuuaagaacauauacaaauuaugcuuuuuauugcacauguagagauuuaauauaggaggaaauguuugaaaguauauaaaagccaaaagaacaaauaaaugaucucauaaccgauugauaacuuauuggcuguauauuuucagacuguuuaacuauaaucuuuuaauauugccaaacaguucucuaguacaguuauaacuauuuguuguuccacuagcugcaaaugauagauagagccuauuaaaauauuacuuuuuuacugcuuugugugguauucugauaucuuuuaccucuucauguguugcuauguaguuuuuguugguuacaguuugaaauaugaguuccuuuugcuuauuaaagugacauuucugggcaaaacaccauacuggaggauuuggaggaaaucuugaaauuguuccuaaaggcaacaaauugaagauauauuaaugcuauguaaccugagcacauuuagauaggagaucaccagccauuggagucaaucugcaacuuccugaacaggcauguuuuggagccaggcuuugaagaagcuguaggauaagagaaggaagagacaugguuuguacagggagauggaauaagauggguaugauauguaugcuggauuagaaauugauaggauaccuucaagagagaaaagaagcuagugagauaaaggguucaaaaugaauguuaagccaggagauggaugaaagaggaaggcagauuuauugucaagggaggggaaagacuaacaucaguuauguuuaagggaagcuggccuagcaauuuacauggaaguggcuugugauacagggaguauaguuuaagucuuuuaagguauaugugaaaugauuggccaaacuuguuauugcugaguauagaaaguaaaaacagaaaugguauguaaauaacuuaauauugcuuuugugaucauggaaaaguaggaaggauuuguuugggaaaggaacgaugaauaccuuuguuuucaguuacauaaaagauuaaauuaauuuuccuccucuuucuuguucuguugcaacuuuggacuccaguuggagacuggaucucccuuauucuguaccugacaucaccuggcaugaugacuuugcucauaguuguugcucaggaacauucauuaacuaauugcguauaugaagaaauauagauuacuggaguaugucuuuccacugcucuacugauauuugcuaaaaaagagauuuugaguagugugcuuuuuuuuuuuuuuuuuuuuuuuuuuugagacagucuugcucuguggcccaggcuggaauguaguggcgcuaucucggcuccuugcaacuuccgucuaguggauucaagcgauucuccugccucagccuccugauuagcugggauuacaggcaugugccaccaugccuggcuaauuuuguauuuuuacuagagacgagguuucaccauguuggccaggcuggucuugaacuccugagcucaggugauccucccgccucggcuucccaaagugcugggauuacaggugugagccacugcgcccagccugcuuacuacuuugcacagaaauuagaaguaucauuuuagcaucccuugucuuuugucugccaaucaagaaguuucagaauguuuugaucuuuggccaaguaaaguauugccagucagugucuugggagauuuuaaagugaugacguagugcuuaguuaucuuacauagcaaauuguugagauauaaaauauauuaucaaauaguucaguuaccaauuaagccugcauuauauaauguaugugauuaucuaaugguuucacccaaaucuuuuucucccuuuaaaugacauccucgaguguagggauucuaucuuguacuacucauuuuuuagcccccacaugucuauagcauuguguauggcuuacaguaacuuaaaaaaauguguguuggcuuaauuuaugcuuuaaaccuuaaaacauguuaaaaauauauugucauauuaagaauauuaauagaaccuugucaaaaaauuuuuacacaugcaaaucuuuuuucagugaaaacauacauacaaaugguuuuuuuuuuuuuuuuuggagacagucuugcucugucacucauacuggagugcauuggcauaaucuuggcucacugcagucucugccuccuagguucaagugauucuccugccucaccuuccugaguagcuaggauuacaggugugcaccaccaugccgaacuaauuuuuguauuuuuaguagagacaggguuucaccauguuggccaggcuggucucaaaugccugaccccgugguugcuggucucgaaugccugaccccgugauuugcccaccucagccucccaaagugcugggauuacaggcgucagccaccacgccuggcugaacauggucuuuauucuuaagacuagaauaguacuucucaacaagggaugauuuugucccuuuccuuccuggguacauuuggcuaugucugaagacauauuugguugcuagaaucauguuaagcccuuuuucagccagugggguuuagcugaaauguacuuggguucucucauuuaagugguacagaaaucauaccucuguaauuuagcccaugguuuccccuugccucucuuucaagaaugcuucuccagucucuccagcuggcuaauuuuauagauuauucagcauugccuucagaggcugucaccuuuauguguccuccucuguaucacuagguuguaccaagaaccuuuccauaaacacccuaaaccuuuuucuauccucuaucauuuuauauucauuuauagaucauuuuauauucauuucuaaccucugucauuuuauauucaaguuguaucuuuauggaucuuucccacuagaagauaagcuccuccaagucagggauuauguguuauucauuuugaugucagcaguacuuggcacuuaguagguguucaguaagugcuuuagacaaacuguagcucagauaauauuguuuggcuuagguuuagugcgguuuuuuuggugguauggagaggguugggauuguggagagagaagcugauugacaggagacuugaguucuaguucugccucuacgacccauuagugccaucaccucaggcaugguugagugaccauuaugaguuuuaauuauguacagagugagggaggauugggcuacaagguuaagaggagcacucaucccauaagcuguguaucacagcucacuuaacugaggccagacaaccuuauugaacacagcuguguguccaggaauaaacagaagaggcuucaguguaacugccagauauuuuccccauaacuuaagacagcagauuagaaacaguaguuaauaggaaaugcccaacaccugggaguccaaaugaagagguccuuucacuuaucugugaaggaacuuuuggccuauacugucuuuauugauggccuggauaagugaacuauuauuguauucaaucugguucacauauagucuucaguaaccauuucucaccgcuaaugaaaagcuaucuguaagaugcugaugaaacagcuuuguagugacuuguuucucaaccucugaggcauugaccugaaaguaaucauagaugcucuucuaccagugaccccgauguuagcaguuguuggggaggugacacauaaggcaguggccaugcgacuuucacucuggccucuguagauucgccucgauuugagagguaagucuggguuuugucuagggaaagccaggcuacucuguaagucugaaaauauguguuuuagucuuauugugggcccuuaauuaaauguccauuucuuuguguauaaaaugaaacaguuggucagguggucuccaaguuucuuucugacauuguauucuucugugugaguuugcccuucgauuucagcaauucuguuauuuuuauuugcuuaaucaccaaaugaagccauucaaaagguuaaacuauuaaguguuucaaaagauucagauuaugccuggaacauagcugaguaaucugaauauauuuuaguguuugccucaauuaguagaaguaaguugugcuguccuuggguaauuaaagggaaacuuaacagccuuucuuggaaauauauguauucuggguuuuuccucaaaaaugcaggagaggaccauugguucuguuagcugcuguguggaggcugagagagcuuagggaaaccuucccaagagcggacauuugagcuguccucaaagacuugacaggagaggaguggggaugggaaaggaauugaaggcggagauacugugugaacaagggcauggagacaugacguagugaucuacggcugaaguuuccuuucaggugugaaguguuuuuuauauuuugagaacuuugaaauuuuccuuuucucuuagauuuuaaucacaucuccauguggacuucaucuuuauagacugagguguuccaauuccaguuaggccuagucuuuguuccaucccuuaagccauuuucauaguucaucuuuuguguagcaguuacauaugucaguuuugagcaauagugaccaaaauuuuccacaguaucacagauaugagugauucacagaugguuaaagucacugcgcacucuuccacugcuccuccccaccacaguuguaguggacaaaacauuuuaugaaaacucuuacauguauagaacuuugucuucuuuuuaaaaaggauagcagagaaaucaucuuucuuuuauaauucuuagguaugucagucuucucaccuuaaaaugcaagaguguuuucugauacagcauugaaguaucaguuauuuucuauguguuuauuauaugugaauuagaaauucaaugaagugaguucuguggauaaccaaauugaguuccugcuucaggaaccuuucucaguaauuauuaaucuuuuuaguuauuggaagaauuuugaaaagaauuucaaugaaacuccuaauauauuugcuguacucaauuaucuuucuuccaauuuaguaaacagccuuuuuacuaacuuuuuagauuccgagagcuugaguuuguucuuagugagcugcuaggcaauugacaucugacaucuuaaugggagacuagaauaauauuccucuccauacagaggaacucuuaaaaaaaaaaaaaucuguaagaccuagaaaccugugaacccaccuucuguguaauccucauguaacacuaaagauccagccugcuagcaugggucucauagauugaggcagucucuaagugaucauguuacuuaauauuuacaguauaaccuuuuuauuaauuucuuuuuaaugaccaugacugugacuauuaguaacauuuucuaccaguagccauaaaaaucccccucaaaaaggugauaauauauuucauaguauaauggaauuucauagucauuuaacuugagagguucaaagaagaaagcuguauuuucacugacaggaucacauuucaauugcaacuuaacagaaagcaaguugaauccuaguuuucagccugaacaaauguucugauucuggugaacuagggaauuuaaaauaucuuuauaugauuauaccacaacuguguucucuugcuuucucucuguaaacauguuaaauccagaggagacagaagggaagacauuuaaucuguauuuguaauuugguauugaaagacuacugacucuucuaaguaagccaguccuguaagcaugauuuguaugagugucuagcauuuauuuucuuuaaaaaaaaauuacacaugcauguguauauauauauguguguauauacauacauacagagaaaaacacagcauguuauaaucauacaaagagauauuaauggauggaagaaugaugggugacuauugcaagaauuuuuggccaugauugaaagaaucccaccacucuuuugccacauacgaaauccacagaucugguaagccaccuuaauaucugucauaguccuacguguaaaacuuauucacuaauuuauuauuaucaccaguaaccuuuauuuagccaaggguucccuuacuuacuuuaaauuacuuuguuacuuauugguaauuuaacacccaauguguuacuaacaguugaaaacuugaauguugccauaaauacgcaauggauaugguuucagguuuguagcuaaguaugauucccucacagcagacaugugagccaaaagacugaacaguguugacaucagauauuauuuuauuuacuuuaaaacugguuauauggauaacauacuuuguuuugcacaacacaguaggcagucaauaggugaaguauuuguuccuguuuaaugguggccuguuauauaucacagcugcugaagcagagguucagaaaagucaaauuacuucacugagauuggguaaccuaacucccaacuuaaauaaaucuaaugccuuucuaccacuguccugcccucuuuucugauuguggaaggcccugaaagcauuaccaaaguuucaaaguuaccuaaauaacauuuccuaaaaaugacaucuaacgaauaaugaaacaucaaaguaaaauagauuuuuuauaucauuuaaugaguaguuaagacuagguaagacucugugcuuaguaucuauuuguauggaaaccaucucauuauuugacauacauuacguauagaauauguaacaguuaaauuguuuuauguuuuggggccccuccccaaguuauuuugcuaacuuacaauaugaaucuuuguagaugauugaagacauucuguaguguuaccaaacuuguuaaaaguaagugguaaagaacacagaagguuccuugacuguuuguauuauuuucaucaaaauggcuggaggaggaguggguggugucagcaguuuacguuacaaguuccauauacacuuuauuuugaugaagaccauuugcccacuuugcuaagaagcguuuaguguggauuuuccugacucuuuuccuggugauuuacccuuugggaaauguuucccucgcuguuagacuuguguuguaauaauauuuuggguggccgaagcccuguuauguuguuaacaguugaaaauuugaaugucaccauaaauauacagugaaugugguuccagauuuguaacuagauucccucacuguagucguaugagccagccgacugaacagauccuuauuuggaagccacuggugucugauguggccacagaacacugauuauaacuuuguuugacugccuaaaccugucuuccuuccugguccuugguugagggcauuacuccuaagucaugucaugacaaaugaggucagaguugguacccaucacauuuguuucaucuucacaguuuuuuuuuuauucugugccuagacugacaauuauaaaaugaaaagauaauacugccaaugucuguaaccuauauaagaaaguucacuucuuuuugacaucugacauguaguaguuccauuuaaaauaguauuuguucaggaaugucaguuuaagcaaaacaguagaauaugagaaaaccaccaaccaucuuuugaagagguugaauugcuauuuuggcucuuuuggguaaauaaaugucuuacuguauguaaagaucugagauuaugaaagaacauguaaaauugcuaggucaauuauuuuccugaaauaacuguuguuauucauaaaaauacccaggugcuaauaagucugcccugcuaauuuugaugcagguuguuugggaaccacauuuugaaaaacacuuacagcagacuuucuguaacuaaaauuucucagggcuguuuuaaaauauuucuuuauuuuuaguucugccauuucucuuuuuuugccuuuucccuguaaggugauuauuacgaaaagagcuagguggaccuuaucauuggaauucuagucuuuguuuucaguucauacucuaaugacaucuguuguuuucuauaucaugaaaucaggacaaauacaauuuuugaacuuuugggaggaauauucucagucacuauggcauuaggaaaagauguucaauuuugcugaacguaacuucagguacacgccauuugggaucaagauugagagaacugugcuugcuucaggaagccuccacuugagcuuuggcauuauucucauggcugguccauccucacccuuuccuuagggaauaaucauuucccaggggagauguauuauauauaaacaugucagcaugucacuuuuuuugucaacauguuuaaguuguguuuaaauugguuucaugcuugcgggcaaauguuaauuuuaucaaaccuaaagcuauagggucagauuauagugugguguacaguuuguagacuuauaauaaauggucauguuugcuuuuauguauuucugcucauacuuguucauaauuuuaacucauuaacagccuucagugauagcuuaauuauuuaaauuucaauuuaagauucugauauccuguagugcagaaaccauauuaucauagaggcaaaauguuuacgucuucucaugcaugucaaggaaauauaguauaugcauaaucacugaauuuuugagguucuagaaauaguccaccauggacauauacaaauauaaaaagccuauaguugugguuuaggaacuguggcucauggaaggauuagauugaacaauguaucauuguuccuagagucaguuaagcguguagguuuagcuaguuugggaacagccucuagcaugugacucuauaacacuugcacaacaaacaugggccugauaagugagcaguaaaucugggcugacugcccacucccaguacugccaucauaguauuuugagggccugacaacaauauuaaaagcuuaaaacauucuucacaccguuuuguauuauuccugguuuuccaguuuuauuguuuacuaaaagucaauuuuucuuaauaaaaaaagauuguuuaguuggucauuugauuucucauuagauacuaggcuuugugaggucuuacauauauuuaaguucaaguuuucucacuuuucuucagggaagugggugacuugguuguccugaugucucuuuugggcacauaaagcacauuuuugucauguuaucuuuguucacuuuuaucagaaaaaauucagugucugagcaggucacuaucaucaaaagugcauguuuggguuuuuuucucuuuuccccuuacaacacaaugaagacagucuuaaagguguguuaggggcuuaaacacuugacagcugcauuuuuaaaaaaguuucuaauuaugguauuuggaguguccauaaaaagcuucuauuuauaacguuuguagauuauauuaaauuccuaacgccuaauuugugccaucugacaucacgaaaucuuagcagacuuggaaggaaccaguuuguuagguagcugugcacagguacaaacgauuuaagauuacacuccugggauuuugugaaaaaucgguuuuacaaguuuuuuaguuuagaagaaacauauuuucaaaaauggauuaagaaaagaggacaaaagauacaauauaguuagguuuaaguuuaaaaacaguuucauucuacugauacuaguucuagauuuuaaccaagauggaaucauuuuacaaauugagaguuucagagguugcuuaacuccucagauuagugguuuuugcuuuaucauggacacaaaauauuuacccuccaggcauaugucguucuuaaaacaauguuguaggugaucaaaucucaaaguaguaucuaaggcagugcuucucaaacuucaacgaacauacagaggaucucauuaaacuauagauucuucaucaguggguuggguggagccugaguuucugcaguuuuaacuagcuccugggugugcucagugcugcuggcccaaggcccacacucuugaauagcagggguaugaaagaauugauaguauccauucuuugaaguuuccaaaccuuaucacaguaccaguaucaauguuaaucucuuucuuaguauauuauuuuuaguuauuuauuuuacuaaccuacaugagcacuaaccuccuacuagugcuuucacaaauuagcauuauaaaauuauaauccuaaacuuugaagauagguauaagaaagucaucaguguuuucauuacuauaaagcccauuuugauuauguuguucaguguuccuuaaauaaggguuauagauucagcauuugaaaauaaaacacacaaucaagaauuugaaguguguuuuagaauuuauuaggaugagcuuuggcuaaugcuuaagaaauauuguuuauucuuugcuuugguuuauauugacagaaccgacuaucuuauggcuuaaguaaaaauugauuguauggaaagguuuuuagcaauuaauauuuugcggcauuugguuauagggaugagauuuuuauuuuauuuccaaauuauuauguuguuccccuuccccuaggagccaauauagucuacacuugcugaguuccuuuucuaguucauucucugucucucucuguuuguuuguuuguguuuguuuuugcuggcgagguguuuauugacagguuguggugccgcacagguccucaaagcccagccagccagcagguacccagggcgcagugcucagccugcagcaggagggucuccguucacauguccaggcuucugguuaauucuuucccuaagcugauagcucucugcagguugaaguaacgguccagaaacauuuuuaucauuucuguuccuugccuucaaaccuguggcaucuaccuacugcaucucuucauuacuuauuggugaaaaccaaacuccuauuaaagcucuuaaacuagaccugucaucuucacuuaacugaacucuuaucucauuuuuaacaaaacauauucuuggcccauucaccaugaaguuuuuccuauuuuaaauauugggguagcaacagaaugaaauuuuugagggcuuuuugcguaccaggagucacaguccugguugcuuuuauauauguuacugaauuuaauuaccucaacccuggaaaguaaguaaauaaaucagucccacuuuauugaagguagagcagauugauaaaaauugcccacacaauccagauugucauuggcagagcugggauuguaauauacaucugcuugacuuuucuuuuccacagaggagucuuccaaaaggaggaggcuucugggucuuuaaaagguuggauagaaauuaggugcuuugugggccaguuggggaaaagauuaccccuggaggaagaguagcgucaagaaauguaucagacauuucaaaagaaucaaaaaucuauauuaaauuuguauagcugacaaaaccugauuuacauaaaggauuuuuuuuuuuuuuuuuuuuuugagccagaguuuuguucuuguugcccaggcuggagugcaauggcgugaucuuggcucaucgcaaccucugcccccuggguuuaagcgauucuccugccuuagccucccgaguagcugggauuacaggcgugugccaccaugccuggcuaauucuguguuuuuaguaaagacaggguucuuccauguuggucaggcuggucuugaacucccaacuucaggugguccgcccgccuuggccucccaaagagcugggauuacaggcgugagccacugcgccuggcccagcauauuuuuuuaagcuucaaaccaccaacuuaaagguguagaaauaguaagcauaauaccgccauaaccaguuuaucucuuuaccagugcuaucaguuaacaaaucaugaacauuguguauuauguauauuacauguagcuuucuguucugacagcagaguuuaugugcuaguucuggauucgucuuaauagaugauuugaaaaagaaagcauuuaaaaggauucucuguaaaaauucuacucggcuaguagcaaacuuaucauuuuagaaaaaccguuuuuuacuuugagaccaguaagauggagugacaagaacucccaagccagaagcuaaaagacguguuuuuauuccugguaaugccacauaacuggaauuggcaguugccaguaguacgagaauuugcuuaacuuucaccagccaaugaaguuauuugcuugcuuucuuaccuccuauuacaguggaagcaaugcuuguauccuauuccuuccugcucucugaaggaugacugugccccaucaauaaucccuuugcacaucuucagcuacucuguguucacauuuaaacacuuguaucccuuccucuugaaaaaacaagaacucauaaccaccuauuuagcuuuuuauuuccugugcacaacuaaauuugucugcuucuuuacuuccuacucacuguacucucacugucccucuaaaauggcucuuggccagugucaccaauaauuucuuucuuuuuuuuuuuuuuuuuuuuuuuuugagauggaaucuggcucuguugcccaggcuggagugcaguggugccaucucggcucacugcaaguuccgccucccagguucucgccauucuccugccucagccucccugaggagcugggacuacaggcgcccgccaccacgccuggcuaauuuuuugguauuuuuaguagagaugggguuucaccguguuagccaggauggucucgaucuccugaccuugugaucugcccgccucggccucccagagucuuucuguguacuuucacuacacacacacacacacacacacacacacacacacacacacacuaaacaauuagccuuguccaauacauacuguuuuauaaccuauuuuuaaaaacuguauuauuaauauuuuuucauauuauauguucuucuaaaacauuuucagcagcugcauacaguccaucauauauauccauguuuaaccaauucccuaucauuaaauguuaacuggcuuucaaaugcuugcuguaauaaaugauacugaagagauguuuauauauaaggguuuuauuacuucuggcuauuaaugcaggauacuuuuuaagguaguuuuauuuguauaauauaucuaguuuuucuuucauugaaacaaugaaacuuugcuacaagaaaacuuaguacuuauugcaaguuuguaugucagauaacgugcuagaugccuugcagucuuacauuucaugguauuuagcuguuuuaauucccaacuuuauagauuaagaaaucuauauguauacauguauuucucaguaaguuaacaauuauguagaaaauguucagcaaacaucaaagggcuuuguguaagaacauguuauucaggagccacaggggaaaaugaaaacuuacagaugaaguuuaaaguucugcuuuggcuuuggaguauguaagaagaugacuuuugggguuuugugguguuuuaccuuaaaaaggcguuuuaggccuaaaaauuauguuauuuggcauucuuaucucuaggagaaaauaaguguaugaauuucuuaugaaucuuggguuuuagucauaugguuacucuuuuaguuuacaaacuacauuguaucuuugcauuagaagggguaauaauuaucuuaauaguugaagaugauuuccuuucacuuaaaauuccaggcauaacuuuuucagauguugcacuuguaagaucuaagaguugaaaguugagugauuuaagggugaaaaaugucuguugcagagggaggcuggugggagcagugagaugcugugacuuaaugcuuuuacagagcucgcuuggcacccuuugauuaugagcccacaagauaagaauuguuuuuggaaccugguauuuguuuccuaaugcagugguuuguuuugucuuagucacaucgaucagacaacaacauggcaggaccccaggaaggccaugcugucccagaugaacgucacagcccccaccaguccaccagugcagcagaauaugaugaacucggcuucaggugagugagacacuguaauuacagcacauggaguaaugcuuacgcauugguaaaaguugauguggaaaauagucauuacucguuuacagaaacugggacauggugauguuuauugucucuccaguuucauacagaagacauagucuauuuuaaaauaacguaagcuauauuauugccuuguauaguuguuaacgcauaagggggccgauaacugaaagccagugguucuuuaagauuugguucugaagcggguaucucaaauuuguaguucuguuaauuuugacguauuugguuuuauucugcugcuuucuugugucucagguauuugaguugaauuuacccucuucccuuugugguuuggauggaaagccaagcuauaguguucuuauuuuuuauuauuauuauuuuuuuuuucauuuuuuuuuuuugcuaugguguucuuaacccaacuuuuaaugugguguuauucauucuacucugaaaauaucuggaaggcaguaacuuuuguaaacccaaaagaauauuucuuauucccagggcaagcauggauuauuaaacgcaucuucaccuuuuuuacuagaagauaaaccugaguauaaaucuuuuucuaccucuuauuuggcaauuuacuugaauaugcaguuuuucucaucuacauaauggggaguaacagugccccuuaugauagaagggaagauaugaaaggaaauaauacaauuuauaugaagccucuaguaauuacagaguagguacuaagugaaaguuuagccccuucaucuuccuuaucacauacugucuggcgucuuucuccuuuguuagguggguucaaggccacaguuagcccauuauguaccuuuguacauauuaggaaaaggugcccuuccucugggaagauguaacauugugccuggcaucagagauuggagcauuugggcuggauuucugaccacuccccuggcccccacgcuuuaccccgcugcucagugcccagguucaggacacagauggcaacaauaguauguggcagcucuaguagacuugauggcuuucuccaccgcccaugcauuuucccuagauaacaagcauauuuaguagcuacacaguagauuucuuaaacagcagucuuuggcaagggacuguugugguugggugggaagggugguaccauuaguugacaggaggguuccuugacuaggcgaauucacagaacuugaaauguccuucugccccucgugcuggaauguuucugcuguuacauaccucugcucuugcuuuugguggguugaacauuugaguucuaaagaguuaagaguggaaaacaaagaaaauggcaacauuugugauugggcuuuucuugacauagacuuuaaauucugaagaaaaauuccuuaaaucuaaauuuaacucauuauacuacgaauacauucucagaaucucuuuuauaugugacacuuaaguaaaaauuuuuuuuuuuuuuuuuuauugagacggagucucacucugucacccaggcuggagugcaauggcauggucucagcucacugcaaccucugccucccagguucaagugauucucgcgccucagccucccgagcugguacuacaggcgccugccuccacacccagcuaauuuuuguauuuguaguagagacgggguuucacuauguuggccaggcuggucucaaacuccugaccuugugaucugcccaccuuggccucccaaagugcugggauaacaggcgugagccaccaugccuggccccuaauuaaaaaaauuuuaagacaaaaauuguacaaauauuaauauuuuuacuuggcaacuauuauguuuuuuuauuaccaaauuuucaaauaaaguugugaaaucugcccuguauuuaugguuaaacaagaugauucacauuauucauuuugucaugcuccaucuaaaaauuaucucggcaguuaaugacagauaacauuaauuuaaacuuuauuuuggaagaguaaguauuucgcgucuaacaagguugauuguaauucuuuuagaacauugcuuugguuguguccuauuauguuuucugauggugauggucuagagaaaugagaguauuucggcugaaauuuaugcuuuaagucaaagguauguaucaacuugguuuuaguggguuuuuuuguuuuuuuucuuuuggauggaguuuugcucuuguagcccaggcuggagugcaauggcacgaucucagcucaccacaaccuccgccucccugguucaagugauucucuugccucagccuccugaguagcugggauuauaggaaugcgccaccacgcauggcuaauuuuguauuuuuaguagagaaggguuuucuccauguuggucaggcuggucuugaacucccaaccucaggugauccgccugucuucggccucccaaaguguugggauuacaggcaugagccaccauguccagccgguuuuaguggguuugaaaauaauuguggauguuuuauuucagcuguauguccugggcagguacaguggcucacaccuauaauuucagcacuuugggagaccaaggugggaggaucaguugagcccaggaguuugagacccgccugggaaacauggugaaaccuugucucuacaaaaaaaaaaaaauagucugucaugguggugcauaagugaagucucacccaguucucaggaggcugaggugggaggauggcuugagccugggaaauugaggcuacagugaccugugauugcaccaccauacuccagccuaggugauagagugggaccccaucuuaacaacaacaacaaaaauuuuugucuuguuuguaaaauaugaaauguuuuaauauauuacauaaaaauuaguaugcauauacaugucuaaauaauagagcuauauguaguaaagaggugacuuugacacaguuucaguggaguggcaaaaagcgugacuggaggguuaggagugagggggagaaggcauaaaggagaggguugugaggagagaguuggaagaaggaacugaaaugagaaaagccaccucugaagaggcuugagcauguuuacagcgugcuagaagguauuuaacaauaauaauaguauaauaauaauucuuauuuauauaccaggcauucagugaagguccauuuugcacugucucauuuaagaucccauguucuucacuguauguuaaccagggauaggauaacugacagauaggauaacugacagagcgaagccuccgauaaagcagaagcgacaaggaaccacuaacgaacguccuggaggcgcuauuuuuaaauacuauuaauaguagauaauauuggggaacugcuucuccagaaggugauggguguggagaugauguuuguuuaaggaggccuuguuucaaauaaaauacuguucacucaagagaagagaauauucaaagagagcacucgagguuauugccuuuuauggggacggucagacaguaugauggggaagggaagagacuagcugauggguccaaaaccaaaggcuuuuuaaaacauccgcaacacaucgauucuaggagucagucaaaacuuuccaaauuagagugaaguguuaucuuaaauauauaugaauucccagaaucagacaaguuuauaucuggauuauucugaauuuggucauauggagaccugcugaucaagugcugaggguacugauaauaucuuuacagcacaugccucuuuuuccucuaaauuacauacacuugucuguugucuuuucuuccauuucaguggaagcccaugguuuugacauguuuuggaaugaaugucacuguaaucuugauauaccucauguucacauaaaauagccguaacgucauguugacauguuaauaagguuucaguaagcaaaaggaugcucuucucuacuuggaaaaaugaucuuuuaaggaguuuuuaaaauguuagagacagugaacaaggacaacugugagagcauguaaguaaauuuugaggguauuuaauguaacaaagcagaaaauggcuuccgugaagcaggguaucuacagaaaaguuucacccugaagggagugucuucugagucugcuaacccgaagccuucacauaaaagagaaagcuacaccgugcuuuugaagcacucuacuggguuaaucaugcuaaaugcaacuugauuuacauuuuuauuacucauuauuuaauaaggacuuccucgcuuugcuuuuuuuugaaaaagaauucccaucauucauaauugaguccagcuucauguucugcucugagaucuuguuccucauccaacugcuuuccuuaagauacuguaauuuccucuagacuccccaaaccuguuuucugcauaauuuucaugguugacuaggaugaaagaucuuuuaagauucuuuccaauucuuaagauuuuaugaaacucuauuuuguuuucuaauuggcuuuagcaaaaaugaucaguauaauuaugcuuuuauaaguccuuuuucaaaauaugagguugaaaugguagauacuacauauagccuagagaccagugguuugugauugggcaaauuuccaaauaucuauaacugagaaucacccaaaacaaagaugcaccuggaaaagguucuagaggcaacacucaauacauccuuggaagaagauuaauuuauauucuuuaacugugccauuuaaguggcaggguaaaugacagcaagcuuugugaaagaauuugaaaggugaagaagaggaaaauggaaaaauaagaggaaauggaauaauguauuaagauaaugguuguacuuuacuuuauauuaaaauauucaauguauaaauauauguauaaauaagucuagucuauuaaauuacuugaggugaauguccuuugaaaguuaaaauuuauagcugggugcaguggcucaugccuguaaucccagaacuuugggaggccaagguggguggaucaugaggucaagagauugagaccacccuggccaacauggugaaaccccgucuccacuaaagauuuaaaaauuagcugagcauugguggugcacgccuguagucucagugacuccggaggcugaggcaggagaaucacuugaacccaggaggcggagguugcaaugagcugagauugugccacugcacuccagccuggugacagagcaagacuccaucucaaaaaaaaagucauaauuuauaaggcuggguguggucguucaugccuauaauccgagcacuuugagaagccaaggugggaggauugcuugagccuaggaguucaagaccagccugggcaacauagggagaccccaucuguauuaaaaauaaaaauaaaaauuagccaggcaugguggccacacaccuguggugcuagcaacuugggugacugagauuggaaggauagcuugagcccacgaggucaaggcugcagugagccauauuugcaccacugcauuccagccuggacaacagagugagacccugucucaaaaaaaaaguuauaauauaaauuaguuauuauauauaauagccuuuugaugccugcuuaggauccguaguuuuucuccccauauugagaguuagguaaacauuucaugauuuuuguguucagcauuagaaaagaaagcccuggggagugaaaagugauacuuccuuagcucuauguguaugauauauauuaaauuuuuaaauaguguacuuguuaacacugauccacaagauugcugaaucuucaagggacaguaaagucaaaguauauucugugauaauccagaaauaacuguaugacaaaugacuaggaucaauaaaaguuaugucuugauuuauauuaagcagaaucaacccauuuaucugcuuuugagaaauguacauuugauaacaacccaaagccuaaaugucuuauuacagguacauuuuagagaauucauuauuuauaugcuuuaaaguuagaaauuguugggauuuauuugacaguucccaacucuaccaauguagcacuuucagauuucucuauuaugaaaaacugugaggauuuccuaggaaauaccucaagauggguggagaaaaugcccucuugaucaugaaaggugauacguguuagaggaaugugcuaagcaccuuccuugaaguggggaaaaauguucagaagcaagcaaagugaguaguauagagcugccuuaagguuugccucuuguguucuccugccugccuguguaauaucucucagcacugaagaucaaaugagagauuguuaccaagaaaaaugagagagcuagaaaauagaugugaaauauaaaaaugauggguaaauuacacauugauuuagguuuuaacuuuaaaaagcacagagaggguaaagaugugagaaguugcagaaccaacaggguugagguguugguaauuccugcuuuaugugcuguaauucagaaacuuuaaaguuuuacuuuucaccuuugaaacugagagacaguuuacauuaaggguuaagaccaagggcucuggaaaucccauggaccugauuugaaucccaggcgucaucuauuguccaugaaaucuuggacaaguuacuguaucuaccuguauucuucacuuagaaaaaugagauaauaacucauagggcuguugugagcauuaaaugacagaauccauaucacauaguuaaaauguauuauuaauaguguacagugccugguauaaaugugauaaaauaaaugugaucugauauuuuagaauuuaaucaguuuguaauaccugguagccacuguuacuuuguuaaaaaucuguuaccacacuaucuuugaaguuauguuuaucucuguaggcuuuuuaucaucaaauugaggucauuggcucuuccaaguaguugguuccugauucuucuaaaaguucuggauuauuauaagauggaaauugucagucugaagucacaauauaugggaaaagacuauacuaacgggaaaccuaauagcagugaacuauaacaaagcccaaagucagagcaaugaagagauaguguauuugacuaguuacucucgggcuuguauuccaaauaccuuuuuuaaaaacuuuuaaaauaaaaacacuuauuuuuuuugaacaaaauugcuguuuucuuuuucccaucuagaaguucagguaaauuaagagaaauggcccuauaaaauggaaaaauaguauaaggaaaagcauaauaaucuggaaucaauauagccaauccuuaagaagcuugguuuguuuuauauagcuuguggcuugauuuauuugaugauuaaguuccugaaaaaugauaauauggaaacaaccaccauuuuucuuacuuaaaacuauggccaauccauuucauuuuaauaaaauaugccaauauggaauaugaugacuuaaauuuuuucuuuuugaaauaaaaaaaguaauucaguuauaauauccagcuugcaaauggcauuagcuuguaauuauuguaucuacucuaguaugggaguucuucugaagucuuuguuaaacccagugauggcugauaaaggcacuuucuaaucaucgcucuugacuuagcugcauaaugaagaugccacucgugucagggcaacuaauggcuuugauuuuacucugauggugagagccuuucacuucgucuccacugggaaucacucugauguuguuuaauuccagucaugauuuuuacaguauuaauuucuucauucuuuguuuaaagaaacccacauucauuaugcugagauguggguauauaauuacuuuguuuuucaguagcugcagaucaguauuuuuuuuaauagugccacauauuuuuaaaagauuauuucaguuugaguaucaugauuauccacaguaacuaucuaaaucucaaauguguugaggaguacuguguuuuguaugcuuaguuacaugcuugauuauuccagauaagguaauucuuuccuguccucuuugcuuuacuuuagagauuaucuucuaaaaagggggaaacauauagaaacucaagacuguugagugcucuugaccugaucuuagagcacagauaucaaauauuuuaaaaaauuuacuagaagccuuugaaguaaucauuugggauaguaaaguucauuuacauuuugaauguuauuaagauuuuaagguaggccgggugugguggcucacaccuauaaucccagcacuuuggaaggccgaggugggcacaucaccugaggucaggaguucaagaccagcuuggccaacauggugaaaccccgucucuacuaaaaauacaaaaauuagccagguaugauggugggugccuguaaucccagcuacucaggaggcugagacaggagaaucguuugaacucgggaggcagagguugcagagagcugagauuguaccacugcacuucagccugggauacagccagacucugucucaaaaaaaaaaaaaagaaaaaaaaaauuuagauccaugaguaucauuucuaccagcucucuuaauaaaugacuuauuacauauuggggcauaaaaauagaaguauuuguguucaacuuuucuucagugauuauuuguagauuuuuggaaacuuugcucagcuuuggaguagagagaaugagaaagagauuaaauuauuuccauuuaagaaccagcucaaaugccuguuuuauucucuugauaaguguuggaauauuauuuuugucuuucccacugauuucuaaauccuucugguuacucuauugcuacaauaauuuuaugacucauaggaggaauauuugugugaaagauuaagaugcuaauucuuuaaaaaugauauucauagacuaccauauauagucagcauaagugaaacagaauaaaucuugcaacaguacucacaguuuuccaaaauaagguuuucuuuugauguuaguaagguaaggaagugguaaaacuuucuuuagguuaaaaucuuaaugaaagguauuaauuugagcagucugaagucuaagugugcuauuuguuuuuccuucggcaaaacuuuacagaaagcuaaucuuuaauaaauaaacuuaguaaacuaacucuaagccauuucauugaguuaaaaucuaaaggacuuaaguggcacugaagaaagucugaagaguugcauauuaguaggcucacugagcuuguacuugaccuuuucuucuagaaaguucuuacagcuauaaccugacaaacaggaaaaugauuuuuuaagcaguuucauaguuuuaccuugagauaauaguauuuuucccuucuuaaaucauucauucuacaaauaucaaaugcccugcuuuauacuaugcccugugauugcagaaucaagcuaagacagacuuuuuuuauauuaccauaaaaaauguuauggcaggaccaggcgugguggcucacacuuguaaucccagcacuuugggaggccgaggcagguggaucaccugagguuaggaguucgagaccagcuuggccaacauggugaaaccccgucucuacuaaaaauacaaaaaguuaccuggguguuuggugccguuugccuguaaucccagcugcuugggaggcugacacaggagaauugcuugaaccugggaggcagaaguugcagugagcugagauugugucacuguaccccagccugggugacaagagcagaacuucuucucaaaaaaaaauaaaagaaaaaguuguggcagauguaugcacugagugcugagaaaguagagagagaggaacacaugagucaguaguggaaaggaagaacagugaagaauuuuuuuuuuuuuuuuuuuuuuuuuuuuggacacaggguguugcuccaccacccaggcuggagugcaguggcacgaucacagcucauugcagcuucaacuucacgggcucaagugauucucaugccucagccucccaaguagcugggacuacaggcauacggcaccaugcacagcguuuuuuuuuuuuuuuuuuugguagagacaaaaggugggcaugguaguguaugccuauagucccagcuuuuuggcagcuuuucuggggauuacaugugugagccaccacacucugccaagacuucuuuagggagguucauugauuucuuuauccaaauauugaauacaaacuaugugccaggcaugguucuaaguuaugagaacggauauacaaugagucagauauuaaaaguggaagaaagaaaaauagaccaguuauggucagagugauaggcuggggauggagggagaugauagcuuagauuaccuucuccagugcaggucucuguaauugacgucuuuugagcagagaucugaaugaacugagagugagagccaugugaauaucuggggaagggagagaaugcuucaugcauaacacaacagcccguucagaggcccugagacauguuuggggaacagcaaaaaggccacugcagcaugaacagagucugugaaaggcagaauggggcugcauuacaguggugcuuguagguuuugaacagaggagugacaugguaucaguaacuuuuuaaaaaauagggagauuacuuggagggcaguugcaguaacccagggagaggaugaccaaagugguggugaugaaagugauuggguugaggacuugaguacuaguggacgagugggaaguuaaguuagaagaaaagggaagauaaaaguagcuaguagaugggcaauuacuaagcccuggaaccucuaauaccauauugcuagugguaagaugaugagcaaugagacugaagaccaccucagaauggcuuugugucauaagcuaagaaguuugagccuuguccugaaaauguugggauaccauuaaaaaucuucuuuaggggucuucugcuaugguuuucccuauuuuuauuaucugaucauuugaauuuugaaauccaaauaucucauuuucuuauauuuaaagcuacuuccuuagguauaguauacaugaauuuuuaauguuuaauauaucauuggaccaaaaugguagaacuauucuaagaaagaguagggaacugacauuuaagcaccuacugggagccaugaccugugucaaacacguguuuuaauucucucaaugaucuauugaguguucaucucuguuuuauagauaaagaaagugagcaucaagcagguaaaggaauuugcccaagguuagaaggcuaauaaauauuggaucgauccaagauuugagcccaggucugucugaaucuaaacccuuuauagucucuaaacuauacugucuuucuggaguugaauaugaaacuaaagucauaugaauuuuauuuauaauguaucaaagauuuuuuaaucaaguaagccacugaauaguacuuuugcuauauuguuaaaguuugaguuaaugguaccucuagaaaagguugaaucauacaagcgguccuuguuagucuuugguauucuagaguagugcuucuuaauuuguaaugugucaaggaauuaccucgggauuuguucaaaugcaguucuuauucagugggucugauuuaguaggauugggaccugagauucugcauuucuaacaauuuucuggugaugcugauacugcugguuaaaggagugcacaaauagaauacuguugaauggcuuaaacuuaaauccauagaaauauccuuagagaucauuuuagcauuccuauuuuaggcuggaaugaaaccuuuacugaguaccuaaauacaaaugagugguuccaucauuucaugagcucuuauuuaauauaaaaacccugcaaaauauauguuaccuacuuuuucuuaaaucuauuauuuacaggccgggugugguggcugaucacgccacucccagcacuuugggaggccaacgcgggcagaucaugaggucaacagaucgagaccauccuggccaacauggugaaacccugucucuacuaaaauacaaaaaucaguaaucccagcuacucgggaggcugagacaggagaaucgcuugaacccaggaggcagaaguugcagugagcugagauugugccgagauugcgccacugcacuccagccuggugacagagcgagacuccaucucaaaaaaaaaaaaaucuauuauuuguaagggcacaaaacaagucucugagagauggcaacuucacaaagaccgaucauacuuuuccacagauaggcucuuaaucaugucagcucagcaaacuuugguuguauuugguggcagugcuaaguccuagggauacaaagacaaaaaagucagcgucucuacuucuugagucuguugagaagagaaggaugcaggcaaaugauugggguacagggaggcaucugcuauaaagaggacaugaacauaguaguuggggcaccaguaugcuggugcauagaaugcagguaaguaguagugccagaauuccaaucuaagccuucauauguaugguccacaguuucaucuuauucuaccacacugcccauuguaauccagaaggggcuuggauucaucagcguguucuaguaguuuggcagaagaaucuucuaaguaccuauaggacaugggugaaccugaacucaggauggggugggcaggauggauuagccaccaaccacucuuuguuugcccaaagcuuauuuucaucaguauguuuauaguaucauuaguuugggaggccaaggcgggcagaucaccugaggucaggaguuugagaccagccugaccaacauggugaaaccccgucucuacuaaaaauacaaaaauuagccgggcauggugguacaccccuguaaucccagcuacucgggaggcugaggugggagaauugcuugaaccugggagguggaggcugcagugagccaagaucgcgccacugcacuccagccugggugacagagcgagaccucgucucaaaaaaaaacuuauuucuuuuaccaaaacuugauguauagacugccuuuucuucaguaaauguuuauuuucccauauucggcuuaucaaagccacaaaauaaguuagugauaauaauauagucauguauugcuuaaugacugggauaaguucugagaaauggguugcugggugauuucauaauuguauaaauaucauagaguaggcuuacacaaaccuagaugguauagccuauuauacacauagacucaaugauacagcuuaucgcucuuaggcuacaaaccuggacagcauguuaccguacugaagacuguaggcaguuguaacacaaugguaaguauauguguaucuaaauauaucuaaacauagaagagguaaugcauugcacuauaacauuaccuuaugacagccacgacaucucuaggugacaggaauuuuuuagcucuauuauaaguuucugggaucaccauucuauaugugauccaucauugacugaaaugucauuaugcagcaaauuuguauauaacuauuuccauugcgucugccuaaaaaucuuaguagugugggcagaacuugauuagggauuguuuaaggcauauauggucaagcauaugaauuucagauauuuauguuuauggaagacuccuuuguaaaaaaaaacugaagaagaaucagaggugauacauuuuaguuccuguuuauuuugaaagccaaaagucugcacaaauugcagaccaaaguaucacaaacuacuaacaaggcagugguuucuaauaaauguugcuaucuuuguccugagcaaccuugcaaaacuguacauucccacucauaaaaaauggagaacuuuuucccuauagucuagggcagagugauaaguuuuucucauaauuccacauagcuuauaguuaaacucaguguagaagagugaugaacacaaaacaauacauacuguauucaagaaaucagaacaggugcaauuuaaauuuauagguggggaagagucuuacuagugggacagauuggagaaaagcuucacaaagauauggcauaagaauagaguagaauugggucaggcacgguggcucacgccuguaaucccagcacuuugggaggcaauguggguggaucuugaggucaggaguuugagaccagccuggccaacauggugaaaccucaucucuacuaaaaauaacaaaaguuagccgggugugguggugcaccccuguaaucccagcuacucaggaggcugaggcaggagaaucacuugaacccaggaggcggagguugcagugagcugagaucacaccauugcacuccaggcugggcaacagaguaagacuccgucucaaaaaaaaaaaaaaaaaaaaaaaaaaaaaaagaguagaauuucaguggguugaaaacaauggaggcugggaggacacaggcuuugggguggacauacugagaauguagggagguggaaagugcaugacacuucuggguacuggaaagacaggagugaacaagccaugcggcugggaggacugaaugaauuacuaaagugauagaaucaucuuaccagagagaaagcagcugaugaaguaggagaagaaacuauauguagacaaguuauuaggaagaagugacauucagagugggaagggaugagagggaguuagcuaagcaaagaagguagagagaagaguuccugcagggagcaacugcaguugugaagguccuggagcugggagaggagauguuugaggaacugagagaagauugaaugaggagggaugugaaaugauguggaggaauagauagagccuggcauguuggaugcuuucaguaccgaagcagugcuauauaaugccugacuauagaggauaacccacuaaaaauuugagaauuuuccuuuagggagcugagccuugagucagaggacuuccuccuuagaggaggugagguaagaugaucauguggcugugguacauacaaaguuuaauguuggaguugaauaagaccaauuuggaaguuacugcuaaaacuuugucauggaaaugugaaaguuuaugugaaaguuucaaggucaaaagaucgagaccagccuggccaacacagugaaaccccaucuuuacuaaauacaaaaauuagcugggcgugguggugagggccuguaaucccagcuacucaggaggcugaggcaggagaaucgcuugaacccagcagguggagguugcagugaaccaagauugcgccauggcacucuagccuggcgacagagugagacucggucucaaaaaaaaaaaaaaaaaaaaguuuaugugaaaguuuugagggacaaauggaaauggcauuuugaagaaaccccacucaaaauaugggaacauaucuugugaagugucaaauguccaguuggaggagaaagacuaguauugacccugugagaggcauuaaagauaugggagucauuuaugugaauauggcaagccaugggauuucaugaaaguuccaagaaaagaggauuaaaaaaauaugauuacuguuugucauaauugugguguaguauucaagagcaugauuucuggagagcucaacugucaagguuugaaucucacucugccacuuacuagguugggcugaaugauccuggacaagcuaacuuuucuuugccuuagauuccucaucuguaaaguggguauaauaauaguaccuccaucguaggguuguuaagugacuuaacauuugcuugcaaagaacuuaggaaaagugccguguacauaguaagaacaguuugugaaucaucauaaauacacgagaccagaauuucaaaacaagcagcaggcagaauguuccuuuaaaaggucauugaauguacuuuuccagcuacucuuguuacuuucuaaggaaacuacuugauaauccuguacuuuguaggacucaucaggguguguuuaguaaacuucaguguccuaggugacuucuuuauucccaaauuguggggcaggugacaaggggagguugguccucuaacucgugguguaguuaaucaggauuuuccuguuugaauagacauggcaaaugguuuuaguuagucauuacuaaugcaagaggguccuuaggcaagagcaggaaguuaauggugagucaccuucaguguuaugacauggaguauuucuuuuuaaaauaucacagggaguugguuuuugcuauaguagcuaaguugucaaucaaguaauacuaguaguaaaucuuacauaaaaacucgcuucccucaaguuuaaguaguucuaauuuaugcauuauuuuauauauugccuacuacucucuuuuugcuuauccugaaucaaauuucucacccucugucaaucuaauuuuguguugcuauaaaggaauaacugaaacugaguaauuuauaaagaaagguuuaauuuggcucacaguucugcaggcuguacaggaagcauggugccagcgucugcuucuggugaggaccucaggaagcuuacaauccuagcaaaaggcaagugggaaccagugugauacauggugcaagaaagugagugggagaagucccaggcuuuuaaacaaccagaucucaggugaacugaaugagaacucacuuaugaccaaggggauggugcgaagccauucaugagguaccccaccccccaccccgugacccagucaccccccaccaggccccaccuccaacuuugggaaucccauuucacuaugaaauuuggaggggacaaacauccaaaccaugucacccucuuuacgucucauuaaaaugcuggccuguuucucucuuccuuuuugcuauagggccuacuuuuaaucuuuucuucgaaagaagacuuugguauugguggucaggcaugauagcccagccuugaaaagcuuccacaucuuuuucacgucuaagggcccagcuuucgaguguguaaaaguuauuuggggugaaaauguguauuauccauucucaccaaucuagagguugucaugaguuugggggauuggaauuacuguuuaauaaugguaauccccuuuaaguauuuacugguugaaauaauuaaaguuuuucugguagauucuuaaccauaaaaacgaagcgaacugcuuauucugccccauccacagguagcagccucuucaugcuugccccugccuggaaugcccaugcccggaaugucacauguuuggcuaggagugcauuuaggucagagcuuacaggucacuuccugcccuugaucugcuuuucuaaaaaacuguuucccauuuuucuuuuucuuucccauuuuucauuuuucuuucuuucaugcaugcugcuuuauuuuugcugcacguaucauuagccaacauuguacugucuucuaucuggaacauaaauuccaucagauagggacuauguuguuuauugcuccaucuccagggccugaauauaguaggaacucaauaaauacuuguugaguaaaaguauuugcuauaucccugucccuucaguuuaaaugauacauaaaaauaaugcagaaauugagcuuacauagaaagaaugaaacaauauuuuguuuuacaagcauaaacaaaggauuuuaauuacauucauuucagccaacauuuauucuauuuuuuuuuuuuuuuuuuuugagauggagucucgcauccgucguccaggcuggagugcaauggcacaaucuuggcucacugcaaccuccaacucccggguacgagagauucuccugccucagccucccaaguagcugggacuacaggugugcgccaccacacccggcuaauuuuguaguuuuaguagagaugggguuucaccaugucaccauguuggccaggcuggucucgaacuccugaccucaugauccucccuccuuggccuccuaaucuauuucuaauuaguagauccuauacuggacaaaaauggaaaaugcaaaauauauacuccuguguucaggaauuucacagucuagccaggaagaaaacaugcauaaugaaauaauacugaaugagccaggcgugguggcucacgccuguaaucccagcacuuugggaggccgaggcagguggaucacaaggucaggagaucgagaccauccuggcuaacacagugaaaccccgucucuacuaaaaguacaaaaaauuagccaggcaugguggcgggcgccuguagucccagcuacuugggaugcugaggcaggagaauggcaugaaccugggagguggagcuugcagugagccgagaucaugccacugcacuccagccugggcgacugagcaagacuccaucucaaaaaaaaaaaaaaaaaaaaagaagaucaaaacaaaaauaauaauacugaaugauaaaugcuaugacauagauauaaagaaauuuuuuuacuagcacagagaaagaacucuucaucuguauugaggaagugaaaaguucucaacuaaaaauguuucgaagcuaaauggccaguaguaauucucggucgggcaugguagcucgcaccuguaaucccaccacuuugggaggucgaggugggaggaucucuugagcucaggauuucgagaccagccugggcaacauaaugagaccccaucucuacagaaaaauuuaaaaaauagcugagcgugguggugugcaccuguaguccuagcuccccaggaagcugaggcaggaggucacuugagcccaggaguccaaggcugcagugagccgggauugcaccacugcacuccauccugggugacagaaugagacccugccucaaaaaaauaaaauaauaggccaggcucgguggcucacgccuguaaucccagcacuuugggagguugaggugggcggaucacgaggucaggagaucgcgacaauccuggcuaacacggugaaaccccgucucuacuaaaaauacaaaaaaauuagccgagcgugguggugggccccuguagucccagcuacuugggaggcugaggcaggagaauggcgugaacccgggaggcggagcuugcagugagccgagauugcgccacugcacuccagccuggguggcagagcgagacuccgucucaaaaauaaauaaauaaauaaauaaaauaaaauaauaacuccuaugggucacauccauucuuuuuacuuccugccaccuacuccuuauuucuaucuggucauuaaggacaaaugugaaaugaauuuuggagacggagaaagacucucucaaaauaaauaaauaaaauuuaaaaaaaaacguacugcccuuguggugccuguuuugucaugguagauuugccuaauccuagcagacgugacuguguacuauucccagaccugcauagauugaucuccaaacugccuaaaaugaauagaugugguuguguauaacucagauaaauuugagaaauacuucuguacuagcugaagaauucuaagugguuguguuuuguuuguuuuuguuguuguuuuuugagacggagucucacccuguugcccaggcuggagugcaguggcgugaucuggcucacugcaaccuccaccucccagauucaagugauucuccugccucagucuccugaguagcugggauuacaggcccucaccaccacacccggcuaauuuuuuguauuuuuaguagagacgggguuucaccauguuagucaggcuggccucaaacuccugaccucgugauccccugccucagccucccaaagugcugggauuacaggcgugagccaccaugccuggcccuaagugguuguuuuaaaucagugguuccuuagaccggcaucagcaccaccugggaauuuucaggccugcugaaucaaaaaguauagggguaaggcucagcaacauguguuuuaacaaaccuuccaggugauucugaugaauauuuauagcacauuauaaucagaauauaaauugaacauaaaggcauccuaaauugauuuugaucgagccacuguggucuccucuuacauuuauuuuugugguaauccuacauuuccccccuuggacuuaaccuuccugcauccuaacccuagcccaaacagaugauugaaacacauuuucacuaaguguaauuuguuucacuuucagaaaacauaucacuuuuugcuuucucuccuuuucaugguuauucaacaguuaguuuaagagaaugacuuggaauccugcauugagaaucaagucacugaauuucuucuaaggaccacuggacuaaaaauucuuuuuuugugaauaaagccuuuaucuguauuguuccauuaacacuggaagaauuguuucuuuucaguuuucucuaucuuaauucuaugacaaagauaguguggugaaaaguuauuuaaaggugaucuuuucuaaucuauuccuugccuuuggugcgcagcuuucuuucaguacaaagaaaguauccuauuuugggccaucucuuuccauauaacauuauauuuuacccagagaguauuaaaugaaagauaaaaugaauauaaaguauuauuuuguauuugguauauauguguugguauaaauguuaauugcaaauaauauagguucuacaugauuuuaagcuuacagaaaguucaaaguauuacuuaaaaggcaagacauugauucuuccaucaaacauuuauugagcagcuauucagguauuagccuacaagcuuguaaagaagaaugacuugaucauugccaggagaacagauauguaaucaaguaauuacaauucuaccuguuaaaugugcauggagaauggaagaggaaacuaauuucugucugagguaguauggaaaggcugaauuaaagaagugacaucugagcugucucuugcaggaugacuaagaguuuaggagguaggggaugcagaguauuugugauaaugggaacggcauauacaaggagauggcaugauuuuauggaaaguuggugggaaaacuggguaucugaagaagacuucagaaaugaauccagcuaguaaagaauuuaggcauuuuccucuugauggagagcaauaggaauguucuuuaguaagaaugaaugacauguuuaaaagaugaaucgaaaauauuuuaagaagagaaaccccuggugacugauagaggaccuuggagugagaagagaugacaagccaguuacugaggaaguggucaaaaaagagagcugguaaguauugauggcugaguucucugagauggacuguggcagacccaucggagagaauauaaguggaauuuacaaaaugaagugaguggagcagguagggaagguugguuuguauccuagguaucucuuguggcucucauucagacagcuaagguggggaauaaugcuguuucuguguguguguguguguguguguguguguguguguguuuaaaccacauauaugaaacccauauauucaagcaggcuugaaagcuacaaugagggccgggcgcgguggcucacgccuguaaucccagcacuuugggaggccgaggcgggcggaucacgaggucaggagaucgagaccaucccggcuaaaauggugaaaccccgucucuacuaaaaauacaaaaaaauuagccgggcguaguggcgggcgccuguagucccagcuacuugggaggcggaggcaggagaauggcgugaacccgggaggcggagcuugcagugagccgagaucccgccacugcacuccagccugggcgacagagcgagacuccgucucaaaaaaaaaaaaaaaaaaagaaagcuacaaugagaucuugggguuguugaguugaggcucccaaaggcauucagugauugcuauugacuuguucaucaccauguauagucacaugguauuuucagugccuaaaaauuuuaaauacaguuaguuguuuugcaaaagcuuuuuauaauucagccauuuuacaguuaaagauaguagcaaaccauuaauauucaguuuuggaguucugucuuucuggggaggaaauagagcccaaaaugacagugaaagcuggugagaaaagguuugauauacaugugauaaacagguuugcuucucauucagccucugguaaacuugggauguguacaacaaauucuaccucuggacuugguuaguaguguguacuacacauccaggacugaaggggagccuuccuaaggauucuaggcauggagaaaacuaauuccacacgucugcauuuccuaacaggauuuuaccccaucaaaguagaccuuugaaaaugcagcugcaaauugaucuguuccuaauacgaaugaaacuggccuaaaaauaggacuuugggucccaugggccuugugugaguggucaguuuaaccaaaguuacuuauucagcaucacccaugagacugguguggacugccaauacaggaagaagggaauuguucuauuugugcauaggagggauacuuaggcucuggucaucugugggagaugagugaaaagaaguauaguugugaagagcagucaguggguuaggaaucacgcugccuggcuuugaguaccauuccugguacuaacuagcuuugggaucuuguaccagacugaucaaccuggcacuuugugccucaguuuccucauuagaauaaguaguacuacugcuuaugucauuuguuuacuguaagaauuaaaugaauuaauguacauaauauauaagaacaaugacuagcacaagauaaguguucaauucauguuaguccacagaagaaaagauuuuagccauguacugaccaucccaguuuguaucuccugcccugccucuuuugauuccuguuggaaaugggaacugggggaguugggagggacaaggaaaucaggaagaauuauguuugaauacuuuaguuauuuauucugggccucucuuuucauugcuguuaccucccaagagcaauugucuugacuucucuauuccuauaaagauaggaaaauccuuuuagaguuaacuguauucuuuaguccuaucucucaaaugauguuccuuaaaguuugccuuccaacaacuuuagcacuuaucuugccuccucccaagccuccaacaagcuuaaacuucaaauugcaaccccaacccauuagcaauuucuggucugcugaaaaauaagcuuuguuuggacuguagcuuucugucuuacaguuuucuuggugugagccacucacauaaaacauggaaauaaauagagcuuggcugucuuagcuaaaaugugcuuuauauuaaauagaauguuuaugauauuuucaacguucuaaaaauacuugcauguauuucuuauuaaugaaccuugguguuccuaggaagguauugucacaaaacugauuggauugggugguaguuucugagcugcaagcucuuccgugucuuauguuaacaguaauaguaauuauuugggccaugacuuccaaaaggauuuuuuggaaaaaaauuuuuuuucuucaucucuguguugaggaauauucauuuuauuauuuggugguuucuuuuuaguggagaagaagcagguauauagguuuaccuuucuucucugaacacagccuuaaauauguuucaaugaauuguuuuauguuaagauguguuuucuuuuuaaauuaguacccccucccacuuuuuuuuaggugcaccaaauaaaaaccaugauuuuuuuuuuuuuuucuguauuauagguccucuuccugauggaugggaacaagccaugacucaggauggagaaauuuacuauauaaaccauaagaacaagaccaccucuuggcuagacccaaggcuugacccucguuuugguaaagguucaucucaaaaccuuuuuagaugcuuuugguugcuaauuuuuuuuguaaauauacuucggaaagcacauuuaaauaaaaucgcauugcuuuauaguauuaaaaaaugacccugcccacccaauguuuaccaguaguguuuuuauccuucucauuguaaacuugagaaauuuagaucugaaucagauuuuuagggcuccucagguuggggugggggaaugucauaauggccgacuaaccagaaucacuuguuccuuucacauuuugggagaaacacagugauuguuuuuaaaauguuuuuuuuuuuuagcugcaauaauaaucaggcugucaugcaacaccucagaccaggaguaccagcuuuugucagugaccugaugucugcuugugcuuagguucugagagugaugaguaccaucuuaugccuggguguuguaguguuucccauccuaaggaggaacaugucaccccagaaauggcccagugaaagcauuuugcccccucuucugucucucucgaaaaauaaauguuuuuuuuucuucauucagaaaacaaagaaagccauauuccccuccagaucucaugaauaaaucacauuugcacaaaggaaccccuccccuuccaaauguguacauuuugauaaggguguaaccaguucuucagugcuuuuuaaaaaauguguguguguguguguguguguguguguguguuuuaaacuguuuucaguuuuucauuuggguuucugagauauuuuuccaaggccauggaauaugcaucuaaaaaagagcagauaauugugguuuugaagcuucaucuuggacuagaugcagcuaaaugaaaacaaugugcagaucacugaauaggucagacugaggggacucggaaccuuugaagcuuuacaggguuugaccuaacaacaacugcggggcccucacgggaaagaggaauuaacucugugaaugccaugaaaacacaacccugcggggggaaaaaagaaaaaacuguaucuggagcugguuggauaaaauaacuucuccaucgggaauauuaugagcaguuauuuugugucuuauauauaccuuuaaaaaaauaaauucaaguuugccccaaacugacugaacccccuguucaaguuaagucaauggcaggaucagggcagugaugucauuuugacagauaaccgguuuggcuuaaauacuguccuuuuaagcuucaagaccuguuuggguguuaaaaaaaguaaugagguauguuaauaauuugcaacuucagauucuguuuacuauuugaauuagcccuugugauuggaacaggaaaccaaguaagauagagaauuuaauaaaugcggccaauuguuuggacuggaacaauaacagccauguuuccuuaaauuaucucuaaugaaaugaaugaauucaguuucuccacauuuuggaaauucugaagaaugguguugcggaauuuuuuucccugacauaagguuaugaaagaugaugacgaacgcuuuaccaacugcagagaucaggaagaacaaagcuuuuuaaagaaaaaaauuuuuuccuuuaaaacagugaaauaaaacaacuuuucuguaagcuuaaguagacuauugauuacacacacagcuuggucuuuuguuuuaagaggaggagguacuuuaaaaaaacacuaccacccuccagcacguuauguacacacaggcauacaguuagaugugcccagaaaaaguuucauaaaauucucuuauugcauuuaguuucccuuuuugggcccaccguguguguauuccagacaggcuugacaauaugccagagcuuuuuauuuuguggcccgacuuuuaaucuguuccagaccuuuucacucagagagcucaaguguaacugaaggggggcaggaaagaaaaaaacguguggguuucucugaucuagagugacagcaaauagagacaagcuguuagcugcuggauuugaaguuuuccuugaaaucagaaguucugcauaguggauuauguuuuaucucugccaaagaaauauaaacuauccccuuguuucugacccuuugggccauacaaacacaaacaaaugguguaggauauugcuuucaugauuguggaguuugcuuuucgauauucuucaaaucuauauuaaaauauuuaucaauuuuuggcuuaagucaaguagaugugugucuuucagugucuuagaaugggagcuaagccccuagagaagcuuaauuuuagcuccuucaaacaaccccuuuuauauguuuauuuaucagaugcuuucagauuaauuauaguuagaauauagccauuugcuuuaagauuaaacauauuuaguaauuacacuucauuugcugcauaauaacguuucagucagcggcagaccacauauacagucgugguccuauaugauucuaauacuguguuuuuacuguaacuuuucuauguuuagauacacaaauacuacccguugugcuacaguugccuacaguguucagcacacuaacaggcuguacaguucuguagcuuggggcgauaggcuauaccuuacagccuaggcauguaguaggcuauaccaucuagguuuguguaaguacucucuaagauguuugcacagugacagaauugccaaugauccauuucacaaagcauauccugguuauuaagugacacaugacuauauuuauaguaucaauccuucacaucucacaugaaauuaauguuauuuauguaauuuuagggaauaaaagaguaauuuguuguggauuggguuuuuuaaugauuuuuuucuuuaacauuuaaaagcuauuucuuuaauauuuuaauuuuagagaauucauuaguaauuuauaacaaaucaugaagugacaucagauggcaauaaggaugcccugauguuuauugaguuuuaagaaaaauagggcuuuuuuuguuuguuuuuuuaaggagucauauuaggaguguuuuuacucuuuguucaagaaaaugguuccuugaguauuaugcaagccauuaaauuauuucauauaaacacauaggaggugauuuuuuuucccuggagauuuuguacuggcaaacaugagucucagguuuaaacaucaccuuguauguuguagaucuauuacuguauauaauacagucauggacauuuuccaguaaaaggccuaaugaaaacacaaugaaauuauaauugcuguucagaaugaaaaaagaucuuuaaaacacuaauaguugauaaacugaucuuuaauguuauuuucgcuauuguuuauauuauaaaaagauguauuaaaauauuguuaccaaucuguguuuuaggaaauaagugcugauggcaccacugggauaaaaauauuugguguaaacaaaauauuggagcaagagauuuggggaaaaaauuauacuucugaauuuuaaagcaaguaaugaacaguccagagugacaaaaacagaauauuuaauuccuaacuacaguucugugcacagaaauucuauguguagaaaugucagagguauuaaaccucauagguugauuuugguuccuuuguuucaguuucccaaaacuugcuuucugugcauuuacauacacguguguauguguuacuauaaugucuugaaauaagaaauaaaaggauaaguaaaauacaaauaccuauaugcaauuuauuaaaauaagacuaaagccgaagguuguugagacuucuuuuucaucagaguuaaauauuuggcauuaauaauuaaauaucuauaaaaauuuugagacauucauuaacauuuuuucuuuuuuaagccaaauauuucuguuguuaaaaauaauauuuuccuuuugaugaaaaugcaccuaacaaccaacuaaauaacuaagaauccauccuauuaguguugggggaaaaccacugaagucucuagaaaccaaauugguaacuuuauuaauggagucuugagcaaagagaaugucagcaucuaauuauuuaaauuuuaucaaagcaagucucuugauagcuguaugcuaaaagugagguuuuuuuuguucuguuuuguuuuguuuugagguuugaggcuuuuuuuccccuuaucaacucaagucuuuccugguuauccugggcugucaguauuugguuauggacuacauuaauuacuuagcguacagaggaaaagauguguguuuuagauaaaaagagcuauugcgagcuaaaaauuauuaacagauggccaggugcgguggcucaugccuguaaucccagcacuuugggaggucaagguggauggaucacuugaggccaggaguuccugaccagccuggccaacauagugaaaccccaucucuacuaaaaauagaaaaaaauagcugggagugguggugcacgcuuguagucacucaggaggcugaggcaugagaaucacuugaauccaggcggcagagguugcagugagugaauaucaugccacucuacuccagccugggcaacagagacucugucucaaaaaauuaagaauaaaaauaaaaauuaguaacaggcuggaugcaguggcucacgccuguaaucccagcacuuugggaggcccuggugggcagaucacuuuagguaaggaguucaagaccagccuggccaacauggucaaaccccgucuacuaaaaaugcaaaaauuagccaggugugauggcacacgccuauaaucccagcugcuugggaggcugaggcacugagaaucacuugaacccgguaggcagagguugcagugagcuaagauggugcacugcauucuagccugggagacagagcgaaacuccaucucaaaagccgaggcugauggaucaugagguuagagaucaagaccauccuggccaacauggugacaccccaucucugcuaaaaauacaaaaauuagcugggcugguggcacgcaccuauagucccaacuacucaggaggcugaggcaggagaaucgcuugaaccugggaggcagagguugcagugagcccaagaucgcaccacugcacuccagccugggcaacagagcgagacuccaucucaaaaaaaaaaaaaauuauuaacugauaaaacucacaaaauuuggcccucauaaugaguccucuaaucaucauuuuuucaguggggagaaugcuacucuucugaucacugcagaacauucaacaucccuggcccgcuaagugccauagcaccacacagccauuacgauuccucggaccaccaacacuuuuuuuuuuuuuuuuaaaugcugggagaguuagggaauauggucuaaaaucugagccccucugagaucagggaaauuauacccaagguuauauaguuaaauggcaaaacugaaauuugaauuugaucuuuugauaccuagaauuuaaaagaaauuuagauucaaugcaguuaaucuuucagaaauaccuacuaaugcugauacaugaaaauuugagagggagaaaaauagugguuaaugcacuugcaucuuguauugugacucaucuugaauaaguuacccaaagauaaugaguuuuucuuuuuuucuuuucuuccuuuauuguuucuuucuuuuuuggagagagggucucacucucaucgcccaggcuagagugcagcauggcucaaucucaguucacugcagccuuaauuccugggcucauacaagccucccgccuguagcugggacuacaggcaugugccaccauacccugcuaauuuuuuuguguuuuuaguagacaugggguuuugccguguugcccaggcuggucucaaaccccuggggcucaagcagucuaccugccucuaccucccaaagugcugaguuuacaggugugagccauagggccuggccaaguuucuaauuacguaagagaauuuaagaucucugauuggaacagacuuuaaaggcaucuaguugaauuauuuacccaauucuugccucaccgaucucagcuuugaccuuucccuuuacuaguuuacuucauuauaguguagcccauucuacuuaaggaaaauucuaaugaccacaaaguuuauauuucuugauuacccaaaaauuuacuuccuuucacaugugugaauacagcucuaaucccagcaguguucucuucuaacugugguuucucugguuuuucauguguucagaguucucuguucuuuaucaauuuacucacuucucuggauguccuucauuuugcuagugcuucuuuaaguguuauauucuauaguguuucauauguacauuauccugugagaaaaauaguuaugucauugcucugaccugucauuuucaaucuccuccaaaaaucuuucuucaaucugcaguagaggcuagcaucucuuuuccacaugauaguuacaacaauguacuugauucaacugaauuaaauugggauguagaaaaauuuaccuucucaguuggaaaucaagagacccaaguucugcuaucacaauauaaccaacuggaucagaaagauaccuaacuucucuugacucaucuguaaaaugugacuggauuagacuggaugcucuuaagaauauuuccacucuuuaacugaauacaauaugcucaguaacugcuuuggacucuugcuuaagguuacuucucaauagccuuuuugauuugagugcauugagguuucagagauacuuuugaacuauuuauugcaccauuuaaguuuaacuuugguccucuggucacaguguggaauuacuuuugaagaggagacagggaaaucuuccagccuuuaaucuaaagauaagccuuaucacauggugaguauguccaggcaaacaaaucugauggggggugugggaagugcugggcugaauaguuaagcuuuguccacacucucaaacucuuggaagcauaugggaguuuaaacauguucauguuagcaaaguucagcuuuauugccuuaaagaugaugccuuguugguacacuuuguuucuaaaauuuaaaacucccauaaaguugccaugacagaaagucuaauguaagcagauuugaagccuaguuccaggccaugugcuuagcaaaaccugauuuaagacauaccaauagagauuguuaguaauuauugcucucacuacauuuucuuuuuccuucaaaagcaagcauuugcuuaaaugaauauuuuaauacauaagauuauagaauagauuucaaaauuaguuccacacuugagcucugcaguuuuuaaaauuuuauguuaaauucaguaggauauauucuaaaaaguaaacaacuuuaguuguauuccucuguccaguaugucucaacuauguuuugugaaauuucgcuguuccuuuuuaaaauguuuuauuuuuuaucuaaaaauaaauacuuugguuagcuagggaaaauauccaguaagguaguuccaaaauaguuuaucaguuaugguaagcaaucucuccuguacuaaccaaggcugaguagacauauguuacggaggauaaacuaauagguaauuucuacuugaucaguauuucauugaugcaauuaguuaauuauacagugaagaaacauuuuuaucuuucuuuacauaaugaguacauuguucauacaggauuuuuuaaacaugaaaguuuaagaccagcaacgucaauuagaugauaguuuaaacuaaugccuuauucguguuacuaaagccgcuaucaaacacacuuaaaaagaccuuacauaguuuuuuggggguuuuuuuuuguuugauuuuuguuuuuuuuuuuuugagacggagucucgcucugucgcccaggcuggagugcaguggcgcaaucuuggcucacugcaaccuccgccucccgaguagcugggacuacaggugccugccaccgugcccggcuaauuuuuuguauuuuaguagagacaggguuucaccauguuagccaggauggucucgaucuccugaacucgugauccgcccaccucggccucccgaagugcugggauuacaggcgugagccaccgugccaagccuuuuacauaguuuuuuaaaaggaaacuuuuucaaguuauauuuguauuaacucuguauuaacagcaaacaucuuauaugcuggaaaagaggaaccauuugguguugcuugcuacuuuuuguaccaacccaaagauucagauguaagaaaaagaaagagauuauagaauuauuggaaaggucaaauuucuguugaaaguaauuggugugauuuagaaggagagugguucagauucuguuuuguuuuguuuuauacucauuuuguucugcuacccuaguugcuaaggucauuuuagaacucauucuggacuugcuucaacuuggagauucuccugugcauuacuaauagcauccuccuaacuagggagagaaacuauuuuaggauuuauuuauuuaugcaacaaaaguuugggugccaguuacaugccaggcacuaugcuagccauggguugggaggaacaagcuacuaaacaaguaaauaaaucauuacaaauguauuaaguaugguaaaagguacuaaacaauguggggugaaaggaacuaggguggugggaaccugcuugcaccuggguggucaagggagguuuuucaaaaaggcacauaggaagccaccagucaaauuucagaccaguuuuuguguuuuucaguaaaaacucugagguaugcaucacuucuaaauuauaaauuauccucugugaaagagcuuuacuaguaauaaaugaaauuagaaauaaaguguuauaauugaccuguuuauucauuaaucuaacaugaauuaauagugacaaguauauuuuaaaagauaaugccccuuuauuuuuuuaauuuuuaguuuuuuagagacgguguaucucuguguugcucagucuggucuugaacuccuguccugaagcaguccuccugccucagccucccaaguagcugguauuacaggugcaaaucaccaugucuggcugcuucucuacagucucauuaucugaacuuucuuuccuaacuagaccuuaaaguuuauuuucauaguggggaaaaacaucuagcugugcucuggggacaaagagagcugaaagcuaauuagaacacguucucccuuuucugccucaccucauuuagcaacccuuguguccugcccuaaacugcuugaugaggugaugaggagaaaauguucugcuggauuucuuuuuguuuucuuuuagcuccauucaugauuguauuguuugaaaaauaacauuauaaugaauuuuuaugguuggaggagggggaaguugaauugacuaaaguauugauauuuguuaccaguauuuuugaacagcuaaagaugugaaaacuuuaauccaguuuggggaggcugggaguuggugcuggggaaaagguuuggcuguguccccacccaaaucucaucuugaauuguagcucccauuauccccacauguugugggagggaccaggugggaauaauugaaucaugggggcaauuucucccauccuguucucagauagugagugcucgcaagaucuuaugguuuuauaaggggcuucccccuucccugagcacugauucuucucucuccugcugccaugugaaggaguacauguuugcuuccccuuuugcaaugauuguaaguuuucugagaccuccccagccaugcugaacuguaaaucuguuaaaccucuuuucuuuauaaauuacccagucuuggguaugucuuuauuaacagcgcaagaacaaacuaauacaguaaauugguaccagaaguggggaaagaagugcagagugugggauggagagguuacuuagccugugacaaaaccuagaguaggauguuagagcaggugaacuguccccacauauugaucauuagagaaaugcaaaccaaaaccacaaugagauaacacuuaacucccauuaggauggcuaaaguuuuuuuugaaaagauaacaaauguuguccagaauguggagaaauuggaauccucauacauugcuguugggauugaaaaaugauguaaccacuuuggaaaauagaaugacaguuccucaaaacauuaaccauaacauucccauaugaccgagcaauuccauuccucgguauagaggcuaaagaauugggaacguaugucuccacguugugggaacguaugucuccacaaaaaccuguacccagguuuacagcaguauuauuuuauaauaaauagccaaaaagugaaaauaacccaaauguccauuaguugaugaaugggcuaacaaaaugugguauauucauauaauggaauauuauuuggcaauuaaagggaaugcagugcuugauacauauuaaaacaugaauaaaucuggaaaacauuauaaaugagaauagccaggcacaaaaggccauauauugcuuaauuccauuuuuagaaauguccagaaugggaaaauucauagagacagaaguagauuagugguugccagggacugggaggaagggcaguagguagugaacugcuaauggauacagggcuuuuuuguuuguuuuuguuuuugugacuuuuuuuuuuuuuuuuugaagugaugaaaauguucugaaauuagaucguggcaauggguguacaauucugugaauuuguaagaacuaccagacaguacauguaacaagggugaauuaucccaguaaagagaaaaaauuauuucuaggcaugaugucauuuagguauauaguguauugagaaauaccuuuuguauauugaucauaaaaagauguauucagucauuagguuaggacacucgucuuuuccuuuucuuuuguaaaagauagcuuuucagugugaauuaaaauaagcaauuuuuacugaaaaacuacauuuuauguuuaaguagauaaauuauuaugccacuuuauagcgacucucuauugaugauucaguccccuuaggucaugcaguaaacacuuagagccaggagugaguguuuuguguuuuguuuuuacugcuuuaagacccacagauggccuauuaguuuguguuuuuagaagaacauuaauuucuuuuaaaaagucuacuguuuuguaguuuugaguacacucguagguaugaggaaaacccaaauauuucuucuaaauguuuugaacaaguuaauauagcuaugcuaauauggaaauauucagugucugagauuugaaaaaauacuagacaaaagcuuuuguugugggagauuugauguaauguuuuaauagcuuaagaaucguuuauuauuguaaauguauacccaguaagauuacuagaauuaaauuuauuauuccaaaguuuaugacuaacagaucuguaauacauuguuauaauccaaguuuugagguuacaaaucauguaaauuuuuagacaaucuaaaaauugucugaaguuuggaaauucacauguuuagaaugaaacuuggggaaaaaaaaccuauggugaugaccccuuucuuuuauuuuugagaaaguagucccuuauuuuucaguaauugcucagucauugguuuucuaccauaaagcugucagggcugauuuguuaagcaaaacuugaaacaguuacuauuucguagugcaagaagcacagacucuaaauuuuaaaauauugcauaauuuuuaaaauucugacauuuugugggguuuuuguuuuguuuuuaccuuuuggaaauuuuauuaaaacuggaaacauugggauuucaauaguugauagccagaggaagaaguugguaaugcuauucuuuucuuuucuugcugcccugcccccuuuccccaggaaacaaagccgguuuuguuucuugccugcuugugaggucucugcugcaccccaugugggugcaccgcucugugcuuuguugaaagacuuaagauacucagaagguaaagaacaggaugcuucuggagaggaauaaaucccagcuucaguagauaaacaagguuguuugaauuggucauuuaagugaguucuuucuauggaaaccuuguagugcugcuuguauccauagguaacaacauuuagguaaagccaaaaguacucacaauagucaucagaguauuucucuuacauaauuuugugcaaguuucuguuuaauucuguggacugguucuuccuucaucuuuugauauccuaacuaauuuuuccuguuccgugguuuugaauagucagauaagcuuagauuugaaaaagaccuuaccaaccaauucaguuuguugucagcauuggcuauugucauuaaugauuacugcuuuugguaucuaauucugggaaacuggugagaagcaaaggauauuuaccacuuuauuuuuguguaauuuuauugcuauucaguguuuuucaccaagaauguauguuauuucauaaauaacuuaauguuauguuacauaaugaaaauauaauggggaaagcucaaaagcuuauccaaauguuucuuaauagaugaaguauuuaacaguguauauagcucuagaaucuguuuugaaaucaaucauguuuuauaauuccaacacuccucagcuuacuaaugggcuauuuucuagcagguuuuugguguuuugcuuuuuuauugcuuggaaccaaaaacacuuuuccccaauaguuguuugccuugggccucaauuuacgacauguucauuguaugugaugaaucucagaucaguuccccaauucauauuuaacucaugcuaucaaaccuggcacagcacacuguauaaaauguuucuguguggaaauauguugaguguuguauugaaacaccgagaagauguuucaccgaaagagaaggauccucuuauaucguuggcucaaucuccacuaccuuuuuucuauuuagaccuuguaggaaagagaaacaugcauauuuuuguaaaucauaggaauauuuggaaacaguaaaugguaugauaaaauaggaggagggagagagagaauguauguguaugucuauguguuuguggaggagaaggagagagguauaggaaucaucaaaauauggaauucgucuguaggagucagagucuuuagguuuagaaagaaguucugcagaagagagaggacuaagguuuauggagcacccacuauuccaggugugugagagaauaaucaguccucauaauaacucaaauggagaugucaguauugaugguacggaugagaaaaccaaggauuaagugaauuaccaaauuaguaugcccaacucuaauccaaguucauuugacucuaaaggcuguguuuuuuaugauaccugucaauuauguaacuauguuuguugguaacagauaagagcaauuuuauuacaugagguuguuggugccuggcaaaucuuaggucccaaaaauuguuggcuuuuuucguauccauugcccuauaaaauaauaaacuauaaccuauaaggaugaaaguuuuagccauuuacuuuuuauaaagccauuucauaagucuucgugaguuaauaaauauguuuuuuuuccauaugagauuaauaaggcuuugaacaagcuggagcaguaugucauguuuugacaucccuucucucuucuuccagacaaaauauuaaaacaagauaaccaaaaagacacaacuaggguaggaauuuuuuaaaaaucucuauaggucagaaaauaaaaccacaugaagcauugaggguagugcuagaggccugccaguuuuaggggccauuuggcuccugagaagaacuguuaauaaaaguauuaauaaggaagaggacacacaaaacacgcucaaugggaaaagccaggcgugcagcugaccuggcccuggccuaggacaauguuuacaaggauugaccacugucaagucacagagucacaaauugucuagaaucaauauuauguagacuauguuuuuuaaaccucaaugcaacuaaauuuaaacuuauaauaaaaaaguuaguuucaaaaaacaugucuugcccuaccagcuauuaaaacauacuacuaaaguuguacuuuuguacauauuguacauacuaaauaauguuuauauacacauauauacauguauauaacuuacacguuuacauaguauaaacauaaaggcaguacugccguacuaguauaagaauaguuagauuaauaaaauaaaaaaucuggaaauaacaaaaugucagaauuuauucuaugauaaagaugaggggaaagauacacaguuagcauauggaagaagauaaaauuagauccauucaucccauacaacagaaaaaauugcaguggaucagauuugaguugccaaguaaaugagaacuauaguuuuuuaauuaaaaugggugaauuucucuguaguuugaaagugaggaaauguaauucagauuuuuaaaaagauugacaaauuugaguaaagaauaagcuuuuuuuuuuuuuuuuuagacaagagucuugcacuuuuugcccaggcuggagugcaaugaugcaaucucagcgugcugcaaccucugccccccguguucaagugauuaucgugccucagccucuggaguagcuggcauuacaggugccugccaccacgcccagcuaauuuuuauauuuuuaguagagauaggguuucaccauuuuggucaggcuggucucaaacuucugaccucuagugauccgucugccuuggccucccaaagugcugggauuacaggcaugagccaccaugccuggcuaagaauaaguucuuaugaaaaacaagcaaaaagaugacaaucugaggaaaauuauugguaacuuauaucacagacacagauuucuuauccuuaguguauagauuguauaauaagacauagcaaaaauaaaaucauacugagauacuacucaucuuucagaugggcagaaacccaaaauuggcaaguccuugggggcaaaaaagcacucuuacauuacuagugaggauacaucaaaguacaacuccugggguggggcggugguguaaauuuggcgauaucuagcaaaauuauuuaugcuuucaacauucaacuaagcaaucucccguauagacaucuacccaaagauauaguagcagaaauacaaaauuauguaugagcauauucuguacaguacucuuuacuaauaaugaaaaccuaauaggaaauugguugaauagaauauuaaccagcuaugucaauaggaaaaugagggaaaaucucuauauacugcuuuagaguuaucucaggauauauuguuacaaaggcaaaagcaaaguggaaggaaguaugcauaguaugcuaccauauaucaaagaagaagggaugugugauguguauguguuugcuuacauuuuuaaggguagaauaaaggaaauacugauacaguuuaccuguuaccuauuggagguaggaggaagcgggugggaaauaaagcaaaucucugaaauucaaagacagaaugucauaaguacaccuguauuucaggugguuggcuaauuauagaagaauaauuucaggugacuuuaaagcacagugauuuuacuuuauguacuuaauggaauaucuuaaggagauaaaauugcaaagaaaucugaaacuugaaucauuuuagugaucauaauguuauuuuuagaugauugcguauguauagaggacaauacauauuaauguuguuagaacccaguuuuucagcaugagaaaaaacaguuguuacaaaaucaaaguaaaaaccaugcauccuaaaucugaauuggaaauaugcauuuucugaaggagaguaccaccuagaaacaguuacaaaaaagcaacagaauaauaauagguacccccuaguacgcagaguaaugucucuaaauaccauuucccacucaaagaaaucagggcuucuucaaaaaaggcugaguaaaauuuggggcagggaauauacuagaugaccuuggaacaucuuuuugugccuaaaagcaaacaaggaaguagaacaagcccauuguagccauagcaaaaagauccagcuugaccuggucaaauauggcacacuuugaacauugaucagaauaacugugcuggauuaaaacacaucauaaacauauuuucaaaucugugauuucauaaugauuuuuuuucccuucgcuccagguagcagaguaucagaauuauuauuauuuuuuuuuuuugagauggagucucauucuuucgcccaggcuggagugcaguggcgcggucuuggcucagugcaaccucugucugccuccuggguucaagccauucuccugccucagccuccugaguagcugguagguacuacagucacccgccaccacaccuggcuaauuuuuuuuuuuuuuuuugguauuuuuaguagagaugggguuucaccauguuagcccggauggucgugaucuucugaccucgugauccgccugucucggccuccccaagugcugggauuacaggcgugagccacugcaccuggccgauuuuuuuuuuuuuaaacccucauuggcuaccuuuuggaggacucugggaccaacucaucauccugaaaguguacacaaaaagggaaugaaucaaacauuuauucuguaucuuaccuguacaaauuauguuucagaguaaccaaauacuuaauaugggaaaauucuuauuuauagaacuucaaauaauacaugggaaggaaugauaccaucauuuuguaaccucuaaugaaauaauggguuuagguuuaaaaaaaucagugguugcuaaaaaccauugggugaaaauaaccuaaaauggauauaauaaguuuaccacaucugcaccacugauucauccuuaucaugaagacagucaucuugugccuucucuccucauguagugccaccaaugaaguauucuugccaaaaauugugaucaggccucuauauucgaacuuguuuacagcaaaccaagaaauggaaaagcaugcugcauaguacuauggggaugcaaugagcaaaguccagguuguagaagauucuuugaggcaaaugacacaguuucuuugacaaauaaaugacaaagaaaaaaccaagggggaaccuguguauuaaaacagugguccucagagcgcuggcaugaaucaaaagucacugggagggcuugucaaaacacagauugcuggcuucaucccguaguuucucauucauuagcccuggguuagggcccaugaauuugcauuucuaaaacgcugcuaggugcucuuccuccugaugauccagaaaccacagaaccauguuauuaaagaagucuuggauuaugaaucaaauacaauguauggaccuuguuuggauucuguuuugaacaagccaauuguaaaaauaacaauaauucccuugauaauagggaaauguagacaugggauggacuuuugauaauauuaaggaauugguaaauuuugauaguguaaucaugguauuguaauuauauuuuucuuuuuuuaaagaaggcccugucuuuuuagaaauacauguuaaaauuauggguaaaaugcuauauuguuugcuugaaaauaauuggcgcugaaaaguaguugaggauagagguaaaagagauuggccauguauuaacaauugggaagaaagcgagugaugaguacacaaggauucauuaucuguauuaauuuuucuacuuuucuauguuuauggaaauuaccuucaaaauguaaaauauauguuuggaaacauaaaaauauauuccaaaauagcucaugaauuaaauguaagucaccauagaaauuacacguuuuuuggaauagaacagucaugaauuauacuauuucaaaacaugugggaugcagguaaagcaggacuuaaggguaaguuuauugacuuaagucuuccaaaaaaagauguaaaugaauuaaguucaauucaaaaguuagaaaaugaaacacagaaaagcuggagggaaaaagaacagaaaaaauagaaauaaguuaauaaugcagucaucuuuuauuaacagguagcugagaagauuggauugaacuaaggcauuauucugagggagguuggucuguaauauuccucucuuuaauauccuugguucugucucggugcugugcuagccugauagaagaauugggcagucuugagccagguaugaugcucgccugcagucucagcugcuugagagacagacaguaggauuguuugaagccaggcauuugagaccagccuaggcaacauaguaagacagaaaaggggaaaaaaaaaaaaaaaggugugcuaauguaaagagaaauuaaaaguaggacuucuguugucuuaaauaguuucugccucagugaguaacuacucaacuuauguagaaauggcucaguauuuuuucagcgcacacuuugugccagaugcugugcuagguauugaggacacauagaugacuacgauaugacccauacuccuguggcacucagucugagggagcauauaaauuuguaaguaaaaaauuagaaucaggcaauaaaugucaguagacaauauggaaaaguucccaggcaauuccuugagagaagaaaauucuuaauguauaggaugggcccagccuugugagguuuugcucaaguagucuccaagaagaaauggcauuuaccaagcagccagucuguuauaaugggacacauuaaaaaucacaaggaguuugcugugugacugggagaccauuaaguuauaagagcugucaguguauguuauuuaggauuuuuguagcaagguuuauaugagagauuggccuguaauuuuccuuucuuuuaauauccuuguaugguaucaagguuaugcuggccuuauaaguguuggaaaguauucuuuccuuguuaugcucuggaagaggcuguguaagacugguauuauuucuuccuugaaugacugcaaagccauugggaccugggguuuucuuuagucaauguguacuaaacauuuaguagaaacagugacccaaaauuucaacuuaaguugaauauguaucugaaaagguuuauuauucuuacuaacauuuucacauaaaacuucccucugcucacugagguuaauucacaguuugaucaguguuguaucagugacagaaauucacuaguauaaaaacccaguccauuucuaaccaccaaaugguguauuacagcuucaaaaaaaaauuuuuuuuuuuuuacuaccuaggcuuugugcuggggguuaccauggugucaaaugagacaaauccaugucauccagauacuuguggacucaauuugauaugagcaagcaucagaucauuuuaaucuacuugcuuuauugggauguguauguggauauauuaagggcugauuauuuugaugggcuuugcuguuuggaaugcuuugucuuaauuuuuguggaugaauuuuuaauuuauauauuucauaagaaguaaugaauuugcaucauucacacuucagaaguuauaaauaagguucuccaccuuuguccuuuagucacccaguuucccaucucuggagccaaaagauguuaguugcuucuuagcuauucaucaauuuuuauauccucugaauaugcaauauauucacccccgcucccuucccccaccccguuuuuuuuaaacacuuucucuucugcaccuugcuuuuaauuuaguaaguccuuagaaacuguuccuuauugcauguuaaaacuacgucuuguuucuuuucucuuaugacuuccuuguaucuugugacaacaguaauaauaaauuaauguagucauugugauauugauggauuuuuagguuauuuccagucuuccugcccaaaaaaguuacaucgaauaucccaaauugcuuuugaauaauuaaaucaucauuuuaucuuccuucacuaguuuuuuaggacagauuuuuuuuuucuuuucauuucagccaugaaccagagaaucagucagagugcuccagugaaacagccaccaccccuggcuccccagagcccacagggaggcgucauggguggcagcaacuccaaccagcagcaacagaugcgacugcagcaacugcagauggagaaggagaggcugcggcugaaacagcaagaacugcuucggcaggugaggccacagguuagaaaccagccuuccacuuuuggggguuuguuuucuuaaaguugggcagauuucauuuuaacauuuauuaguuacagaggaauguugucuuuguaaaacugagugacacagaagcauucuauccagcccuguccuugucuuaguuuugugacugugaauggccuuugaucaaguuacaagggaugugacuuggaaaccuguaucaugaagagcuguuuuggucauggucauugcaauugagcaaaaauugaaggaagcaaggaugcuuucucuaauguacauggaauuguggauugcuguuuuucugaggauuucacuaaaggggaaauucuagaacaucacucaggagaaaacauccuuuauuaauaacuuacguggcgggauacaccaauaugacauuucucaaaugacaaauauacuucgguauuaccgaaucuaagaauuuucauugaaaacaaaauaaauguuaccuuuggccaggugcgguggcucaugccuguaaucccagcacuuugggaggccagggugggcagaucacuugaggccaguucaagacaagccuggccaacuuagcgaaaccccaucucuacuaaaaauaaaaaaauuagccaagcgugguggcacacaccuguaaucucaacuucucaggaggcugaggcacaagaaucacuugagcuucggaggcagagguucggugagccaagauugugccaccgcacucaagccugggugacagagugagauucugucucaaaaacaaaaaguuaucuucaaguuuagaagaugccagugugcuuuaaaauuaccugcuuauggauguuuuuuuauuuuggggaaaguaggacauaguagagagcuuugaagcccuuuaaucaccaauuccaucagcuuucuuccagaagguacuguugguuuuuauguuccuaauauauauaauuaaucucaacauuaauuuuuacuuuaucuuauuucagagugguuaaaucuacuaaguucagauauuggagauaaggucuuuuguuaaguagcguagauauuuuuaaauuuccauauaaaauuuuuuugaauagauaauagaaaaaugguauacuagugauagauguacagaggugaaaguacacucaaaauaagaucuuuucccuguuuuucuaguucucuccuauggggccuaaauaacuaugaguuucuuagguuuuuuguuuuuuguuaauuuuuccagagauacucuguuuacauacauaaaauacauguaucugugccauuuuuucccuagcuaaaucacagcaugcuaaguauagacauuuaaaaaucgucauacucggccaggcaugguggcucaugccucuaaucccaacacuuugggaggccgaggcaggagguuugcuugagcccaggaguucgaaaccagccugggcaacauggcgagacucugucucuuaaaaaaaaaaaaagcucuacauuucuguuaccaggaaggaggcaccuaaaggucuguuuuuuguuuuuuggguuuuuuuuagggcuguauuuuaaaaguaucucuugagugucagugaaaauaugugaacucaguacuaccugaacucugauuugggguuugaggaauugguacuucaggaguuaaauuaagccauggcaucugagacaggcucacguugaaacugugcuuugucgguaaucuguccauacaauucuagugugauuggcaucaaagguaaacccugauagaaggaguaagacaguaugugccaacauacgaugucaggaacuuguuggggcucagaaaaugauacuccaaaauaugguucuuugacaaacuaaggaagcagccucaaguucuaugccaaagcacaggaugaggcuguuccuugaaguuccuuuaucugccuagaaaccagacccaccaaaaggaauacaauugccuuugauccccuccucaaaauuucauuaaccagagaagccugaaacuuguaugacagaggaaaagacuaaaaauuaaauaucacaccuagagagcucagaggaacuuugcccagacuauugucuguucucagaucccauucaguuuccaaagagaauuauuuacuaaccauugucuguguacugggcccauucauucuuccuaaaaaucauuuacugcccuucaaaauggcgucauuucccucauguccccuuccccugugaagaaggguauuauauaguaucuggaacucacuugguuauuggguaauaauugucuugcaauuucccccaugcuuaugcaccuuaaauaaauuuguuugccauuuucuccuguuaauuugucuauuaucaguucauuuucagcgaaccuuuagaggguagaggggaaguuuuccuuuuggccccuauaaagugaucuugaaagaaauguuucuuuaucugacauaaaaaaggauggagaaaggaagcauuauuguaccucugacuuucuaacaaauuaccauaaaggaagaauauuuuucgucuacuauuguuagaacaccuuagaaccaucaaaaauauaauuacauggcuaauagaaaaaaaaagagcaguuuuaaaauauguuuuauguaaccuauuuucauuguuuuucauuuuguuguugccgaguaguaguuguucuaaguaaauacaggucucaauuucacuaugaauaaaaacugucaaaaucaagaaacuaaaaaaaaaguucuuuaauuacuaaugucaaaaccauacuguuuuuaagauaauuuguaaagucuagaaauggggccauucgccauuuuguuuuaugccauagaucauccugggguuuuuuggugggcaaaugcugcuauuuguaaaacucuuccuuccaaagauuuuccuaaaucuuuauucucaaacuuacucugggugauggguccuggacagaauagcuucacuuccuuuaaagguaacuucuuuguuucaucuuuacugccuacugugucgucuuuucuuauguugaaguugacagaccugcucuauucucauacuaauagacuauuuuuagauuuuuuuaaaguaaucacaauaaauucaguauaucuuaagucuuuuggcuuccugugaacuucuucccuugacaguuuaucuuagcacugaaacaucaaauauauuguaucugcuuuaucuaauacucagaaacaaagaaccuacgugaccaauaucaaauuuuauuuuuuaguucugacuccuaaagucuugcuguccuauccucaaugcuguuaaaaacuucugagguuccaguuuuguuauguggugacuccauuggcuccugucuucgucagucugcuucuucuuggguagcuugggaauucugugcuauggugauaugucuggauacaauuuguaagucagccuacacagccagaccauguggcuuaaaguaauuuuuauccgucuuauuuuuuacucuuaggcaaugcggaauaucaaucccagcacagcaaauucuccaaaaugucagguaggcucuuaucugauguuuuagcacuggaaaaaaaaaaaaaaagauauuaaauuaggaaagagaaacuuacauuccaggguccuguccuuauuggacauuagcccagagaauaacuuugagccaucuuucuaccaagauacucagguuaacauugcccuuccaagaaagucuacacagucugcucccucccugcuccuccuagggaguuucuguuuauuuugauuccauggaggucuuuuuuauucuauauuuaaauguauugugucucaguuguacauccuaucagcuagguaugccuaauuuuuauuugaauagcuuaaaauaguauguguaaugauuuaaaggaauuaauaaauugaacaguaacaaaagcaguauuuacuuggauaggcuacuuuaggaaauuuuagagucaugauacuaugaggaagagaaaaauucuuucuaguggacauuccaaaggaaaaauaucaaaauuaucaggagaguaucugccuggauaguguuucagguuuucuuguuggcuuuuaucagcauucucugaugaaccccagggagcccugguugugaaggcaucuuauuuagaaggaaagauuguggccaauuuuucuucuaacacaggcacuugucugacucgugggaagaaucucguucuuaaaaccaaaaagauuuuagguguuugagguccacaagauuagaagaaauucggagccagaggaucauucuacuucucuuggggcagaagcaaccauauaaugccucaccuucuauguaacuuacucugcacuaugcuaaauaaguacauuguuuuagaaucugcuguagaaguaggaguuggcaaaauucuacucauuuuggauacuguuaaguuguccguuggagcaccaugaugauaaaagucagauacagucuucauagaaaccaguuaauuuugugagagggaaaaucucuauucuucuuuaucuaucucauaaaugccaccauuaaucaaaagaccaagcaagggauaacucaauaauaagccaucuucaccaaaguugagcauagacauucuuaugaugagggggcacuaauauaccauuugacugugaagugcaggauagcauugggucuuuauaacgugaagccauuuuuuucuuugccauuucucugaaguguuuguuuuguuuugucuuuuuguuuuuguuuuuuguuuuuguuuuugagauggaguuucgcucuguugccgaggcuggagugcaguggugugaucucggcucacugcaagcuccgccuuccggguucacaccauucuccugccucagccucccaaguagcugggacuacaggcgcccgccaccaugcccagcuaauucuuuuugaauuuuuuaguagagacgggguuucacaguguuagccaggauggucucgaucuccugaccucgugauccgcccaccucagccucccaaauugcugggauuacaggcgugagccaccacgucuggccugaaguguuucugaaagaagaauuuuauucaugauaaaugaaauagaaacuaauauaggagcagaaauuaacucaaaggagauuuggauucagguaaaaaguccuccaugccaaaaaaauguugaaauuguuuccuuuuuucccaaggucuuauacccugaaucugauaaauaagucaaauucuucuugaucuuuguuucauacuugaauagaaaaguaaaucuuuacuguuauuaaaauuaucaggaauucuuagauuuuuuaaaauaguaaaguuuuagaaaaggugaggcuuauuaguaguaaagcuucuaagauacgaagauuagagguaauuacucagauuugcccagaccagagcaaaaaacuugaaagagguuuuuaaaaaucuucuuugcauaugcuggagauuaaaauauugguuuguuauauaugcuuuaguugucaguguuuaauauuuaccuggcauaauuguggaaaguuaucaguaaauguaugaaauucaaguauaggguuauauuugaaauagaucaagaaaucuggugguauuuguaucaagaaagcauguguauauuuuucucauccuauuauuuucuaaauaaccuuaagguagaugucaggaaauagaucacaaagaagagucaugucuuuucuucuuuuuuuuuuugagauggagucuugcucugucacccaggcuggagugcaguggcgcaaucucagcucacugcaaccuccaccucccagguucaagcaauucuccugccucagccuccugaguggcugugauuacaggugccugccacuacgcccagcuaauuuuuuguguuuuuaguagagacgggguuucaccauguuauccaggauggucuccaccuccugaccucaugauucgccugccucggccucccaaagcacugguauuacaggcgugagccaccgcgcccagccagaagagucauaucuuaagugaagauggcuuuaaauaguguuucucagaauaaucaagaaagcuagaaaggacuuuucagccccaaagaacagaggguauaaagacaucacucaguaucugaacacuagacgcuguuguaaaguuacuggguuuuuaacuuauacuuuguaauagauauuaaugcagcugaguuagcaagcaauagugagaucagugucauuuucuaaucguauaccucauaugcugugggauguggaaagccacuaaacuucaaaaugcuuaugaauuacuacagaagcugucuuuaaguacuuccuauaggauuuaacauaucauguggcuguuguagggugcugugcucguguacacuaacgucaguaugggugagguuaaugaaaaauuccaagauccauggcccaagugauauugaaauguaaaauuuugaaaaaacuuuaaaggcauuuauauaucuucuuaguuaaauauggaaauuaucaccuuaauuuauuauacuauguuggcaggauuuuggaaaaauucauccuuacagagcuuaacuuuuuauuuuuauuuuuauuuuuauuuuuauuuuuauuuugagacggaguuuugcccuugucgcccagguuggagugcaauggcaugaucucugcucaccgcaaccucugccucccggguucaaaugauucugccucagccucccaaguagcugggauuacaggcauucgccaccaugcccggcuaauuuuguguuuuugguagagacaggguuucuccauguuggucagccuggucuugaacucccaaccucaggugaucugcccaccucguccucccaaaguucugggauuacaggcaugagccaccacacccugccaaagagcuuaacauuuuaauuucauuuugguuacuuaugauuuuuauguuucaaaagcaauuuccauucucagaagaaacuuucugaaacuguaaacaucuuugcuuugugagauugagcaguuaaugcuauuuucuagucauaucucuguuacacaucagugcucacuuguaaauuggagagaccuuuugagcaaguggguuuaggaaugcacucuagcuucuguuuuaaggucuuuugagagaagaacuuugaggaaagauaguccccccugaggugcgaacacuucuaccuucucuugugcuuaagaauaugguucuuggacugggggcgguggcucacgcuuguaaucccagcacuuugggaggccaaggcggguggaucaccugaagucaggaguuugagaccagccuggucaacauggugaaacccgucucuacuaaaaauacggaaauuagcuggaugugguggggcgggcgccuuuaaucccagcugcucaggaggcugaggagggagaaucgccugaaccugggaggcagagguugcagugagccaagaucguggcauugcacuccagccuggcgaaaagagcaaaacuccgucuugaaaaaaagaaaaagaauuugguucuuaauaucugggguucccuaguaccuaugagaucgaguuuaaacucugcaacuggcucauggucuguggucaguagccuuuucacucacugguuccaguuaagccaguaacucuuccauuauuagcuaaguguacuccacugccuuguugcuguuauucugcucacaagcuuuuccccauagugagaaccuugcuuauccccuuucuuaccaguaaagauucuucauuucuguuuuaaggcuuagggugagauucauucccaagugcccuuaugagaauucuugaggcagggcacaguggcucacgccuguaaucccagcacuuugagaggccgaggcaggcaaaugaccugaggucagaaguccgagaccugccuggccaauauggugaaaguccaucucuacuaaaaacggaaaaauuagcugggcuugguggcaugcaccuguagucccagcuacucaggaggcugaggugggaggauggccugagucugggaggcagcgguucagugagcugagaucaugccacuacacuccagccugggugacagagugagacucugccucaaaaaaagaaaauuagagaauucuugaaacuacccagaaauaaaaacaacacugcuguauaaagaugucuuaacucaguagccaguauaauuccaauuuagguggucaaaaguaugauaugggguuacuuucauuucugggcaaguaauugcuucaaucuguauagaaauuacaguauaaauauuuggcaacuacugaauaauguguaguugccauuccuuauaggugguaaugaauagacaccaaggucagucccugguuuaaugaauaauaaagcccacaguauugcugaugaggauauuauacugcaccauuaccucucaacagugaagagguucagauguucacaguuguaguuaaugagaacaaaauaauaccauuguucagagcuauaugaaaacaauugccaacaaccauuuuuuuccugaauuuaguaaaaguaaaguauuuggcuuuuuucccuucaaacugucuuucauguuagcuguuucaaaauccuguuaacacuugucuaacguuaucuuucucuucgaaguucugauauuaaauaaaucauagauuuauuugaagguuuuccaaugaauauauuauauuuuauuuuuaauggguacauugaaaacuuuauauaagagggaagauuuagucucacaccucacauacuuuuaacugguuauuucauuuguuuuauuaaacuugccucuuccuuguuauuugaacagugccauaauaacuuugagaccaugauugaguaauacagauuacaaaaggccuaauuccagaagucuaucagaaagaauguagaauccuaggauaaugcuagggaacaccaaccugccauccuguuuuggaugugauuuuucagaguuuaagauuaucaucuaguucucauaacugucccccaauccauguguauacuuuuuuuaaucaaaaaaguuguucuaaaguuaaaacugcuuugguaaauggcauaaacauuaaaaaacauaaagcauuggcucaguguuuuaaugacuuuagaaauaauaaaauguuuuauuacaguuuaaagcuguguuggaaaauaggguauggcaagaccucuaucuuaaacaguuggaagaaauggcauuuuuuucuauuuuuagaauuguugacauaaacugcuaucacuaaggcaaacuacuuacaagacauauauuuuuagaguuauucuccauuucuaaauuuggauuuccaguucacuaaguuaaucuuccuuaaacaaauugauuaccacccucccugcaaaaaccccuugcuccugugccauauauuaucgaaaaaagacacacuuuuauauaaugcaguauuuacuaaagacagaauugcuuuaagaaaguaacacugacuagguaguuagcuccccaaaucauuaauucuuauguuauuuuauuuauuuaagauggaguuucacucaucacccaggcuggagugcaauggcacgaucucggcucacugcaaccuccuccucguggguuccaagagcuucuccugccucaaccucccaaguaguugggauuagaggcgcacaccaccacccccagcuaauuuuuuuuguauauuuaguagagacaggguuucaccauguuggucaggcuggucucgaacuccugaccucaggugauccaccugccuuggccucccaaaguguugggauuacagucaugagccacugcgccuggccuguuaauauuuuuauaugcaacgaacauaguauguuucauuggguucaguaaggaagauaaaauaguguugcuauuuaagggaauuaguagacaugggauagggaaauugcauauauuuauauaagaaaacaggccagccuuuuucucccuuucuuaacaauaugauaugucuuugugguucagucuagccaaaaaacaacaaccucugccucccauacaagcgcgcgugcuagcgugaacacacucagauaacaaagguuucaggaggcagaagugaaauggaaauuucggaaaguauccuacuccaugcuuuaccuagucagauuaugaaggagaaugaccaugaaguuagacaaaugaaagaguuuucuccuauaagguguccugcuucuggggaggaacaguuaaaucauguguuuccaucgugaguaaguuuuauaauuccuuguauucuuagcaaaggauuguaaaugugaaagugaaguuaccauaggaaacuaagaauuuuagauguaaaauagugaaaauuuguuucaggguuaucuagacauuuugcuacuuuaaaaaaaaaucuuaauauggguaagcaugaagucaaauuaauccgaauguuuaaucaaaaauauauuuuauauaaauucuccauuauauuacauuuaaaaauaagccuguauaugucuuauaccuguguuaaaaaaugccaauuauauuucaauaauguaauuuuaucaaaacacauuuucagugaauaucaacauuauuucauaauuggguaaaucuggcauagcucuuuuguagacaguccaauuauguccugagccauaagccuugggacauaauuggauugucuacaaaacugauuucaguugaaacauuucauguugaaaguuacgucuaucucuaagaaguuuuuggauuauuuuauccugaacacaaugccuaaaauuagaauacuggacuaaaaauacaaguuuguuaaacuucuguuuucccaaagguaacuaggauaaauaguuugacagacuuucaaaacuggggaaauaaguuacaggaaauuuagccaaaacauaaucaugcuucuguucuguauuucaaaggucaaauaguuuuuuucuaacugaagcaaguauuuuuagccauuuucuucuguaauaauacaaaaaugugguagcuuuucccauugagcuuguaaaucuuagcuaaugugggacacauuuggagucagagcuaucuacgcuguaaguaaaacuaagggucccaguuuguucuggaggaaacuuugcagggugguucauaaaagaaaacaugaguuugccugcuuuauuuaguggacuuuuauggaaccaagaccuagccauaagccauuggcccuucuuacuacauuucucuccucucauguaaauagcaauauaauuucccagaagucaaaaaagaugcuaagauuauguaguuuugaaaguuaagguauguuggccuuacauaaaaugaugccuuaguccacaucauuuagaaaaauaaugagaaaggcaguaaaaguagucagaagucuggaaacacuuagaauauuuuuaagguuuuuuuaaauuuuuagaguauccaagagaaacgaaagcauguuucuacacaaagccaaaauguagaaauaacccaaaugccuaucaacagaugaauaaacaaauguaauauauuccuacaguggaauacuaguuagcaauaaaaaggaaugaacuguggauauaacaugaaugaaucccaagauuaucacacuaagugaaaaaguacaugcuguaugauuuuauuuuagaaaauucuagaaaauaccgaauaaucuacaaugacaaaaagcagaugauuagcuucugaagguugaaguaggggaggugagaaguagugggagaaaauuuugaggaugauuaucuuuuuuuuuugagauggagguucguucuuauugcccagguuggagugcaauggcgcaaucucagcuaccagaaccucugccucccggguucaagcgauucuccugccccagccucccaaguccucccgaguagcuugaauuacaggcaccugccaucacacccagcuaauuuuuuguauuuuuaguagagacgggguuucuccauguuggucaggcuggucucgaacucccaaccucaggugaucugcccaccucacccucccaaagugcugggauuacaggugugagccacugcacccggcugaggaugauuaucuugauuguaguggcagcuucacagguguacacacaugucaaaacucaucaauuuaugcacuuuauaauuuauuguauauccguuauauaucaaaaagcuuuucaaaauuuacuuggaauaucuaaucaccuguaacuaaaaguuucaaaacucagcugaguauuuauaccuuuaguaugcuauccauaaucugcauauauguuauuuguaucauuggccuuguuacauuagagucaucccuugggggauugguuccagcaagucccuuauauaaaauggcaugcuauuugcauauaaccuacacacauccuccuguauaccuuaaaucauuucuagauuacuuauaauacaauggaaaugcuauguaaagagcuguuacacuguuauaacuguguugucauucuguauugggaauaauggcaagaaaaauagucuauauauguuaaguacagacacagccuuccauuuuucuucucgaauauuucgauccauacuugguugccuuacggauaugaaaggcuaacuauauuuguuuucaugccaaauucuucccuauuugauuaauaauacacuccugccaccaguaaguaaagugucuuuuuuucauugauucuuucaagucuaauuuaggugaauccuuagguuaguuacuguuagucauggcucaaauauagguuuaaugagaagaguguuuccauagcccuucaaggggucggauaucuccuuagguaacuuggaaugauuucccugcuuacugacaucucuaaguuaucuuucuuuauaaaucugcauaguugguucugcagugucugcugacauagaaauucaguuguuaaaugaaguaaaaaguaaaaauuucacggcuuuuaacaaacauaguggccaaauucaaagcagcaagaacauggagagucuagucugcacaugauacuaguuuuaaccuaauaaaaaguaggaauuuuauuuaaaaggcuaaaauaaaaaguuguaaaaauaauaugaaaauuauagccaauucaguuauuuuaguuaugacuuacaguuuaguguuauauauuuguuuugugcuacaaacaggagcauaccuucuuugauaaaaagcaaaugagagucuuuagaauauucuccaauacucccauguuugucacagaacccuaggcaucagccuuuucuggagucuauaauuuuauucauuuuaaaguuuauuguuaaauacauccucauauuuuaagagcaaaauaaauucuucaaggaauuuuaaguuguuuuaugcuccagaguaauucauucacucuggccuuaggggguacagcaaaaauaauuacgauauuuugugauaagugcuguguucaggauguuaaagacaugacaugucugugucuaauccaaucucaagaucgagaugggaucaccacggagaguuucuucaaaaagguagugccuucaccaggucuuaaauaauacggaagaaaggcaugguauugagaggauguguccucccacagacagacuacaaugaguguaguaucacuguuuuaaagucacuucucacuuuguaagaugagcaugggaggagucaaaaguagaagauagaaaagaaauaagagggauccccauaagacugcaagaaaaguuaaaaagaugaugaguauaaaugaaguuacuuuugaggcaagcaggaagagguggcaagaggggccagaaaaaucaaagauuauaccugaugaccugguuuuuuuuguuuguuuuguuuuuuguuuuuuguuuugagacagagucucgcucugucaccuaggcuggagugcaguggcgcaaucucagcucacugcaaccucagcuuccugaguagcugggacuacaggcauacgccaccacgccuggcuaauuuuuuuauauuuucaguagagacgggguuucaccauguuggucaggcuggucuccaacuccugaccucaaaugauccgcccaccucagccucccaaagugcugggauuacaggcgugagccaccacacccagccaauggccucaguguucuaauguagauggaaaagaaauagacauggacuucacuggcugggcaugguggcucacgccuguaauccuaacacuuugggaggccaaucgcuugagcucagguguuaagaccagccugggcgacauauagugagaccuugucucuacaaaaaaauuuggaggaagagaaaagaaaagaaauggacuucccugaauaggggcuugagauaguaugccauauuuggaguagugaccaugaggaugugaaaaacaacugaccaagaacaaaacaaaacaaaaaaaccaauaagugguacuaggguccauccaaaaccaaagaccuuuaauuuguaaugauaacauucuggauaguuaugugauuucuuuuuuuucuuuucccuuagcauuucucagcaaucucagaaugaaaauggaacaaauacacuuuggcauugcuuugggguugggauuugcugggcugagauaaaauuauauguacaucaggaaucuaaaaggugcuuaugcuguuuugaaugaucagucaugaauuuaagcuuguagggaaggagaaaaaaaaauaagauaccaaaagacagccaauagacuagacuaguaaggagagaugggucuggagucucugagguuggagggcugguagaguggacaugagucuaugcaggaacugguuagaaaaaaaugugagaaaguaaaauaagugcauguaagauuuuggggagagaaguuucuaagccaguucuuggguaugacugagggaauuaaugauugaaauacagugaugaaguggucaguaucauuucgguguaaaggcgaucccggcauuucaacaauggguuauuauauggguuuuaugcauggaggucauaauuccaaugugaugaaugcaguuggaaugaagagaaacacugaucaucgucucaaaacaugacuuaagauuuuagaguugguuugguuucaaauaacaggaucuuaguggcugugcaauggguguuugaguggaguggagaugaaggucacuggaauccagaagguucaggaagcugucagguuaagugaauuguccauuuaauacugaagcauguuaagaggcauggagaauacuuggaguggcaagaggcuuugaccagacuccagaauuuucccguauauaagauggaguaacgaagagaucaguaaauuugaguacaagaagcaguuuaccuugcagggaagacaggcaaacaauuuuggcauuuggccaagucccuagguucccucucaggacauugguguuuguuuuuuuuuaaaguacaggauugaaaagaaaaggaauuucauugauacaguuaagaaaauauuaaauagaaacuugugauauaacgugcuucuuuuuaauguauaaauaacaagaucuaaggcugggugcaguggccuaugcuuguaaugccagcacuuugggcggccaaggaggguagaucaucugagccugggagauugagaccagcugggcaacauggcaaaacccugucucuacaaaaauacaaaaaauuagcuggguaugguggugugccucuguggcugcagcuacucaugaggcugaggcaggaggaucacuugagccuagaaggucaaggcugcagugagcuauaauugcaucacugcauuccagauugggugacagagugagacccugucucaaaaagauuaaaaaaaaaaaaaaucuagaagcacaucuuauaacguaacuacuguagcauugaaauagcaaugaucauaaaugguauuuuaaaauauuugcaacaacuacaaugugauaugaaaacauuuauauguucuauuggugaaaaguuagguacagugaauacuaauggugcauacuacauuggagaaaauguugacaaauuuagcgaaaguuaauguguaauuuuuuuuuuuuuaccccauugaaguucagagacucucugaauucugucaugguccgcugguuaagaaacucugguuuaaaggaugguauauccagaaggcauaaaccuaaagaaaaauaagugguauuugcaugcaggagaauuguaguuuagaaguggcagcguagagcuaggagaagcuuuccauacuucaggaccccauggcgauuguggaggugagggcuggagaugguggggccgugccucagugagcagacuuggcucagaaagcuguguggaaggaugacggagucaggccaguauccuuugugauaagaaacuguauguauuucaaaucaaacccaaaaaguagagggaaagaaagcugauggucuaguagagaugauguuuacgauagguggagaggcacagugaaaauucuuaggaggguaagaaacagugaacagauaaaggagagaaaaaggacagaguaguaaugagugugcuacggaugggucacagugagaugaacuguuuuugagguccugggcaaauacaggcugaaaccugggagguuuggaagcccuugaaggcaggccuucugcaaccaucagaguagcaaccuacagccuuugcucagguuuacagggagaauccugcugagaaauuguuggaugacccugaagaaauuuuaccccauuuuaaauauuauguuugugguggagaagccuuggguuuguguuuuaacuucugaugucuuuuuuucauuuuccuccucucucccugcuagaggauggaacauauucuauccagcucaggauagaaaaaccuaaagucaaaaugagacauuuaauagcaaagugugaaauaguguuggggguuggggaaggauuggugucuuauaguaaaaucaucagaugcuauucuuccuacuucuuuuuuuuuggcgggggagggggucgggggguuccaaacacacaaaaccauauaagaguugucgaguaaaagcaaacuuuaagaauuauuuuuuuagggccgggcgcgguggcucacgucuguaaucccagcacuuuuggggggccaaggcggguggaucacgaggucaagagaucgagaccauccuggguaacauggugaaaccccgucucuacuaaaaaaaauacaaaaaauuagcugggcgugguggugcgugccuguagucccagcuacucgggaggcugaggcaggagaaucacuugaacccaggaggcggagguugcagugagccaagauugcaccacugcacuccagccuggugacagagugagacuccgucuugaagaacaaaaaaaaaaaaaaaaaaagaagaauuuuuuuuuaaagaccagacuugccauucuauaauaacccaaaggaggauuugggaguaucuuccagaguaaggaaaauaacaaaaagaaaacaaaguagcaaaauguauauaggguggggggugguuaauaugacuagacagacuuuaaauauauguaacuuaauuuuuagucauuugaaauggauagaauuaggucauucugauugggaaauguauuaacuuuaaaguagauguuuuuaaucuaucugcacgguuacucugaugaacguuuuauuucuuuaaaccuaacauuaaauguguuaaucaguagauugauucucuuuggcuuuauuuuuaauuaggaguuagcccugcguagccaguuaccaacacuggagcaggauggugggacucaaaauccagugucuucucccgggaugucucaggaauugagaacaaugacgaccaauagcucagauccuuuccuuaacagguuggugaaaguugcuacuggugaauaucugaaaaggaucauugcuuuaaaaucauucugcuuagugcuuguaauaggcuauuuggaacaucugugugggccaaaaaccauagcuguaaaugaaucucucuguaaauggcaaguacaugcagaguugaggauuaaaaguugucuccugugagaggaagugaacuguucagacuuguacaagggauacuuauucaaagucaugacguguuugcuucugccuauacuguugacuaacaguuacuuaaaauuacagaaucaugaaggaacaugugaaugccuuucugugaaagcaaaugaauuucauguuaaaccuacuuaggauugcauuauaaggaucacuggaaggaauuuuccacauagcuauucaagcuaaaacguuucacccagcagcacuguaaggccucauguucuuaagggcuauaguccaaggagauaaaauguaagguugugccucuuucaaaaaugcacuaagauuaacggcaguauuugaaaauaacauagcuuagggaugcuucuuagugaguuaccacaaauccuggguuucagacagauugcaauauuacauaaacugccauuuugaagucuguaagcugaaacaggucauauucuuugccuaggaagucauuuaagauuaagauuuaacuaaaauuccuucuucuagguuguggaguuucaaacuuuuuaaaauaugggauuaguuuacgcuuuggauuccuuuucuaacugauuuaaauaacacacuuucuuaaauacucaaagguauuuugcacuaggaaaacuauuacaccaccuuuucaguucucaccaauugaauuggaaacuuaguaauuccaagagaaaauaucuuauccugcuaaaaguauuuagugcaauagaauucaccauuuacucaguuuuuaagauuaguacugguggccuaguuggaagguuugauuuugaagaccaucuaaaauguauuuuaaguuuguauuuacucuucugacauacacuuuaaaguucuaaaaguaaguguauuuauauaagauuauaguucuagacuuaaacugaggcuaauuaagagaggcauagccucagaacuuuuuuuccaacaaggaaaauuucauauccauguaauuccaguaccugucuuguugaaggggcuauauuaaucccagggauaaaaauuagaccauuuuaaaaauggauaggcugcauauccuucugacagucacuuaugaagauuuuuuuucuuaaaacuuuugaugagagcugggcuacaauuugagauucuauuuucugggaagaucagaguggcagauaaucaguguuacuaaucuaagggcagaauuguauaugcauucucugcaguacccccaguuucuaauaauaacauacaucugacuuugacuuuuuuuuucuuuaaaaaaaaaaacaacucuuggcugggcaugauggcucaugccuguaaucccagcacuuugggaggccaaggcaaguggaccaccaccugggguaagaguucgagaccagccugaccaacauggcgaaaccccaucuuuacuaaaaauacaaaauuaguugggcauggucacgcaugccuauaaucccagcuacucgggaggcugaggcaggagaaucgcuugaacccgggaggcagagguugcggugagccgagaucaugccguugcacuccagccugggcaacaagagugaaacuuggucucaaaaaacaaaaagacaaacaaaaaaaccucuugaugguuuuucccuuguuuacuauuugauuuauguauauuccuuaagcucuaaauacuuuuugccccaacuugccuuggcauugacucuuaguaguaaugcugaguucccuuaguucccuuuuacuuuuacccucaaagcucacucagaugucccccuccaugaaacuuuuacccuuuacuucuaagcucccuguuuguucugaaagcacugugcuuacaucugaguucauauagccccuaaauaugauucauuaguauauuuguucauuucccuccuugaaguugugagccucucacaaaacauuguuuguaggugguggugauuguuaaccucuuuauccucaaagccuagucuaaugccugucauguaguagcagaugcucagugaauguuuacugaaugaguggggccuguaggaagugggguucugcagggagcaguuccucaccaggaaaauggcccuguaaacucuguccucaggaaugcccaugugcuuccccugugguuuggaaugaacucugcgcaacucuguaaguucaguuauucaguaauagacuaaaaugucugaugugugucccaugcuuagcagccgaauagagugaugacuaggaccaggcucuugucccagaucagggcaggcaaaauacaaacaaaccacauccugaggccuucucauauauggcugcauuguauaccaauggucucagaggcaaauguguguuuucuuggaucugugugaggcuuuugagccuuggcaaaaucuggcagaagcauuagaguaaaccagugauggcaguauauagaaugaggggagagagagaacaaggcaaaugcauugcaucauuuagggaaggcaguugggguauugacugagcuuuuagccuugagcaauuguuaaacuuguuuuuauuuuuuaacuuuuauguaaguuaaauagcugcuuauuaaauguacaagccguagagaaaguugaaguucacacucacacagaccauugaagaauaacagcugccuugauuuuaugcguuucucuaagauuuuguagaguuaguagaacucagggaaugccagcugaugucuagaugcuacuagcuuaggaaaguguucuauuucucaggguaauggauauuuaccauacuuuuaauguaaaucugggaaaccuuacuuagucuaaagugaaaaucuguguugggucauuuuauuuucaagggaugugccuugcaguuuuuuguuuugcucuuuucuuuaacuggagcuauaugauuucccguuucguuucguacugaaguguuugaggcuuuuuccucccccgcccaaacacagaagcaaggagaucaagccacgaguauucuuaucuuauuggcagugacucaccuauuuuggcucaguccuaaaaggaauucuggugguuuauuugggguugauuuuuccuuggcuuauguucucugcacaauagcuaggaauuuaacuugagucuagugcagaccugucuccucgcccaccuggaguuuguguugugacgucucugugccaccaccaccuggagaauugaggccuugggacaaguaaguuguauggguuccuccgcacccccagauucaaaugauauuacagagaggagaauacugaugcagagaauuuucugucagccaggaaaacuaacuggggguaucuuuuuuugucccuuauugucaccaagcacagaaccuuaggagaaaucuugguuccuuagagcugccagcuucaauuaggauuaacuugucuauuucacuucauagcacaagcccugucuauggcccugagggagggugcuuguuucagacauugcaggacaggaauuuucacuaauccucuuugagaauuauguugcugcucagcagguguuuauuuuuaccuugaauugauuuuuaaaauuuuuuguguuggucuuuaacugucauguuuauguaguggcaccuaucacucucgagaugagaguacagacaguggacuaagcaugagcagcuacagugucccucgaaccccagaugacuuccugaacaguguggaugagauggauacagguugguauucuuuauuccucuuaguaaccugacuuaacagugggauauguuaucaccaggucucauaagguauuguaagcaaagaugauucagaagaaaaccaauuaaaauccuguaaauuugaauuaaauugauccugcuuugucucuauacggugauuuguaacuugucuuuuccuaguuuaaaaaaauauauaucauggauuggccgggugcaguggcucaugccucuaauuccagcauuuugggaggccaaaguggguguauuguuugagcccaggaguucaagaccagucugggcaacauggugaaaccccaucucuauaaaaaaacauacaaaaauaagucagcugucaugguacaugccuguagucccagcuacucaggaggcugaggugggaggauggauugagccccggugaucacaccacugcacuccaguuugggugacagaaugagaccucuucucaaaaaaaaaaaaaaaaaaucauaaauuggauauauuagcucuauuugaauaaaacucugauaacaugacuuauguuagcauguugaucuuaauuggcaggacaaacugacaacccuguuagaacaucucucuccuuauagauuaguguccuuaauuuugagagaugucuacauguaauucaguguuugucuucaucuuuucucuaagaguuuuugguccaccuuaaguguuauggggcucaggaaaccaggugggaaagacuaggagguggggcucacuuacuuuguuagaauaguugcagaaggccaggugcgguggcuuaaaccuguaaucccagcacuuugggaggccgagguagccagaucacgugaggucauaaguucaagaccagccuggccaacauggugaaacccugucucuacuaaaaauauaaaaauuagccacauguggugguaugcaccuguaaucccagcuacucgggagacugaggcaggagaaucauuugaacccgggaggcggagguugcagugagccaagaucacaccacugcacuccagccugggugacagagcaagacuccgucucaaaaaaaaaaaaaaaaaaaaaaaaaaagaauaguugcaggggucuugcaggagcuaagaaauaccugccucacagggguaauuacggaagcauuucuccuguggcuuaccuggcaaccauugcccuagaguugacaacugccagagugcaugaauuggcagggaaaugaagcuguucuuuagcuaccaacucuuucacuaacugcuucuauucugaaaguguuuagcaaggcuuuugugccuguauucauccagcuccuggcuuugaugcuuucuagaauccacacuaccccuccucucugauuaucuagauguuaaaucauccuuaggagccacuucaaacccauuucacacacaacaccuuuacuuacuccucuaaucuguauugcucucuucuccagaccccuguagcacuuaaugguuuauguuaguuuuucugaaaguauguucuauugaagcucugaggaguguuaauguugucauaugcaaaaaaggcucuguggccaaguaaguuugggaaaccuagaagcaaggcuaggaagauggauuuauucaaagcccucugggaaggcuuguuuugcuguuaggaaggugcaucuccuaaggguagaauaaaguauucuugcagucuuucuauuuuaguguuucccaaaguauauuuaaggccaagguaggucuauaccacucauguuuauguuuagucuuauuaugguggugcuuaucuggaagacaggguagugaugcugucguguuguguacuuguucuuucucccgcugcugcauauaauuuuucaagggcuuuuuuauuuuuuucaugacuccuuuagugcucagcacauaauagcaaucaagcuguuauuggauaucugaacaauguugaagcaaaaguaaacuuggcauuguuauuuuguuaucugugaguuguuugaccugauauaaauucuagguaucaguuuaggucagucaggagcgcuuuucuuucccugugcauuucucugugcucauaugauacagcccugauguuagcuuuucaaaaaggacuuuguuaucucuguguguuuccacuaggugauacuaucaaccaaagcacccugcccucacagcagaaccguuucccagacuaccuugaagccauuccugggacaaauguggaccuuggaacacuggaaggagauggaaugaacauagaaggagaggagcugaugccaagucugcaggaagcuuugaguucugacauccuuaaugacauggagucuguuuuggcugccaccaagcuagauaaagaaagcuuucuuacaugguuauagagcccucaggcagacugaauucuaaaucugugaaggaucuaaggagacacaugcaccggaaauuuccauaagccaguugcaguuuucaggcuaauacagaaaaagaugaacaaacguccagcaagauacuuuaauccucuauuuugcucuuccuuguccauugcugcuguuaauguauugcugaccucuuucacaguuggcucuaaagaaucaaaagaaaaaaacuuuuuauuucuuuugcuauuaaaacuacuguucauuuugggggcugggggaagugagccuguuuggaugauggaugccauuccuuuugcccaguuaaauguucaccaaucauuuuaacuaaauacucagacuuagaagucagaugcuucaugucacagcauuuaguuuguucaacaguuguuucuucagcuuccuuuguccaguggaaaaacaugauuuacuggucugacaagccaaaaauguuauaucugauauuaaauacuuaaugcugauuugaagagauagcugaaaccaaggcugaagacuguuuuacuuucaguauuuucuuuuccuccuagugcuaucauuagucacauaaugaccuugauuuuauuuuaggagcuuauaaggcaugagacaauuuccauauaaauauauuaauuauugccacauacucuaauauagauuuugguggauaauuuugugggugugcauuuuguucuguuuuguuggguuuuuuguuuuuuuuguuuuuggcagggucgguggggggguugguugguugguugguuuugucggaaccuaggcaaaugaccauauuagugaaucuguuaauaguuguagcuugggaugguuauuguaguuguuuugguaaaaucuucauuuccugguuuuuuuuaccaccuuauuuaaaucucgauuaucugcucucucuuuuauauacauacacacacccaaacauaacauuuauaauagugugguaguggaauguauccuuuuuuagguuucccugcuuuccaguuaauuuuuaaaaugguagcgcuuuguaugcauuuagaauacaugacuaguaguuuauauuucacugguaguuuaaaucugguuggggcagucugcagauguuugaaguaguuuaguguucuagaaagagcuauuacuguggauagugccuaggggagugcuccacgcccucugggcauacgguagauauuaucugaugaauuggaaaggagcaaaccagaaauggcuuuauuuucucccuuggacuaauuuuuaagucucgauuggaauucagugaguagguucauaaugugcaugacagaaauaagcuuuauagugguuuaccuucauuuagcuuuggaaguuuucuuugccuuaguuuuggaaguaaauucuaguuuguaguucucauuuguaaugaacacauuaacgacuagauuaaaauauugccuucaagauuguucuuacuuacaagacuugcuccuacuucuaugcugaaaauugacccuggauagaauacuauaagguuuugaguuagcuggaaaagugaucagauuaauaaauguauauugguaguugaauuuagcaaagaaauagagauaaucaugauuauaccuuuauuuuuacaggaagagaugauguaacuagaguaugugucuacaggaguaauaaugguuuccaaagaguauuuuuuaaaggaacaaaacgagcaugaauuaacucuucaauauaagcuaugaaguaauaguugguugugaauuaaaguggcaccagcuagcaccucuguguuuuaagggucuuucaauguuucuagaauaagcccuuauuuucaaggguucauaacaggcauaaaaucucuucuccuggcaaaagcugcuaugaaaagccucagcuugggaagauagauuuuuuuccccccaauuacaaaaucuaaguauuuuggcccuucaauuuggaggagggcaaaaguuggaaguaagaaguuuuauuuuaaguacuuucagugcucaaaaaaaugcaaucacuguguuguauauaauaguucauagguugaucacucauaauaauugacucuaaggcuuuuauuaagaaaacagcagaaagauuaaaucuugaauuaagucuggggggaaauggccacugcagauggaguuuuagaguaguaaugaaauucuaccuagaaugcaaaauuggguauaugaauuacauagcauguuguugggauuuuuuuuaaugugcagaagaucaaagcuacuuggaaggagugccuauaauuugccaguagccacagauuaagauuauaucuuauauaucagcagauuagcuuuagcuuagggggagggugggaaaguuugggggggggguugugaagauuuagggggaccuugauagagaacuuuauaaacuucuuucucuuuaauaaagacuugucuuacaccgugcugccauuaaaggcagcuguucuagaguuucagucaccuaaguacacccacaaaacaauaugaauauggagaucuuccuuuaccccucaacuuuaauuugcccaguuauaccucaguguuguagcaguacugugauaccuggcacagugcuuugaucuuacgaugcccucuguacugaccugaaggagaccuaagaguccuuucccuuuuugaguuugaaucauagccuugauguggucucuuguuuuauguccuuguuccuaauguaaaagugcuuaacugcuucuugguuguauuggguagcauugggauaagauuuuaacuggguauucuugaauugcuuuuacaauaaaccaauuuuauaaucuuuaaauuuaucaacuuuuuacauuuguguuauuuucagucagggcuucuuagaucuacuuaugguugauggagcacauugauuuggaguuucagaucuuccaaagcacuauuuguuguaauaacuuuucuaaauguagugccuuuaaaggaaaaaugaacacagggaagugacuuugcuacaaauaauguugcuguguuaaguauucauauuaaauacaugccuucuauauggaacauggcagaaagacugaaaaauaacaguaauuaauuguguaauucagaauucauaccaaucaguguugaaacucaaacauugcaaaaguggguggcaauauucagugcuuaacacuuuucuagcguugguacaucugagaaaugagugcucagguggauuuuauccucgcaagcauguuguuauaagaauugugggugugccuaucauaacaauuguuuucuguaucuugaaaaaguauucuccacauuuuaaauguuuuauauuagagaauucuuuaaugcacacuugucaaauauauauauauaguaccaauguuaccuuuuuauuuuuuguuuuagauguaagagcaugcucauauguuagguacuuacauaaauuguuacauuauuuuuucuuauguaauaccuuuuuguuuguuuaugugguucaaauauauucuuuccuuaaacucuu

SEQ ID NO: 192013 - RNA, 29092 nt, Homo sapiens
accggaagcgcucuagggaacccuggagcuuccgcgccugcccaguuuugcuccgaaagacuuaccgaggagggagcuugcggugcguucugggaaaguugcugggccagcuccuuuguuuccagucugagcguugcguucgguuucccgagggucuucugaggcaccgcggcugcgggcuucugaguucccggcucuccgcagggaagccuccucuucguaccucguuuuuuggcucgugggggguccucccaccgcuggccgacgcagccagcauguccggggugcgcgcagugcggaucagcaucgaaucggccugcgagaagcagguccaugaggugggccuggauggcaccgagacguaccugcccccgcuguccaugucgcagaaucuggcgcgucuggcccagcggauagacuucagccaggguucgggcuccgaggaggaggaggcggcggggaccgagggcgacgcgcaggaguggccgggcgccggguccagcgcagaccaggacgacgaggaagguaaggccugcauccgcugcccgagucccccggucugggucccagcacccgcgcgggccuccgccucucccgcgaugggggugaucuugugcgugcgagaacuuuugagugucccucuagcggaagcguaaggauacuuggucgucaucuuuuuguugcugccggacaagguaggacacgacuuuacguaauacuccugcgggucuccuugaauggcagcguuuagagacacugucaaaccgugaaauguuuaaaugaaugcuucucuguagagggccuuuaauguagcacacuuaguggcuaaaagagcccuagaucggggcucugccccuugccggcugugugaccuugggcgaguuacuuugcauccuugugcggugugaaugaugauaguagcaccugcagaaaagaggucuguuuugacugaaaugugugacgagguccaagagguaggcggguccagaucauguagaacccaguaggccgggauaagcguuugacuaguguuaagaccacugaaagcuuuugcaggauaaguagagaugguuuuguuaaaguuuacucuagaugcuuucuaauaaaugaauuauagggaaagcaaaacuggaagggaggagacuaggagggaagugaagaaauaaugaguggguuucagauucucauuauugucaaggauuuuugaaaaaaaaaucaaaauucuuaauuuaguuaugcagcacacccaguguaaaugggaauuuaaagaugucauuucagggcagugcuguuaggauuauuaggggucuauuugcaaaaaaagguaaauacuacuuuauaccucacacaaaaauuauuuccacaguaauuuuugaggauugaagugccaaaugaagaaaguaaaacaaaguguuagaagaaauaaugaaagaauaguuguauuauucugggagucggauagaucuucuuaauuucggaaauaacaggacaggcaugguggcucacaccuguaguuccaacauuuuuggaggccaagguggaaggaucacuugagcccagacuucaagaccagccugagcaacauagggagcuccugccucuacaaauuaaaaaaauuagcugggcgugguggugcacgucuguggucccagcuacuggggaggcugagggaggaggauggauucagccagugagaucaaggcugcagugagcuaugauugugccaccgcacuccagccuggguaacagaacaagacucuaacauccacacacacaaccacacaccuaccuaccuuacaaaguauagauauauuacuuacauaaaauuuaaaaauaaugggaaaagaugccauaagcaaaguaaaaagauaaaugacagacugggagaaguucuacacauauaacacaaauuuaguugauaucuucucuauucaaaaagucccuucagacugaaaagaaaauaaugacacuuuggaaaaauaggccaaagguaucugaaggcucauagaggagagacuucagauaccaauaaacagaacauagacucaaucucauuacuagggacugggaaauuaaaacaugauuaagauacucuuuccaugcacaaaauugacagaaauugaaaagauuguuaauauucaggguuaggaaugugaacugguagugauucugaaagacaauuuggcaguuuaauaugugccaacauuuaauuuuaacuuuuuuugguuuguuuuguuuuuuuuuuugagauggagucuugcucugucggccaggcuggagugcaguggugcaaucucggcucacugcaaccccugccuccuggauucaaaacgauucucccacuucagcuucccuaguaugugggacuguaggcgugcggcaccaugccuggcuaauuuuuguauuuuuaguagagauagaguuucaccauguuggccaggcuggucuuaaauaccugaugucaggugauccacccugccucggccucccaaagugcugggauuacaggccugagccacugcacccagccgaaacuuuuaaauguauaucuccuuugauucacuauuaccacgacuaaaaauuuaaccugcagaaaaaguugcacauauacaggguauauauucaagauguuuaccacugcuagcauuguuggaagcaguuuacuuguuggaagcaaucuacauguccguuaaauacaagugguuaaacauaccguacauccauguuccagaauaucauacaguguuagaagaauuaaguagacucauaaguacuaacauggaagugucucuaggaaauauuaagugggggcgggggaaaggcaaguaauagaaaauuggaaauagauguauguaagugcauagaaaaaccuuugaaaggguacacucacuggggccgggcgcaguggcucacgucuguaaucccagcacuuucggaggccggggcaggcagaucacgaggucaggagaucaagaccauccugacuaacauggugaaaccccgucucuacuaaaaauacaaaaaauuagcugggcgugguggugggugcuuguagucccagcuacuggggaggcugaggcaggagaauggcaugaauccgggagguggagcuugcagugagcugagaucgcgcuacugcacuccagccugggugacagagcaagacuuugucucaaaaagaaaaaaaaaagaaaagaaaggcuacgcuccaucuguuaauagugguuaccucucaggaggggagagaaucggguggggaaugaaggaaaacuuucacuuuuuacccucuaauucuuuauugugugaacucuauauagugaauguucauguauuuaaucacaauacuuuuuuuaaugguuaaaaggaagauaugcuaauaguggcuggcuuacaggucauuuucauuuuguacuuuucuguauuuuggaaauuuuguacaauuguaaauucaaguucuaaacacuguaagaagauuauuaaaaagguuuacauaaauuugaaaagagauuugagucuauaauguuguaaugauaaauuuaaccuguggaaauagaugucauauucauuuugcgauuguaggaaugcuaaugugaauguuaacaaaguuuuaagaaacgguagaggagauggcauaaauaagagaacaauuugaaauuuaauuaauuauuucuccuuuuaguacuuuuuaaaccuaagugagcugucugccauucaauguaacgaauacuucuguauuucuuuuuuuucucucucucuuuuuaggagugguaaaauuucagccuucccuuuggccuugggacucagugaggaacaauuugagaagugcccugacagagauguguguucucuaugauguucucaguauuguuagggauaaaaaauuuaugacucuugauccugucucucaggaugcacuuccuccaaaacagguauuuguggacuuuaauugaauaauaaaauuuuauuuauuaaaucccaggacccuuuuuuggcuuugugccuguuguuccauuuuccuuucuugcaaaauuaaguccagaugaagauuuaaagacuaacuggucuaaaacaaagccauacaacugcauuuccuuuauuuuuuuauuauauaccuaugauccuuggaagaguuaaguuucauuaagaauguaauaccuuuaaggccaggcgugguggcucacgccuguaaucccagcacuuugggaggccaaggcgggcagaucacgaggucaggagaucgagaccauccuggcuaaugcugugaaaccuugucucuauuaaaaauaacaaaaauaagccaggcgugguggugggcaccuguagucccagcuacucagaaggcugaggcaggagaauugcuugagccugggaggcggggguugcagugagcugagaucgcgccacugcacuccagccugggcgacagagcgagauuccaucccaaaaaaaaaaaaaaaaagaauguaauacuuuaaagguuaccaaaucuuaacaaauucuuauagccuggguccuuggucugugauauauuacacaaaaaugugaugauauaauggcuuuggaaucagguagaccuggauucgaauccugccucugccuucauuaacugugugaccuuaaauuaagcaaguuauuuucucuuaagucccuguuuuuccaucuaauccuuccuucccuuuuuuuuuaagggauggauuagaaaaguuaggcgaaauuauggagcauauugagagcuggguagaauugcugcuauuucauaaacaguguauucaauuuuugaacauuugaagaugaaagagaaguagcaggaagaugaguuggugaauagucugaaaucauugaggcuacuuggguccuuaaggaaaacaagugucaagaccauaaccaaauuagucauggagaagaaguaaugacuguuagaacccauuuguaaauaaaauuaauugaauagaauuacucacauaguaauaguuucagaaucuagaaacauugugcugggggacuaauagaguucccuaaaucugcauucuucauuuuauagagagaaaacuaaagcuuaaagagauuuguaauauguucaaguugcugucaagccaguaguuagggagccaagacuagaacuccagcaccuaacucauagccccacugccuuuucuacuauucugugcuuuucccagaagggagucuccaggaauuucuuaauaucuccaggaacucuuuuauuuacguucccuaauacaaucaaaagauuauuuugauauguuuaugaagcuuuuuaugugauuuuugacucucauacagccagaaaacuguauuaaacugguuaguaaaauacacaaauuauggugauuguggauauuuauauaugcauaugugauacauagauagugacuucugaucaguuuuccaaaaaauuaggauucagugaaguacauuuaauauuaacaauggcagggcacgguggcuuaugccuguaauuccaacacuuuggggaaccaaagcaggaagccaggaguuugagacuuucccaggcaacauagcaagacccugucucuaccaaaaaaaaaaaaaaaagccaggcuugguguugcacaucuggagucccagcuucucaagaagcugaagcaggaggaucacuugagccaguaggucaaggcuauggugagccaagauggugguacugcauucuagacugggugacagaacaagacuccaucucaaaagaaaaaaaguuaaugcugugugauuuuaguccuaauuccaaaagcacuuuaauagcuuaugguaagaugcaaaauaugguaagcuacaaaauacaagauaauuuuacaguuauacccauugcagucauucauucauucauuaaaucaaauauuaugugccaggcauuguucuaggguuuguggauauagugauuucugccaucaugcagguuaccauugaagcagagauuauagauguuaaucagaaguauaaugagugccaaaaagguuauauauaacuauauguguguauguacaggauagggggcuggcaauauauaaggagaggaauggcaguacauuaagaggggacccuaacaggcuggacagaguugaugcaaugguaaguucugaguagaggccauuguaguguuuuugguuuaacauaaguaaagcuuugagugaguuggacaaagaaauagguuaagguuauuauuuuauuaaaaacacuguuauguguacuugccccuccuuuuugcuuuuuguucacuucauuuuauuauugauaaaauguguaauuuuagagucauuuaaaaauccugcagaacugcauguuuggguuguuuuugacagaauccucagacguugcaauugauaucuaaaaagaagucacuugcuggagcagcacaaaucuuauugaagggggcagaaagacugacuaaaucaguuaccgaaaaccaagaaaacaagcuacaaagagacuucaauucugagcuuuugcgauuacggcaacacuggaaacuucgaaaaguuggagauaaaauucucggagaucugagcuacagaagugcagguaugaauaauuauuaaaaacuauacuuucuggccaggugugguggcucaugcguguaauccuagcacuuuggaaggccaaggcaguuggaucacuugaggccaggaguucaagaugagcccaggcaacauggcaaaacccuaucucuaccaaaaaugcaaaaaauuagccaggcgugguaacacgcaccuguaauccuagcuacuugggaggcugaggcaugagaauugcuugaacccaggagguggagguugcagugagccaagaucgcaccauugcucuccagcaugggggacagagcgagacucucucaaaaacacaaacaaaaacaaugcuuucuguguaaguauaauguuaaacauccuucuauaauguauuauuucucagcuauguguuacguuucaaaauuuuaauuucuguucauauaagccaaaaccacucuuaucagaaccuuauaauaaauagccuaguuucuauuucaaaaccuuuuagguacacuuaacagaaaguucaaagaugggguuuaugugcugacacaccuugaagcauaauugacuuuuuaguuagaaaugagguagaacuacacuccucaaucaaggccuuaccuguaacccuuaaaaacugaacauggcggggugcaguggcucacaccuguaauccuagcacuuugggaggcugaggugggcagauugcuugagcuuaggaauucgauaccagccugggcaacauggcaaaacuucaucucuacaaaaaauacaaaaauuagcugggcgugguguugcauaccuguuagucccagcuacucaggaggcugaggcaggaugaucccuugagcccaggagguccuggcugcagugagccgagauugcaccacugcauuccagccugaccuugucucaaaaaaaaccccaaaaaaaaccaaacgaaaacuggacaugaugcaauucucaguguucuucugagaauuaaaacaaacaaacaaaaaaacucgacaugaaaggaggaaagaaacuuucuauucuuugcccuuucuuuucccauuaaucugcucagcuguuuuuauguccugagugaagagaaaggguggcaaaaagguuugcuuuccuuuuucccaccaaacuagggcuacagcacuaacuuagggaaugcaacuuuugggggcauacuaaaguuugaugauguugacuucauauuuuuugguauaaauucuuagucguugagcuauaauaaauaguagguuuuacaagguaauaauggcaauguuuuauaagcugcugaggcagucagcgggcuggcuauauggaaaaacuucauagcucaaugggguagaagcugugaauaucaggggaggaggcaagaagucuuggcuuugaucguugagauaaugguagagugauaucugaaagauucauuugccagaguaagcuaucauuauccuaaaauuaaaaaaagguuaaggugguuaagucaaauacuggaggacugacaugcuucagcauugauauuaguuggguuauuuugaauccugaagguuaaaucucauuauaaagaugaauuaaagaugacaagaccauuuaaaaauuuuaauagguggucuguagaagcagugcuuucugguuuugggcauuuucuuuuccacaaauaauuugugugcaagaacuuuaauucuuucuuugggguagucacucaugauuaugaaaggauuugaucacauuguuuuuaauugcaagaaaaucuuuagcaucuucccuuguuauaaaaccaguuacauugaaccaccuauuucuuauguaauucaauggcccagaacaacuuacccaaacuccugaccuacacaaaaacacaucacauaaaaucuaggaacugggcugggcaugggggcucacaccuguaaucucagcacuuugggaggccaaggugggaggauugcuugagcccaggaguucaaaaccagacugaacaacauagacccuaucucuaagaaaaaaaacuuaaaaauuagcugggugugauggcauguaccugcaguccuaguuacuugggaggcugaagugggaggauuguuaaauccuaggaguuugaggcugcagugagcuaugauuacaccaccacacugcagccuggaagacagagggagaccuugucucuaaaaagauaauaaaaaauaaaaaaucuaggaaacugguugaaaaaaagauguuaugugcacuauccucugucuuucuguuguuggaugcagagcacuuaguugaaaccuuaguagagaggcuaagcuccagaaguauuucauccccaagguuucauuucuaggaguacaccucuuuuuuuuuuuuuuuuuuuuugagacagaguuucgcucuuguugcccaggcuagagggcaauggcgcgaucucagcucaccacaaccuccaucucccggguucaagcaauucugccuuagccuccucaguagcugggauuacaggcaugugccaccacgcccaguuaauuuuguauuuuuaguagagauggggauuucuccauguuggucuuggcuggucuugaacuccugaccucaggugauccauccgccucguccucccaaagugcugggauuacaggcaugagccaccaugccugcccugugaguacacccauuuuuaucaauacuccauuggaauaaaacaauuuggauuuucuguggaauucuuauuauguugaugucauuagacuaagaaguguuuuuuuuuuuuaagguaaauaaccaccccccaccuuuaucuuucuuuccuuuguucaccauuccucacccuuuucccccaaaacauauguuuuuuaguggggacuuacuuugugauucagugauguggaugugaaguauuauauauuuaauaaugugugucggaauaauauguuaacuguuuuauauuuuccuauuuuuaauacaacauuaggaucucucuuuccucaucaugguacauuugaaguaauaaagaauacagaucucgaucuggauaaaaagauaccugaagauuacuguccucuugauguccaaauuccuagugauuuagaggggucugcauauaucaagguauuugucaaaauauuuuucaaguaauuucuuacgaauagccugaaguuaauuuguuaacuuuuuuuguuuuuguugucauauagguuucaauacaaaaacaggcuccagauauaggugaccucggcacaguuaaccucuucaaacgaccuuugcccaaauccaaaccagguaugguuauguucuauucucuaauuucuggucuuauuugagcugacauuuuaaaauaaacugaagauaaauauagguaggaaaaaauagauaguuugaaguaagaacaauucaaaauauacuucuaaaauuuaucaauaaacuauuagugaauagcugugcaauuuuuuuuuuuuuuuuuuuuuugagaccaaguuucucucuuguugcccaggcuagagugcaauggcgcagucucggcucaccgcaacgucuaccucccagguucaagcgauucuccugccucagccucccgaguagcugggauuacaggcaugcgccaccauuccuggcuaauuuuguauuuuuaguagagaugggguuucuccauguuggucaggcuggucucgaacacccaaccucagguaauccacccgccuuagccucccaaagugcuaggauuacaggcaugagccaccagcaccuuuuuuuaagauuggacuuauuuacugguuuuuuguguuaaagaagugagauuuuuauauuuuggaaagaauauagcuuugcacaguggcaguaucaaacccagugagguuuaucuguggcaugauuauugcuaauugauacuucccucuacaggaauuuaaacuuuccucuucaggaaugaaagauuggggugguggggaacuucucaauacccugccgggaugauuuguaacacaguuggcauuggcaauuuuugacagucucuauagagacugaauaggaaaaaaaagaauauaccguaauguaguguuuuccuaaacuuuugucauauguauucagaucaccauuuaaacuaguuaaugcauaauaugguuagauaauugauacauauauuucuugucuuucagguuccccacauuggcagacaaaauuagaagcggcacagaauguucucuuauguaaagaaauuuuugcacagcucucucgggaagcuguucaaauuaaaucacaagucccucacauuguggugaaaaaccagauuaucucucagcccuuuccgaguaagagcagcccuuuuucgacuuuaugaacaggacuuuguguuuugggggacuaggacagagaagguagcucuuaggguguauugggagaauaaugagagcaaagaaauagugugcuauccauagugacagccaguaaagcauguaacacaaacuauacuguggaaucuguucuguccuaaauagugugacccuuggauuuuuaagcuacauauuaaaaauuugcacuuauguagucauuauuguggucaagagaaaagaaaauuugcacuagcauagcuauaguuauuuagcaacaguugcuuugagggagauuuuuucagggauccugccuuauuaucuaaaugagaggccaauuuaaaaauguuuacucuuaacgccugucaucccagcacuaugggaggccgaggcgggcauaucaccuggggucaggaguuugagaccagccuggccaacguggugaaaucccauuucuacuaaaacaaacaaacaaacaaauuaaaaaaaaaaaaaagaguuuacucguaauagucucaaauuuauagaaacuggauuuuaauuauauuauucaaaagcagguagacuugcccuggagaucaguuuguauuuagcuuugcacuuguuuuuuacauaaauucuaaggacugucgucuuagaaggaaguagguuuuaguggugagaaauuccauccuacuucucaugggagcagggaagacuaacugucuuuuacgcaguaagacugccuaccuacucuuauuuuaaaggaaaaaacaaauuaauauauagcuuuuucaccagucuuuagccaguucaagggcagcagccauauuaugugucaacagaauuugaauuguuaaaauacgugguagcuuauuauauucaugaauaguuuuuuuuuuuuuuugagaugaaguuuccguuuuguuguccaggcuggagugcaauggcgugaucuuggcucacugcaaccuguccacuucccggguccaagcaauucuccugccucagccucccaagcagcugggacuacaggcacacgccaccaugcccagcuaauuuuuuuuguguuuuuaguagagaugggguuucacuauguuggccaggauggucucaauccccugaccuugugauccacccaccuuggccucccaacaugcugggauugcaggcgugagccaccgcacccggccaaauaguaaucuugauauacagauguuaaucaugaggucugaucuucaaguuuagaauauaucuuuugaaaaugaacuaugauuauacuuuaugaagacaguuuaugccuuuccauauuucagguuauuuacauauguccuccuucuuuuuauaaauaggcuugcaguuaucuauuucuuugugccauuccucaaaugauaagaaaucccaaaaauuugcuacugagaagcaauguccggaggaccaccuuuauguccuagagcauaauuugcaucuacugauuagagagguaaggaaauaaauguuuuucuuugcgcuguggugaguauguccagggcagugaguaugcacaaagcuccucucgucugcugagucuugauuauucacauagcaacaacauucacugucugaugugaaagauccuugcugugugcuaggggaauacagagauaaucacaauacugucccuguucccaaacauaccuucuagugguagagauacacagguuuucaaguagagguguaagaaacaugaugcuaaagugcagagggaagggugauucugaccgggggaguuaagggaaaaugucuugccagagucugugaacagacuaguuuuauuuuaggacauguucuacuuacagaucaucuacaacuguuuacagggagcugguucacaggccaggguaauuucaaaagaauauccugugaaauuucauagaauuauauauuacagccucccuugccccaccccaaaaccugguucaguugauugugaugaugcaagaguuguuuuuaaaaagcuccuuaggagguucagauaggcagccggguuugggaaccucuaaucuaggguauagugaaagaacuauuuacugauugcaugcguucuauuuaugagacucagugaagaggauuguuuuacauuuuaaaacuuguaaaauaaaaauuaaagcuugagauccuuuugugguucaaaagcaugauugggcuuucaugcuuaugcaugaguugugacucccucaaaccuuauuaggaugucggcgcauuacccaucugacaugagaaaaggaaaaaaguuacagcuugagagcgacccuucucuuuacagucuugcauuaugugugaccuaguaguugcuagcauuuuucuccaagguuggauuguuuucauaugugguucaaauccauuccuuucaguguuucugucaaccauguuuugacuaaauauuauguagcauuuacuauguggauauugguauuuaaaauggcuguuuuuguuaguuucauaaacagaccuugaguuccaucaugaugccucauccagcaagugcaccuuuuggccacaagagaaugagacuuucggguccucaagcuuuugauaaaaaugaaauuaauucauuacaguccagugaagggcuucuggaaaaaauaauuaaacaagcaaagcauauuuuucuaaggaguagguaagguugaagaaaguuacuguuuucuguuuuuucuuugaaauugcaguguuuucuucuguuauuucauaacacuuuuuugggaugcuuuugacuuuuuuauuuuagggagaggaggugguaagaguuuauuugcggucauagacuggguccugucaagucuggggaagacuuagauccacuucugaucuaacaguguauucuuucuaacacugucacuuuuuugcaaagacaacugacuaggaaugugccuuacaacaccauacuuucuucaguaacccagccgugagauacuuauuucugaacugauuuacaucuuuuucuugaggguuucuguauuuuuuguuucuugcacauuuuagaguuuggagggcacuuuccuuauguuaacuuauuuaaucuuuguucuuugcggcagguaguguuaacccuguuuuuacugauaagauugaggcuuaaagaaguuaugcaccuugcucaagguuacacagcuaaaaaguugcagaacgaggauuuaugcccaggucuauguaacgccaaagcucuuuuuuuuccuuuauauacacugcuuacaaaauaacguggcaugauuacauauaaauguaucuuuuucagugcuaaagggugcuuuucuauuuuauuauugguacuuagugaaaaggccuguuuuuuacuucauuuguaauuaugccuugguaguacuccagaauuucaggcaugggcauugucauuaaauagaugauauuuuauuuuugauuuccaguuuuuuucuuguuaauacaguuuuuuuuaguacauuaguuuguagucuuaaaguggaaauuuagguccuucagcuuuuaguaaaaggaauuggggagacacguuagagaagacagcaugaggcagugaaaggaguaggggacuaggggugaaagguguguaagccaaggcucaaccacuugcuaaauaacuucgagcaagggauuuagugucuauggucccccacuuauucccgucaauagcagguauaggaguggggucuuagggucauauuaaaugauguauguagaaguuucuuauaaguaauaaagcauuauaugauagguuacuguuucuuaccauuaauacaguucaacuuaaaaagcugauaauuugaguagaucguuagucuugcaaauuucugauugaccauaaauuuaaauauuccccaaauaaaugaucagcauaaaaacagcuauuuuuauaaccauuauaaauuucagaguaguaaguguagccuuggaagcagcaaagcuuuaaaacuuuuacuucuuccugguguacaaaaagcuuagugaagaaaaaaagacccugucugggcaugguggcucaccccuguagucccuacacuuuaggaggccaagaugggaagcuugcuugagcccaggaguuugagaccagccugggcaacauagugagaccuugucucuacaagaaauuuuuuuuuuuuuuuuuuuuugagacgaagucucacugugucacccaggcuggagugcaguggugcagcucacugcaagcucugccucucggguucaagcgaucaucccgccucagccucccaaguauuugggauuacaagugugcgccaccaugccuggcucauuuuuguauuuuuaguagaguugggguuucaccauguuggccaggcuggucccgaacuccugaccucaagugauccacccaccuuggccucccaaagugcugggauuacaggcgugggccaccgugccuggccaggaagccuuuuuaaaaaaaguagcugggcuuggugugguggcucaugccuguaaacucagcacucagggaggcugggcagaucccucaaguccaggaguuugagaccugccugggcaacauggcccaucucuacaaaaaaauaaaaaaaauuagccagaugugguggugugcaccuguagucccagcuacuugggaggcugaggcuggaggauugcaugagccugggauguugaggcugcagugagcugugaucacaccccgcuacacuccaguugggaugacagagugaaaccaugucuuaaaaaagacaaaaagacugauguguaugauaacaugcacagugagaucucuugacaugcuaauauauuuuuauguguaugugucagagugugugugugugucuuuaaagaaaaaucggaguuuauaaaauuuuauauccuucugaguucauaccucaggggugacaccaaaacaaacaaauuuuuuaccuugcauucauuuaauauuguauuguaaauuuuuucaucuauuuuaauagcuguauaauauccuauaauguaaauacuucaugauuucuuuucccaauuuuccauugcuagauaauuuuauuuccaguuuaaugguucucguaaugcucacacacauacuuaccuucuauaggaauuaugaagcacugucagggaaacacaucaaggaaaaaggaaaauaaauuucagaauguauuguaagaagccgguacugcagcagcagaccaaacccuaagucuauuaauguaaaagccccuuguccccacuggcucuucucauuucuucccauugucuuuuaaaauuaaauuuauuuuuauuauuauuuuuuuaauuuugaggugaggcguggcaugguggcucaugccuguaauccuagcacuuugagaggccaaggagggcagaucacuugaggucaggaguucuacaccagccuggccaacauggcgaaaccucguuucuacuaaaaauagaaaaauuagccaggcgugguggcacacgccuguagucccagcuacucgggaggcugaggcaggagaaucacuugaaccuggaagguggagguugcagugagcugagauugcaccacugcacuccauccugggugauagagugagacuuugucucaaaaaaaaaaaaaaaaaaaauuugagacagcaucuuacucuggcuuagacuggagugcagugcagugguggagucauagcucacuguaaccuggaacugcuggguucaagugaucuuccugccuuagucuuuugaguagcagggacuacucgugcacgccacugugcccagcuuauuuuuuuuuuauuuauagagacugguugucgauauguugcucagguuuguuuugaacuccugguaucaagcgaucgucccuccuuguccucccaaaguguuuugauuacaggugugagccacuuccaggccuuucuuucucuuuccaguaaagugcuaaaaaucagauaauuagaaacugaggguuugguuaauuuaaaugauuuaugcuuugguucuaaguguuggcuguugauuaguguguauaagauuacuggcuuuggaauuggauucccagguuuuuggcucuggauuuagacucccagguuuuguaucccaguuuauagcuaugugaccuugggcaaauugcuuaacauugcuaaaguuuuuucuguuuaaaaaauggaaauaauagugccuaccuaauaagguuaagauuaaaugauauguuaguaagauuaaaugauauaauucaugaaagcucuuguuauaaugcaugcuguauaaugaacacuugauaaaucuuauuucucauugguauugauaguuuucuuuuuuuggaguauaaggauuugauugugcaaaaaaucucuagcuucucuugaauaugauuauaauuucauuacaguaaugggucuagaugugggugugucccaagucauuuguuaccagggaucaaguacugacauuuaugaaugauuuauauuagguuuauaccguagaauaucgaauauccuucucacucauuuccugauaagcuuuucugaguggaagaaaaugaauagaguuaaagggaauaaacccaucaugaaucaugauaaucaggggugugugaugagaguguauuguaaugucaagcugagaaccuacacauucaagcaguaugaaaggguucuuagagcuaccucugccuuuauuuaaagucugccuacacauagugguaguuuaaaaaaguaguuaguuuuaaaauuuucauaaaauuuucgaaucauuuauauuccuaucauuuuguauggugacuuaaaaaguuuuuuaacuucuuguauuuaaaagagcugcugcaaccauugacagcuuagcaagccgaauugaggauccucagauacaggcucauuggucaaauaucaaugauguuuaugaaucuagugugaaaguuuuaaucacaucacaaggcuaugaacaaauaugcaaguaaguggccaaaauaaaaguuuuguauuuaauauguuaauuugcuauugauguuugcugaguaauuauauuaagcauuugguuuuuauuugcuaggguggcauaauauuucuguaaauuauauaagcuguagaguguuuuuuuuuuuaauagguggagucucacucuuuuacccagguuggagugcagugaugaucauaucugacuacagccuugagcuccgggguucaaggaauucuuuugccucaaccuccugaguagcugggacuauaggcaugugcccccaugcccagcuaauuaaaaaaauuuuuuuuaagaaacaugucuauguugcccaugcuggucuugaacuccuggacuccagcaauccugcugucuuggccucccaaagugcugggauuacaggcaugagccaccacucccggcccuuguuuuuuuguuuuuuugauggcaauuaguucuuaggagaaaauucauaaagucuguuuuuaaacauuguaagaaugagagguaacaaugucuaaaaacuagucuuuauuaaguaaaugucacauauuugagcugggguaaacaaugaaccccggcacugagcagaaggcugccuuaccuuuugagauuccaggucugcuucaguucuugccuaaugguuauggcaggucuaguauauuugaagugaauagggccauuuguauucuagccuauacucuccauguuaugccuaaaauaacccaaguuuuauaguucucaugaccugguguugauccugggucuaaucaaguucaugauuaugcccuaaaaacuggguugauaacugugugucugugaaggagguaagaugguuuuuguccccaggcuucauaggaaugcagucuacuugauuuacauucacaaaucacaaguuaaugcaauuggccaguagccuuuaaggacuuuuuggccuaccuuuugagccuuuuugaaauuuaacaccugacauuugucagggucugugacuacauuuuauuuuuaaaguguuaguugcuuuauuuccuuuuugucucaguuuguguuuuugagauggcgucucacaaugcuguuguccaggcugaucucaaacucuugggcucaagcaguccuccugcuucacccuccuguguagcugggacuacaggugugcacuacgauacccuuaguugcuuuauuucagcagacguaacuagccacaguaaagcaaagcauacugugaaacacaaaauaacgacccuuaggaguaggggcagaaaaauacauuuauaaugcuauuguuuucuuucuuuuugauuuuuccuauguacagucauuuccaauauaauacuauuuuuaaugcagagguuuuaauucacuuaaaaaaugaaaacauaguagauaagugugagagcagaugcagaguaugaaagaauacacaauggacaggaaacuaguccugaaacuuccagagaaagaugauggaauaaaguagagucauagaguuuucuuccccuuaucuaaagaaagaauaaaauaauuggggugauuugaggguggauugggagaaaguagguguuaaacauagaugaaacaaguuuggauugcauuuuuaacuuaagaaugggugaugggauuauaggcuuucauuauauuauacuucuguugguguuuauuauuuauuugccaguaagccuuuugcccuccuacuguuuguguuuaaaauuuuccauaguaaaaagagagacugagugcaauggaaaagaaaagagaaaauuaucaucauugaauuguuuagacuuagaacuaagacuaaaacugggauuaugguuacaggucccaaucuaaacguuguaaacuuccacaaagaaagauuagugaugauguagccuugacagaaucaggagugaaggagaaguagaaggcaguaguagaaugcccuuuuccucaucuucuauagcucguguauuaggguucucuagagggacagaacuaauggaauguguauguguguauauguguguguguguguauauauguguguguauauauauauauauauauauauauauacacacacacauauacacacgcacacacacacacauaaaggggaguuuauuaaguauuaacucacaggaucagaaggucccacaauaggccaucugccggcugagaagcaaggagagucaguccaaguuccaaaacuaaagaaccuggagucuguuguucaagggcaagaagcauccagcacgagagaaagauguaggcugggaggcuaggccagugucucuuuucacguuuuucugccuguuuauauucuagccccacuggcagcugauuagauggugcccacccagauuaagggugggucugccuuucccagcccacugacuuaaauguuaaucuccuuugcacccucacagacacaccuaggaccaguacuuuguauccuucaauccaaucaaguugacaguguuaaccaucacagcugggcucaacuuaggcuauugaaaguugaaaauaauuaucagaauuccuuuggaucaaucauuuaaaacaguuucuuacacaucuuucuaggaaagucuauguauuuacaagcauauauauccuaccuguuccuguaaccgaccucucuuuaaaaacuuuuuuuuuacauaugcauguagaaguuauguaacccuaccugucuuacagaguuuuguaugcuuucuagcaacauaauacacauaacaaaauucaccauuuuaaaguggacacaguucaguggucuuuaguauauucccuauguuguauaaccaucaucgucuaauuauugaacauuuccaucaccccaaaaagaaacucuacauauuagcagucauuuguaauuuacgugauuuuuaaacucaguaguguuuuaguucaacuuaugcagguaggcuuaaugaucagaauacaaugggaucaauuaggaaaaacuauauacaggaaaugcuuuacagaguaguagacccuuuuuauguggacuauuuuaauaagguuuaaaauauguggauuauucugcauucuucucaguuaaaauuauucauguggccauaagguccagaaaugcagacaagacacauaaugaauaauuuauugcucaguagucauauaugagugaguaaacauuauuuuguuagcacauagaucuaccucauuuuuuucuuacagccuuuuuguauuucauuguaugucccacacuguuaaucggucuucuguuguugaacauuuuugucgaguaccaggaaaauaauuuguacauacacaggucuauccauuuauaggguaaaguccuacaaguauaauugcuggguuaaaagagaaggacauuuggcugggcacaguggcucaugccuguauccccagcauuuugggcggagcacuugaggccaggaguucaagcccagccuggccaacaugaugaaacccugucccuacuaaaaacaaaaauuagcuggguguggugguacaugccuguagucccagcuacuugggagacugaagugggagaaucauuugaacccaggagacagagguuacagugagcugagauugugccacugcccuccagccugggugauagagugagauccugucucaaaaaaaagauaaggacauuuaaauuuuuaauuaguacuaccaaauuguuuuucaaagugguugccacaaguaugcauucaccaauagugagugauaagaaacccuguuccuucacaccuuguuuuaagaaaagaauucuaaaauguugguuagauuaauauaucuucaagccuuuugaguuucguuuuucuuugagaaaacaauguaaacuuuaguacaucaaaauuacaacuuaagccaggcaugguugcacacaccugaagucccagcuucucaggaggcugaggcgggaggaucacucaacgucaggauuucaaggaugcagugcgcuaugauggcaccauggauaaaaccacugcuuuccagccugggcaacauagcaagacccugucucuuuuuuuuuuuuuuuuuuuuuuuuugagauggaguuuugcucugucgccagaucggagugcaguagugugaucuuggcucacugcaaccucugccucccggguucaagcaauucugccucagccucccaaauagcugggacuacagaugugugccaccacgcccaccuaauuuuuguauuuuuaguagggguuucaccauguuggccaggauagucucgaucucuugagcuugugaccgccugccucagccucccaaagugcugggauuacaggcgugagccacugugcccagccuuuauuuuuuuuuauuacaauuuuauguagacaaucacuaaaaugcuuuauucucaaauauuugcuuuaaaacaaagcuagaaggaagagccauuauuaaaugugagaggacauaaagcuguuuuuuccugcauuuuguucaucuagguuauuagggauuucaaguuucuuggacauauuacaugcugaaauuuuagaaguugcuuuggaagagugcagugaugugcuuguuauuuacuggcuauuguaugaguuucuuuauuugaccuaagccaaauuaauggaguauauauauucugacuuguuugcugauuauuucaguaagagaagguaaagaguuaacaaaaccgcuucucuuucuguacgagaauuugcuccuugguuaacgcuggcucucaucccuuggaaaccugauaaggaaagaugucaucaguauuacuaggcaacauugcuuauaguaaaaaugaucucaaauugguaaaaugcaucugaaccaggagaaauuuuaaauaaaugaugggaaugccuuuggauuuuccuggaugguggugacuuuuaaaacugggcuuggcuuguggaaaccaugccuauggaguuguuacagaagcuuauggcuccuguuagggcagggcccacauauacccaauuggaucucaucuccuugcaacaaagguauucugcugcuauauagacaguugcauggucugcuggcaagcuguggucgcuucaaaugcuucuggguagacugguacucaguguggucuaugguauucuggggugagucuguuuaguugaaccuaagaagacaccugcaucuccuccauggauguugguguggguuauuaaaacuuuuuuuuuuggccgggugcaguggcucaggccuguaaucccagcacuuugggaggccgaggcagguagaucacuucaggucaggaguuugagaccagccuggccaacauggugaaauuccgucucuacuaaaaauaacaaaaauuagccgggcaugauggcaggugccuguaaucccagcuacuugggaggcugaggcaggagacucucuugaacucaggaagcggagguugcagugagcugagaucacgccacugcacuccagccugggcaacaggcuuugagacuuugucuaaaaaauaauaauauuuucuaauuugauguuaacguuuauuauuuaugaaauuguauaagauaauuuugaacaucucugauuuuuaguaugugugucuauaaagguccauucaacugcaauugaauauuggaguugagcagauucgaguuguacauagagauggaagaguaauuacacugucuuaucaggagcaggagcuacaggauuuucuucugucucagguaacaguugcagauuuugucuuaagcccccuucuucgcauagcuacuuaaagaacaaauugguuaaaaaguaguuaaaauguaauaaauuguguaagaagaaaaaaaauuuuuuuccaguagaaauuaaauucuguuuaauuucuaaugcacauuuuacaaccuguugguuaacuggaaguacugauaagcuguccuagguuuucacauaguuuauguuaagaugaaggaccaguucugagacuagcaaguuuuuuuucccacaugucauauuugugaagguuuacaaaaucucuaggguuuacaacaucuccagaguuguuguagaaagugaagaaaacuagagaaagggagaucauauaaaaaacuauaaugaccauuauccauaauaaaugaaguaguuuaaucucaaguccaaggggcaguauagaaagugauggguuugaggcuggguauggugguuugcgccuauaaucccagcacuuugggaggcugaagcgagaguaucacuucagguugggaguucaauaccagccugggcaacauagcaagaccccugucuccacaaaaauagaaaauugaguggguguguugguauguaccuauagucauagcuauuagggaggccgaggcaggaggguugccugagccuggguguucaagguuacaaugagcuauaauuggucccacuguacuucagcccagggugacagagcaagauaccaucucuuuuuaaaaaaaaaaaaaaaaaaaaaaaggugauguguucuagucccagcucuacgacaaacuugcuuugugacaucagacaaauuucuagcccuuucuuuucauaucuaacuguauuuucccuaauuucuucauggaguuuuuaaugacccagugaaauacugaauugugagauauaggguagguuuuugaaaugcuaaugcaagauacuauuuuuuuuucacauuaaaaaaaauaguaucuugcauuagcauuucaaaaaccuacccuauaucucagaagcaauaaucuuauauacugauuugcuucuuugguggccaaguaaguaaaauucauuuguuagguauggcagcucuuggcugauuacaucuaaauuggcuuugguuacuuuaagcacacacacaaaaauauauuagaacacuauugaguaggucccagaaucaaugggaggucuagagaacaaggcuugcaaauggauagggaucaaagcuagguaugagaaccauggccagaggaauggcacucaugcugucccagcacuacugccuucagcacuggugacaaaaugcauucuaaauugcccccauuguaucagucagagucuuaacaagaaauagguggcagacucaggaggaucuaaagaucuauuuacaaagaaguggguguaggugagccaccagggauagugugguaaccugcugcuaguaguaguaaccagguaaccaggccccagggacuuaguggucaccauuccuaggccaaaguuaagaggaaggacagauuacaagaacccuaagggggagagucguguagaacaguccaucuugagaagccuagcagccagucaagagauacaaccagccuagacaaccucacagggagggugccaggggaauaaauacccugaccucacucuucccugccauccugcugucucccauuaccugaacccagcccaaagccagaggauguaagaagguauuaauguaaccacgugugucagccucccagggcagaaaauaagguaggcaguggauuugaaggggcaaauguuacaccauauucagugaucuagaugagagucuucaguuggccaaauuuaugucauaugucuuugcuuaagcugccagugggcaggagaagcaaguaucaggcaacuuuagcuuuggcaguggaagguggaguccuauucccucccccuaaguuacgcacaggaggauuccucagaccuaagauaggguugcuguaguagucagugagcaccccaacaaaaguuuacuucauggucgugauguuaagucacugcagauaucucugcugacugucagucaaguguccuuuuucauucacagaugucacagcaccagguacaugcaguucagcaacucgccaagguuaugggcuggcaaguacugagcuucaguaaucaugugggacuuggaccuauagagagcauugguaaugcaucugccaucacgguggccuccccaaguggugacuaugcuauuucagguacuuucugcugcuuugaaugagaagggaccauugggaguuuggcuuuaacauuuaguuuuaauaauuaaauauggguaagaguaauuuaucucugcaauaaauuaguuaauguuguauuuacaccgaauguuuauuugaucauagcuauuaugcagagcaagagauuauuauuucucuuucuaguaauuauaauaaauguuuagauuggcagcacauuuuccugagauagucugaaaaguaucaucagcauuguuacuccugcagucccaaaguuuaauggauaaaaacuuuaaaaaaaauauauacugcuguaaacaugggaagaaaaauaucugauccuaaaaauaguaaagggauggaacagagaggaauaucuaaugcaagguacuacuuuuuucacauuaaaaaaauaguaacaguuuuuaaaauauucuaaaauaaauaauuaaaaauaauuuuaaauaaaguguuuuguuuuauuuuaucuauuuauuuauuuuugagacggagucucgcucuuucgcucaggcuggaguucaguggcgugaucucagcucacugcaaccucugccucccaguuucaagcgauucuccugccucagccucccgaguagcugggacuacaggugcccaucgucauacccaacuaauuuuuguauuuuuaguagagacgggguuuugccauguuggccaggcuggucucaaacuccuaaccucagaugaucugccugccucggcuaaccucagaugauccgccugccucggccucccaaagcgcugggauuacaggcgugagccaccgcacccggccgaggagaaguauuuuauuaagcaccuucuacgagugggcacuuuaauaggcacuuguaugaguauuacauagcuuaaauuuacauuugaagcgcuuaugguuuuagugugaucuuuguuucugauaucugcucugacuacuuuaaaaauacagucauguguugcauaaugacagggacagguucugagaaauguguuguuaagaggauuucaucguaugauaauagagugcacuuacacagcccuagaugguacagccuacuacaugcacaucuaggcuucauggcauagccuguugcuccuaggcuacaaaccuguacagcauguuacuguacugaauacuauaggcaguuguaacacaacaaaagcaguugacugaaauguuacgcagcucaugacuguauuugaaagaguggguaguuagaaauauuuccucacaggaucacagcuugugaaucugcaagcuuggucauugcuggaucuugauugcuaggaauuucaaaauacccuuuuccucuuucccaaauaauaguuaaaaccucauuaaaaccugaaauucuuaauucagaauaaucuuuccuucaucccuuucaguccugauuuuaagugguugagguuucuuuacauauuaggcauguauuaacaauucauugaaugauugccuuaucaaaugaauguauugaaaaaaauaggugaguguacuaggcgugguggcucacgccuguaaucccagcacuuugggaggcugaggugggaggauugcuugagcccaggaguuugagaccagcccuggcaacauagagagaccuugucuuuaaccgccucccaaaaaaagcuuuguguuuuucagugcugcauguggaaacaaacaaaaagaugauuuccugaaauuauagaggacauuugacauuccuaggucaaaacucaccuugcuuaaucuuugugguacaaauaauaauucaugaauauuuauaccauccucuuauauagaaguuagaguuuuucucuugcauguugaaacugaaaaagcacuuuuuuacaagaauauuuaaguugguagacaaaguuuuuguauucacaguagaauggaguugugggauuuauccuuguuauuucuaguuugguaaacuagaguguauugauauuuugguuuuucuccacaguucguaauggaccugaaaguggcagcaagauuaugguucaguuuccucguaaccaauguaaagaccuuccaaaaagugauguuuuacaagauaacaaauggagucaucuucgugggccauucaaagaaguucaguggaauaaaauggaaggucgaaauuuuguuuauaaaauggagcugcuuaugucugcacuuagcccuugucuacuaugauuuuuuccagauguuuccuaaagaaguuuccagaaacuuugacuugaaauguuugcagaucaacuauaagcacaaagaagagauaacuuccaaaagagugcuguuuuuaaaaauaauaauuaggaaauguuuauuuagcacuuucaaacuuuucacuuuauaaaugacaagugcuuugaaaugcagaaguuuauguacaguuguauauacaguaugacaagauguaaaauaauauguuuuucaugcaguuuaaaauauuacuaacuuaaggguuucuaugugcuuuuuaaaauauuccuucuuugauguugacaucaaauaaaguaugugguuuaaaaaaaucuccaaauaccuuuuuuuccccccaaauacuuucuaaacuuuuuuuuuuugagaugguaucucacucuguagcccagucuggagugcaguggugugaucaugguucacugcagucuugaccucccaggcuuaggugauccuucugucucagccuuccgaguagcugggaccacaggcaugcacaaccacgccuggcuaauuuuuguauuuuuuauaaagacaggguuuuuccauguugcccaggcugguuucgaacucggcucaagugaucuaccugccucugccucccaaagugcuaggauuacaggcgugagccaccaugcccagccuacucuaaauuauugauaaccucuuccuccaguugucuccuuuaagcuuuccugggucuaaccuacauagguaauuuaagaacauccucagaaaggacagcugaaggcaauaggaggcagauuaucucuuuagggcguccucaaguuuuuuuggucuguucucccacuugauugaccucaccaguugagacaccuaguguauggcucaugcccagccuuccaccugggauucuccagccuccacccagcagcccuggauugcuuucuccaauuaaggccuuuccaucagcucucugcuuuuucaaagcgaaaaaacuaauggauuaguggguuaucuuuuccaaggaacagguuugcacuucuuggaaaaagugccuaaagugugcccauuaauaugaggauagauuuaggcucauaagccuuuugguaacacugaaaguaguaucauauaggcaagcucuccuuauaaguaaggcuuucaauuuuuaaaacagacauccugcuuuaacaauuuguaagaugacugugcaguaauaaaaguccuuuguauuucuccaccguguuuucauuaaagaaaaauggagcuugugggcca

SEQ ID NO: 192014 - RNA, 5608 nt, Homo sapiens
uuuucuauguauuuucucugguguuuuaaugguuuuuuuucuaauuauuacuacuucacaaguuucuuucacaaacuucuucacaggguuaaaaauuuuuuuucuuguuauaaaguucuggguuucagaauuucuucaccaccagacugguacauauauccacauuuaucuuuauucauuucuaugaagucguuuuuucuauaugcuucaccuuugacauucaugauccugucacauuuucaggccucucuguccaguauuuuuggcuuuuguagcucucuuuuuagacaaagcagcuucuucaguaauauccucuucuucuaaguauacacucagucuuacagggaauucagaacuuacuaugaaacuaucccccugcauaaaacaaacaaaaaaucauggauuaagcaauaacucaaauaguuuaguaauuacauauagcugaaugcccuggauuacuucagauaaccuagagacuacauguagauguuaaaaauccaaauuaacauugcuuauuuuuucauuugacauccuaacuagcaauaauauguaucagaaugcuacuuauuaaaaauaguacugaaaaccccauguucuuuaucaagucucuaaaaaauuauuuuccuucuugcauuuccugcaguaaacuuauagagcuuuucaaaaguuaaaugaaguguaagagaaaaacuaaauauaauuccuucuguaucaaccaacuccugccuucccaaaauggaauaggaaaaaaauaagucacuuacugccaauuugauaucacauucguuaucuucaagauguguugcauccucauccucugcucuguaauauuaaaauuuaucaucgagaugacagaaucuucgaugaccuaauuaguuguauauuccacucugaaauauaacugaaacugcaauacuagucaaaggaaacacaaaauuugagaauuuuguguucuggagaauucuagaugaacggugugccaagcuuggcucaacuguaauaaucccaauugucauacucuguaucuuuguucauuauuuaaguauaacuauauuaaaggcaaaauaugaagcaauuaacauagaaauuuaauuuauaaccuauuaccaaaguauuucauaugauuccacuuacguugacuccucaauaggagaaauggauccaucaucauccaaaaauuuguaucuacgacugucaaaaucuucauuuucuaaaucuucaccaacauucauuugcuucaaugauucuuucaggugguguucauacuucaguuuuucaauauaguuaaaaaauccucuugcaacagcuugcuauauauuaaaaacaccauaaguaugucgagauuuuauuuuuaagacccagcaggugccuauguucaaaaagggcaaugcccccccuuagcaaagacucugaauuugcuaucuuaacuacuccccacuuguggacuuaucaaaugcugauuauuaaaauucacauuacaauuaugaauuuaccuaagcugguaacauggaaaagugaaguacauaucuugucaugucugggacuuacuaaaggcauuuuaaaauguaaaaacaggaauaagauuucuaauguuuacuauaaucaccuuaaacuuaagagauuaacugaagagauuaacauguauuaauccucccaaauaaaauuucagguucuggcaagggaucauaaauuaauucugaauucauucaacauacaacucucaaauauuuaaaaaagucuacuccuaaguauuagcguauuuuucagauaauuggcuuagaaacaucuaggccuuaagaauauauccacugaacauaaggcaugugugguuuuaguuuagguuacugcaaaaguaauuucaaguuaugugagcuuuuauuauccccacugaguuuuaggguuguguuuaaagaccugagaugggauaagaucaaaggauuuuauacaaagagccuuggagcacuaucuuuuaaauauggcaaaguguaguuauauuaagagauacaagucaagauucaguugaaggauaggguggacuuuagggguaagucaguauagaagaguaucaaaauugcagacagucuguucccaguauaucugagacaauucuaaauuggccaacaaaucauuuugggcaucuugaguuauguguagccauguauguaaaaugcugacucaccucaaacguuaaaauuuuucuccaaggugcguuuuuuucauucucugauucuaaaaaugggaagccagauccucugcuucuaaauuguuucuucuuaucuauuagugaguauauaggauuucuccuuccuucuggucuuccccguggucuuccuguuggcugguaccuccucuuuuucuuuuuuuuauaucucuuuuuccuguucuugaaucuuucaaaaauagcuuuuauagucaaugguauugguucaaaagaugagucacuugaugaaucacuugcgugaacacuuucagguguacgaacaaauuuucgaaugggguuucuuuucuccccuuuaggugaguaagggauacacugaguuuuaaauaagcugcuaucagaagaguuaucacuagaaaaaugggaaaaaaauuaauuucaucuucuuuucuuacugcuuauuaccauuaauacccaguccuaaauguacauuucuuccaagaccaacucagaaaacaugcccagaauuaaaaauuuuuuaaaggaugggcucagaaccagcuagccuuucuacugaucauccuauuuaaauagcccauaaugcuacagcucuuauuaaagaguuuuguagacaucgucuugcugucacccagacuggagugcaguggugcaaucacagcucacugcaaccucaaacuccuggaaacuccagggaugcuccugccucagccucccaaguagcuagcuaggacuaauggcaugcaccacuaugcucagcuuacaaaaaaacuguaucuuucaagacaauguaugagcuccaaaaggcuguaugguucgguucacugcuaagagugucugaguaaaacaaacacagccuaccgaaccggaggauguagucuggaagagaugcuaauaugacccaaagaauacauuuuuucucgacgaaugugucccauaauauauucacauuuugaauuuaaaguauuugcaaugcuauuauaucaaucuauguaacuagauaaacuuggaaggucagugaaaucuaguuuuccuucuuucccaauuccugaaaauuaucuuuacugucacucauuauauacaauaguuucucauaauucagauacaauaaacaugauugaauccacucaccuucgauuugcaaguuccacagcaucagaugucacauggucaagagaaucuauuccugauuuauccaucaauugcucuuuguuuuaaacaguuuucugaaauuaugaaauuuaguaaauaugacaaagcuucccuaaauauugacaguaucuacuacaguguugaacguggucagacuaugccaaugauuucaggcgaaaucauuuaccaagguuaagcuucuuauccauuucagaucaguuucuuuaaaaagaaauccagaaauucuauucacagguucuuucaguuguuacccucuaaauguauucaacgcaacaagauuccaaaaaaguaccgucccuuccaacaaaagcaucuuucaauauaaguaaaaaauguaguuuuaucauuagccacauauuuuaacguacaauuaccaauacaguauuaauguacaauuaaaagccguuuuccaagaucaaagggggaauuccuaaagcaaagugugcccuauauaaaccaggaaaaggaucuccaaucaauaaaccauuuuaaacuccuaaucaccucuccauuauaauuccuagauucuucauuccuagauucauuuaagcaacugaacuuugucauauuguaucuuugccauuauugguggaaacugacaaguucugaauucucaaccuuuuucaaugaacuaucauaauucuugugucuucauccccaugguagagaguauacaacauaccaaaaaaaaaaaaaaaaaaaaagaaaaagauuccuucuugugagcuaaaagaaaaaagaaaaacagguuggucuggguggcucaggccuguguaacacagcacuuugggaggucgaggcgggcggaucgcuugagcccaggagcucaagaccaaccugggcaacguggugaaacuccgucucuacaaaaaauacggaaauuagccagaauaguggcgcgcgccuguggucaggaggcugggguagguggaauaccugagccugggagguggagcuuguauguagugagccucagcaacacaaggagacccuugucucuacaaaaaauucuuaaaauacuggcuagguguguuggcccgugccuuugcucccagccacucgggaggaucgcuuaagccgcgguggagguugcuguuagccgagauugcaccacugcacuccagccuggacgacagagcaagacccugucucaggaaaaaaaaaaaaaaaaaaaaaaaaaaaaaaaaaggcauggcaacaaaaauuaaagauaacuacuuauuucauuauuguacaugccuuagucaaucucuugucucauucuguagcuucuugggaccugacaugagucauuacauauaaauccuaggaugaacuagcaaaauauuuaaaauaugaaacgauaaggucaccaagagcucagauuuguuaaaugcccccugugguauuuuccugguacaaggucuuacuaguuuuuuuaaguacaagauucuacaaagucauuaaauaucgaaugcucaaaaacggaauucaacaaaaauuugcccccaugcuuuaacgguauaccuguaguuaauuuuuuuuaaaaguagggauuaucaaaauaaagcuagcucaauaaucacuuuuucgaaguguuuagaagacacuccuacuugggugucgaugccuccguggggauucugcaauucuuagaggccacgugggcagagagcggcgcuuuacccggagcuaacgcugugaccaccagcgccucucacccggcagcgccuaaccugcagaaaaccggcgcgaguaauggguaccucacauacgaagguuaaaucauuuaaaucacguaauaagguuaaacuuguccgcaacacgauuuaacaccuccaucucaagauauaaugaagcccguccacacuacaaccacguuugugugggacucauaccagccgcguggcgcggaguggccugcggccgugaucccuucacccucucggaccgacuucggagucucgauccuccggaccaacgaaggggccccgggaaaccccagauaugcaacgccucccccgcccgccaggcccggacggccucgcccucuuagcaaccuaccuaaaacggccucgcaguggccccaaccgcgcacuugcugcuuguaacccaggccucggcccaaaacccgcgacuggccugguguccuagagcucuguacacaccacccucccgaccucagcccuccaacucccgauaaccagccgaccuccuccaaccgugcggaagaaaaggguuggcuauuuccguggcccaaguaauagucaggccgaaauc

SEQ ID NO: 192015 - RNA, 31300 nt, Homo sapiens
acacccggaagcagaucgcgcuggggaaaggccacgucgcuaugaguguguuucagucuaccuggauuaaacguuugcuucucuucgucuaccuugauuaaacgugcacuucgcaguccucgguucuccauacccgugaccuggggaucgcuacggaccuuaaaauacccgcaacagccccuucgucccaaguaaguaggagaauugcuucccuuucgguuuaaaaucucucugaggccguuccuugcucucugccuuucuuccuuaggaccauguagacaaccccauucagguaguguucccgcuuaaaacccucugcuugggccccgcgccaagucgaguccucauucgggauguggacuagcgcccuucgcgauccccgagcuccuccgucgucugccccuggaggggagcgcccacuguccggcuccugaaggagccgcuucuccucccacguccugggauucugcagacccucccugucgugagacaucguucuccgcgccaccucgugucguccucacgccggguccuuccgcuccccaggcuuccccuucacagccacugcuuuucuugacuccccguugggacagguuaccugagucugucuugugacacccaguguucuuccuucccaaauuuuacuccacuggaaaaugugcucuuccgggaggugggcauccuauuccuccccuuuccucccgaaugugugggugagagggaucaggagaggaaaagacggggaacgacggagcaaaaggaaaaacugaggagaaaagaaugagggagacccauaaauacacggcaaaauggaugauacuuuagggacuugcaaagagagcaagagugaaagagaacggauggaaaaaguagcagggggagaaaagcacacagagaaauuuagaaaaaaaggggaccuucagagagaugaagggcagcaaaauagaguggggcggcaaaggaggaggcacugcagacagacagacaguggggagaaggugaaagaguuggagccgcggcugacagagcuacguggugcugggacugaaagagagggagagagggcagugggugacaagcagaguagagggagaaccacagcagggaguaagccuaggaaauugggggugcuagagagugggaacaaaggagauguaacagggaagagggaauuuaacaaggagagcagagagggagcuuagaugggggaaaagaggcagaaauacguggagauuggggacaaucggaaagauuggggagaaagagcuacgagaggugaaguaaguugcagagcauugggcagaacagacauaaaagagggaauaaagaaaggggugcaaaacagaaaaggagaaaaaaaagacgcucagaaugagagagggaaacacauagccgugaagaaagcgggagaggaccccauccagaugcgugacaguugauuggauauggauggugguuguaauauauugauuuguggcuuuauacucugauuugaaauauguuuaaguuguacucaugaggaugaaaaucaccaaaguuuuuucuauaagccuugugcauuuuguauguauuuguaucaaaagauauuuggaauuccuauuuagccagagggcagugacuugauccaguuauuugugguaacucucuucuucccaaugauggaguagagcauaaaggaggggagaaauggggcaagaaaugacugacugucacuacaagauaugucuuugguguuuuuuuuggcuuuguucuguuuuguuuuggggggggacauggucucucucugccgccuaggcuggagagcaguggcaugaucucggcucacugcagcuucuacuuccuggccucaagcagucuuuccaccucagccucucaacgcacuggaauuacagaugugagccaccacacuaggccuacaagguaugucuucgcagaagcauugaaagucuuguuuuuuuguaaugaauuuacuuuuuucuuuguaguugcuuuacaguuaauuaauuguuauuuuggaagcuugagauacauuuuauucaauugcuucuuuccuauaguugcuaacuccagaaauaagauuugguggcauccaauaaucagcugaucucauucauuucugaauauuaagugccaucauuuuuugaacuuuuaccccauaauuuauuagauuuuucaaaaacuuuccaaacuguuaaaguguccaauauaguauagucaccaugguguacauuagcuuccucagaacuucuucauuuuauaacagaaaauuuguacccuuuaaccaacauuuuccauuuucaccccccagcagccuguggcaacaacuguucuacccuguuacuaucaauuggacuuuuuuagauuccacuugugaggucauacaguaauugucuuuuagugucugucuuauuucaccuagcauaaugucuuccagguucauccauguuguugcaaauagcaggauuuucuucuuuuuaggguuggauaauauuccauuauauauauguacacaugaacacucuguauaugucuauauacacacauauuuauucauggaugggcacuuggguuguuuccauaucuuggcuguuaugaauaauacuguagugaucaugggggacagauauuuuguaagguuuucuuuuuuuuugagacagagccucacccuguuguccaggcuggagugcaauggugcaaucucagcucacuacaaccuccacuuccuagguucaaaugauucuccugccucagccucccgaguagcugauauuacaggcacccgccaccacgcccagcuuuuuguguuuuuaguagagacaggguuucaccauguuggccaggcuggucucgaacuccugaccucgugaucugcccgccuuggccucccaaaguguuaggauuacaggcgugagccgccacacccagccauuuuuuuguuuuugucuguguuuuuucagcagauacauggucucugcuauguuguccagcaugaucucuaacuacuggugucaagugaucuugucgccucagcuucucagagugcugggauuacagccaugaacugcuaugccuggccuagaugucucuuaaagauacugguuucauuuauuuccuuuggauauauacccagaaaugggauugcuggauugcauuguuguucuauuuuuaauauuuugaagaauguccauaguguuuuucauaauggcuguacugauguacacucccagcaacaguguacaagggcucauuuuucuccauaucaugcuaacaccuguuaucucuugccuauuuaaaauagccuucguaagagguaugaggugauagcuuauggugguuuugauuagcauuccucugaugauuagugaucuugagcaucuuauuauauaccuguuggucauuuguaugucuuauuuggaaaauguucagguccuuugcccauuuuuauugagauuauuugggguauuuugcuguagaauuguaggaguuuuuauauauuuuggauauuaaccacuuauuaaauauaugguuugcagauacauacuuccaucuuacaaauugcuuuuucauuuaguucauuguuuccuuuggugugcaggagcuuugccccucccccaccccacccccaaaauggagucucacucuguugcccaggcuagagugugguggcucaaucucaguucacugcaaugugugccuuccgaguucaaaugauucuccugccucagcccccguaguagcugguauuacagguugcaccaccacucccagcuaauuuuuuaguagagacagggucucaccauguuggccaggcuggucucgaacuccugaccucaagugcucugccugucuuggcgucccaaagugcugggauuacaggcaugagccacugcgccuggccaaacuuuuuaguuggacauagucccacuuuuuaguuugauguagucccaccauuuguugccugggcuuuuggugucauauccaaaaaaaucauugccaagaucaaugucaaggagcuuuuuuucuauuuucugggguuuuacgguuuuagaucauauauuuaaaucuuuaaucuauuuugaguuuaucuuugcauauagugugagauaaggguccaguuucauauucuuuugaaugugaauauacaguuuucccgacaggauuuauugaugagacuguccuuuccucauuguauauucuuggugcccuugucaaaggcuaguuguauaugugcauguuuauuucugggcucucuuguguuugauuguucucuguguguuuuuaugccaguauuauacuguuaggauugcuguaccuuuauaauauaguuugaaaucagaaaguaugaugccucuagcauguucuuuuucaacacugcuuuggcucuuuggaguuuuuugugguuguauaaaaguuuuaggguuuuuucuuuuuuuaucugugaaaaauagcauuggaguguugauagggauugugcugaauuugcagaucacuuuugguaguauggacauuuuaaucauuuuaaaauauucuuacaaucuaugaacaugggauagcuuuccauuucuuuguguguucuucaauguuuuuuuuauccuuuguugcagccccaaugccuguggacugaacaaagggggacggacacaggaauaaagacaaagacaaaagaguauauuuggaagaaggggucaggggcuccuugcuucuagugagcaagaguccugagcuuuuagagcccuucauauuuauugaguaaaggagauagggagaagcgggugguugucagucagcugcuugacuuggugcaggcuugcacgacugcauucucugaacaguagccuccagauguuucaguagauaaccucaaggagcauggugccagggaguaauugcacucagcauaccuucuggcggcagggcagaugugaguuugcccacauccugcauucaugauaaacaguuugcuguuuaaucauauagccuucaguggaaugcagaguuggucaugacccuuuggcuuuuggcucucuacaguccuuucuuuuuucuuucuuucuuucucuuucuuucuuucuuucuuucuuucuuucuuucuuucuuucuuucuuucuuuccuuccuuccuuccuuccuuccuucuuucuuucuuucuuucuuuuuuuaagagaccagccucacauuguuacucaagcuggagugcuggcaugcaguggggcgaucauaccucacugcagguuugaacuccugggcucaggcaacccuccugccucaggcucccagguagcuaagacuauagguaugcacgaccauaccugggugaagggcuaagacuacagguaugcaccaccauaccuggcuaauuucuuuucuuuguagagaaagagucucacuauguugcccaggcuggucucaaacuccugaccucaagcaauccucccaccucagccucccaaagcacugggauuacaggcaugagccacuuuccuggccucuucaauaucuuuuaucagugucuuaagagcuuucaguguacagaucuuuuacuucacugguuaaaucuguuccuaaguauuuuauuccuuuugaugcuauuacaaauaggacuguuuucuuuauuucuuuuuucagauauuuugucuuuaguguauagaaagauuuagggccccucuucugagacauccucacugaacuuaaucuagccaaugcccagcugccuuuaaacuagacuuaauauugucagcacuugcuggcaaguuuucucagcaggcccaacuuuguggucuucauacugaaggcccaggguccuucaguuugcaguuuguguacacuccugcuguguugcaugugcccagagauccuguaccuuuuagccuaguuuguucaugcaugcauggaggagagguagaaaaaugggggaaaauggaggggaguccauagaaggcuccagaaagcaagggugggccuucagaugagccaugguauggugugugcaccugucccaagugugguuauaagagcaagggguauguggaacucuuggaaaggaauuucuuaggucuggcagaagcacuuggaagugggauuaugagugguugugcauggaucauuuuggaaugccacaguuucuuuauuuuuugcucgguugcucaggcuggagugcagugaugugaccucggcucacuguaauguccgccucccgggcugaaggcauccucucaccucagccucccgaguagcugaaacuacaagcgugugucaccauguccggcuguuuuuuuuuguauuuuuuaguagacucgggguuuugccauguugcccagucuggucuggaacuucugggcucuagugaccugcccaccuuggccuuccacagugcugggauuacaggggugagcaaucaugccuggcucauuaaugauuuucuucauagcauuugggaccccaucuacugccucuugguuggaguggcugcuucuguuaucuugacauuuuuuaagccaaacuucuuaaauuaucaguccauauuuugcuggcaucaaacucuccagcuuuagauccuuuaccuuccuaaaguugucauaaaauaacuucccuuuuucucaaaucauauuagagucuacagguaugccuucauuauagugauuuugccccuguauaaagcugcauuuucaauaugagauaaaaaagguauuuagcaaaaaguacauuguuuucgugccuacugguguagcugcagugacggcuucaugaauuuucucuuuuaacagugguccuuacaccagauuaauuuaucuugaaauggcgggcaacugaaucgcacaccucaaucuaugguacguauuaagcaagucaacauguucuuauaaugucauggcuuuucucuacuucuugggagcacuuccagcaucacuaguggcacuucagauggguccuguguuguuauucagaguuuaucguauugcaccaaacaaugaaaaaugugccagaaccacagagaucaauuuuuacugcggucugcaauuuacuagagagauuaacaguucacauggagaugauuaacaucacggggcacauuaagcagguaccugagcucaccacaauagcaaugggagguggcuaugaaauuauuauagaaguucaguauguaguacaguucauuaaugcaguuaugauugaauacugcgucuuuacauuuuuuuacauuuauuuugacuguagauggaaccauauacagucuagagguguuuauauaaauuugguacauuuuaacuuagaauagauuuguguguguuuuaugguacuaagugauaaaauagacuaauaguuacauauauuuuaugcauuucuggcauaccuuuuucuuaauuaggguacaugguucaucugugaguuuuuucaaauuguugcaagucuucaaaauauuuuucagauguuuauugaaguaaauucuuuuauaaauggacccauacaauccaaacucauauuguucuaucgucaacugaagugagaagcaaggccuaaguggaguccacagggagguugggcagcuggaggguugguucguuggucuugagagcguggaacccagaacuguacugccauaagcacuuuucauggugacuucugcggggucuuuugggagugcaggaaucaugcaacuuaccgaaguauuaucuggaaaaucacagagaucauuuaggggggcuaccuuuguuuuuuuuuuuuuuuuuggaguauuuugggcugcacguuaagaugguuauagaugcauuuuggaugcauuaucuaaaugucaauauggagaguuuccuuggaagauguuggggucucauuggggcaugugugcaucauugaagauaucuguuuuaguagauaguggugccaguauucggggguggggucauuacaggcauggaccaccgugcccagcuaauuuuuguauuuuuaguagagacgggguuucaccacguuggccaggcuggucucaaucuccugaccucaggugauuugcccaccucagccucccaaagugcugggauuacaagugugagccaccgcgccgggccucucuguuuauuuuuuggaguuuuuuuuccccuaaaccuggcccauuucaagguucaguuugauaauguggcacucagcacaagagacuucauucuggcuuggucugguaguucgggaggcuaguccaaaacaacagccuucccauaaaaaacaaugagaucauguccuuucccaggacauggauggagcuggaggccauuauccuuagcaaacuaacacgggaacagaaaaccaaauacugcauguucucacuuacaagugggagguaaaugaugagaauacuuggacacauagagggaaacaacacacacugggaucuaccugagaguggaaggugggaggagggagaugaucaggaaaaauaacuuaugaauacuaggcuuaauacccggaugaugaaauaauguguacaacacauccccaugacccauuuaccuauguaaccagccugcacguccugcacauguaccccugaacuuaaaauauaaguuaaaaagaaaacaacgaaaauacuuugggcuuccauaaaauuuguuuaacugugucauucauuuuuacuucuacagaauuacuuuaaacaguguuuacugauggugguguauugcccauuaaaugcaugcacacacacagacccuaaagccucuaguuuccuuccacugugcccuaauuaaaacaaaacauaccauuaacuguguuucugccuguagugaguaccccucuucugugcuucauuuaagaccauaauacaauacaaucuuguucagagucucugucuucacuuguugccuccaauugugucuugaaugcauuggaugaaacuuucauauccaccauuccacugauaacuuuauuuuucagagucaccagugaccuccccauuucuaaauccaauguauuucauuuccugcuuuacucuuucuuugccugucaggagcuauuugauuuucuugucaccucccugaccauuucacacuuuccucugcugcuguguccugacucugaauguuucccaaugugggaaugacucauggcuuaguccuugaaccucuucuuguuucuguccacacccacugucuuuccucaucaucucaucuuaugaauuuaaaccccacuguauuaguccauucuugaauugcuauaaugaaauacuggagacuggguaauuuauaaagaaaacagguuuaauuggcucacaguucugcaggcugcacaggaagcauggcgacaucugcuucuggggaggcugcaagaagauuccagucauggcaggugaaggaggaacaggcgucucacauggcgggagcaggagcaagagagagugaggggggaggcgcuacacacuucuaaacaaccagaugucgugagaacucacuaugauaagaacagcaccaagggguggugugaaaccauucaucacaaauccacccccaugauccauccaccucccaccaggccccaccaguaacaguggggauuacaauucagugugagauuugggccagggacacagagcugauccauaucacccaccuacccaccuacacgucuccauguccccugcagaccuguccccugaacucuagaauucuguguccuuuuguccucuccucucucugcuuagccaucuaacagguaucuccaccaaaagugauugccugaacucaccaaguacauuccccugcacuccugcacaucucagaugauggugacccuguacuuccuggcuuuagcuuuacaugucagcauauauuugaaacagagaaaacaugacauuaaaaagaagugcuuuaauucaugugauaaagaaaaguuauguuuacuuaaaaagggugaggaaaugcauaguuucugaaauuacugugagcugugggagaaagauguuugaauaccucaucucuaccuaaucugcuccccagaaccucucugaccucaucuccucccuguguccuuccugcucccucugcuccagccacacaggccucuuuccuguucccugggcugagguugcuccugccucagggccucuaccugggcugucuggccccucagcugcaggugcaaacauccuuccuucuugaggucuuuguucugauaucaccuucuccauugggacuucugugccucacccuccucucaccauuuaacacuccagccacacccucaccccaccccuggugcauauuaugugucucuguguuucugguccauuguguucuacugucuacaaacugguaacagugaagccccaaggggacagcagagcugggaggauggggcugugcuagucuugcccccuuuaagauguguucaacccuggcuucacauuagcgugcugaggcaguuugcaaauacacguuuugugcccuuuuaccauagauuccacuuccaguagguaggauggacucaaccuccauauuguuuaaaguacccaaauugauucuaauuuguauccagcauugagcguccagccuuugugucuucuguuucugagagcugagcucagccugugauccacagggaggugagggggcugugcucuguaugggguuugaucagggaugggucuguguccugaagggaagcauaguccagcccagcuccccacuguugcagggugugugggggcuucucugggaggggaacaaguucugaagaaaagggugaaaaacuuacuuggucuuuguguaggaguuuauuaugcuugcaucccccuggugcacugggcugucucuccacaugcugaggccuucccugugggcaugguuguggcacagaaaggaauguguuguuuccaaggauuaaacaacauauuuuugacuuucagauuugacuuuuaaagaauuaauuauauugacugagagagaggcccaggagagaaagaagaaagaaaaggagccagggauggcucuuccucagguaaagugauaaucuugguggauuguucugucuccucccuuuuugaaaugcagggcauuggagcugcaaaucuucucugagucugaaguauccugccugacacauuugcucgcacucacccaugccuuccuucagucccucucuucugcacuuagauuccagaucucacagugacucagugacaugagcuugggaagaggcuccacugggcaugguccugggaagggcucacacccagacauggauggagacagggugugaguucuguggugucagcuuuugggcagcagagauuguuuaggggcaacaucugaaugcacugucagcucucaguagaccaggaguagagaagcuguauguggaagucacauguuaauaugcaaaaauaccucauaaauucuugaaaagaugccucuaaggggagaucuuuucugccugauuuuauaccacauuugaagcuauaaugaaucagucacucuuucuaacuccacaaucuuaaugaccgggaauggaauggaaaacuagguacagacaucagugauagagguuguuuuauuccaucauugauuuuaaaauaugaaaucaaccugaaugucagauuaauuuagccauucucagcauauccaucccacagagaaugugguguuccugcugggacucuuaccggcaguuguuuuuuguaaaacgguuauaauuuugcucagauguaagagccaaacuuuuuugaugucagagaagauggagccaaauucugucauuccaccaauuauuauuaaauauuacauuuauuuuaaacaucacaugauauauauauuuguuuugugguaaaaguccaagcagagauggaauuuagacauuaagaaggugaugcaacauaaggaugguagggaauaacguguuauuauaugugaaauuuaugcuaaaugagauuuuagcuguuuuugccacaaaagcaaaaaaaaaaaaaagguaacuaugagauacggauauacuaauuuguuaaacugucgugaguuuuuuacuaucuauaccuugcuauauuguguaccuuaaauauacacaauaaaauuuguaagcaaacaaguaaaaaacagggcaucaagaacacccuucauaaccuaaaaaaagaacaucaaggcauauauauuuaaaaacuuuuaacuacagaacaugaaauagcuccuagaaugcaguaaaagaaaauugagcauaaaaugaaaauuauuuuauuuugauuuccacaaaauaaugaaauguccucacaguccaaggaauuggaaaauggaaauacaaagaauuuuuauuuuuuuuagauccucaaagagaaaaaagaacauaguaguauuuuuuuuuuuuuuuuuaaagagugggacaugucaugugucauuggugggagggggcacccuugaacuugggguaguggggaaucuugccagauucaccaaaauaggaaaugcaccauccuagaagaggcaaucacucuuucaauuacccacccagaggaacccagguuccuuuucccugucacauucuccaccaugccucauguuucauugaggagcuacuauuguaaguucuguggcaagagucagugagaggugucaagaugcauuuacacgucauuaugagauuuuagaaaacaauucuuaagugaauguucugcuguauuuugcaaguuuuugaaauguacauuuuuuuuuuuuuuuugagacggagucuugcucugucgcccaggcuggagugcagugacgcaaucucagcucacugcaaacuccgccucccggguucacaccauucuccugccucagccuccugaguagcugggacuacaggcaccuaccacugugcccaguuaauuuuuuguauuuuuaguugagaugggguuucaccguguuaaccaggauggucucgaucuccugaccuagugauccgccugccucagccucccaaagugcugggauuacaggugucagccaccgugcccagccugaaauguacauguuuuuauguuaauaaacacuaauagcguauuuugcauccucuuuggagcaauuucuaaaugaagacauauggaucuuuuacaauuuuucauuuuugcaaagaaugucacuguggcuuccucugugcaugcugucuucaccacaagugucugaggguuacuucaauggcaguucaaagaaugauugcuucuuuuaggaugguauaccacaaaagcaaaaauaaguaaauguuuguuuuaucuucuggaaggccuggcucacggugugauuauaaaauaugaaguuucuuuaaaaucucauguuucuugcuuacauuuucuuugcaugaauuuuuuugauugaaucuuuaauuugaauuuuuguguauaucuuuuuguagauuauauuugauugcuuuuaaaguuucagauuauaaaugucauaauagguucauaugaagauuggcaaaccucuccauuuucuuuccaaaauuuuguugguucuuuuuuuauacaacagucacauuuuauuaaauucccacauauuuuguuuguguuugaauggccaugaauuuuuacagucgcaggucuugucaccaucacaucuuccuauaagaauugaguuugucagucagugaucauaucuuuauuaugucuuucaguaaagcuuguuuguuugcuuacaguuuaguaauguuagguauauucacauuauuuauugggcuuucaggauacauacguucuugaugcuugaugguuuccccaugagcccuuuagacucucuuuauuuuucuuuauuuuuuauaguuuuuguuuuccuccgugucaaaauccccuuugaguucacugauuccuucuucugccucauuaagucagcuguugaauucaucuagcgaauuuuucaacucaguuauuguauuuuuaacucgacuuuuuuucuuucuuuuguuuuguuuucaggcaggguuucacucuuucccaggcuggagugcaguggcacgaucuuggaucacuguauccucugccucccggguucaaaugaaccucccacuucagccuccugaguagcugggacuacaggcaugcaccaucacaccugccuaauuuuuguacucuuuguagagaugggauuuugccauguugcccuggcuggucucagaacuccugggcuuaagcaauuaccccaucuugggcucccagaguguuggaauuacaggcgugagccacggugcccagccuuagaauuucuuuuugauuuuucuuuauagcuucuauuucuguugauauucuucuuugcaugcauaguucauauaguuuuccugauuucgugagcuugucugugugugcuaucuuuuaacucauugagcauucuuguggcugcuauuucaaauucuuugguaauucacauauagucagcccucuguauucauggcucgugcagccauagauggagccaacuaugaacuacaaauagccagaaaaaaauggaugguuucaucuguguugaacacguaugguccuuuuuuucuugucauuauuuccuaaacaaugcaguauaacaacuacuuauguagcauuuacauuguauuagcuauuauaaguaauguagagaugauuuaaaucauaugggaagauauagguagguuauaugcaaauacuaugccuuuuuauauaagggacuucaguauccauagauuuugguccccuuagggaaucuuggaaccaauccucugcauauacugagggugauccccauuuccuuuuaguucuucaaagccaagauuuaaaucaccauuucuuuaguguagguuuguagagacuuaauugguuucuuuuuauggacuguauuuuccuauuucuuuguaaguuuuauuaucuucuuuuggcacuucccuauuuuaaaaaucaucuaccuccccaguuuugggugguugcuuuguucagggaggacacucuggagucaacucagcuagauuguggagaccuuccacaccuuuucuggcuggggauuuuguccucucugggccuuugcuugucaucucuucauugaaaauguuugcuaguuucuacccagaagcuccccuguugucugucuuugauauugcagacuuuggugcuacaguaagcuguaguacuagauaugcacuuagcguuugucuguguuacugcacacacugguuuauguaaaucauccuuuuucucaguggccccuaaccuuucaccuuguucuugucagugcuuauauucaggaagagagaaaccagcccaucaguuggucaucugaaaagucaggaaguuggacagauauucugcuccuuuccauccccuagaugaucuugggaguuguggguuucuuuucuguuaccccagugcauggcaggggcuggaucucugucaaguggaugcuucaaauuuuccuucagagcuucuauacuguuugcuuuaugucagccugagguguagaaaccuccuaacuguuuucuggauuuauccccgaggcaauuaguccaugaauuguuguuaaaaucauuucacuguggugacuggagaguuuggggauuccuguuccuuuaucuugccgacaucacucaguguaguuuuauaauuuguucacauaauucugaaaauguauuguacuuaagugccaugguauauaugcuaaugaaaauuuagaaguguguguguuguuuuuaaauuaguguuacuaaaguaggaagauuauuucaguacauuguuagcauuguuagcuuguauacuuaaacauucuuuuucuggguugcaaucauguuaucucuuuuuuuuuuuuuuuuuuucccugagauggaguuucgcucuuguugcccaggcuggaguacaauagugcgaucucagcucaccgcaaccuccgccucccagguucaagcgauccuccuggcucagccucccuaguagcugggauuacaggcaugugccaccaugcucggcuaauuuuguauuuuuaguagagacgggauuucuccauguuggucaggcuggucuugaacucccaaccucaggugauccucccgccuuggccucccaaagugcuggaauuacagguaugagccaccgugcccggccacaaucauguuaucucuuaauuuuaguagaucuaacucuuuggcucuacccccuccuugccuuuuucccucccaccuuuucucuuugcugcugcucagacauccagugcaguggugaaugacaggaggucuggccaacccccuuuucucuuaauuuagaggaaaugaaaaacccccuuuucucuuacuuaauuuagaggaaaugaauccaguguuucacuuguugggugaaauauuuuuccuuaacaguuuuuggguuuuuuuuuuuuuuuuuuuuuuacagauuuccuuugcaacaugauuuuuaaauuuucuaauaauuuaugcaagcauauacugcugcaauacauauuguuucuaucuuaaucuguuaaauuuuaauguauuacacuuauaaaccaccuaaucuugaaucacuguuuuauuuauugguggaauaaacgaauaaacuccauuuggcuuuuguuaaugcauaaguagcuaaauuuaacuggauaaaauugcacuuagauauuuaaauauaggcauuuaauaguaauuguaauaaaaguuuauauacuuuuaaaauuuuguaccauuuucuccagccuaguauugaauaaguacaaaauaaauaaguaaaugaaguacuaaguaaauaaguaaaugaaguacuaaguacaaaguaaaugaaauacaauuuauacauuuucauugucccaagcaugcuaaaacauacaugucuaagaauaaugauuuaaaaagucauccaaaaaauaugucauugagagauagcgucuuauuucaguuaauuuaaauguuuguaugcuuugguuuuuauuuacaacaucaucauuucauaaaucagccuauuaucuuuucacaguugaaauuauuuacuugguuuuauuuuaauuuuuuucuuuucucuacauaagauacaggcuugggaacacuauugaaaauuauaucuuaaauguuucuauggccuuaaaauguuuuuucuuuaaaaacuuuuuuuuuuuuuuuuuccgagauggagucuugcucugucacccaggcuggagugcaguggugcgaucucggcucacugcaagcccugcuucccggguucaugccauucuccugccucagccucccgaguagcugggauuacaggcgccggccaccacacccggcuaauuuuuuguauuuuuaguagagacaggguuucaccguguuagccaggauggucucgaucuccugaccuugugauccgcccaccucggccucccaaagugcugggauuauaaaaacuuuuuuacauauuucuuugucccagugauuugcuuaauuuuuaaaauugccuucuauauuaucaugugaauggauuaguuuuaugaauaguaauguauuaugugugugcuucugugugcuuauaugaugaucuuuuuuuucuuuguuuuugagauggggucucacucugucuccaggcuggagugcaguggcaugaucucggcccacugcaaccuccaccucccagguucaaguaauucugugucagccuccccaguagcugggacuacaggugcacaccaccacgcccagcuaauuuuuguauuuuuaguagagaugggguuucaccauauuggccaggaugaucucgaucucuugaccucaugauccacccaucuuggccucccaaggugcuaagauggaggugugagccaccacgccuagccuauauaaugauccuuuaugcgguuccaaguuaaucuugaacuugcuucaaguuuucucaggcaacccucugucaguauacuguagcauucguccccuaugcagcaacaagaccaucuucgaagcagggauuagcccucagcgacaucaguccugcugacaccuugaucuuggauuccccagccagcagaaucaugagaaauacauuucuguuguucauaaguuaguuagucucucuuauuucguuauagccacacagaaagacuaggacauacucuguaauauaacugucggauucuguugauucaacucuaauuuuuagacaucuggguucaggugcuugcucugcuguuugcagguuguugaccuaggugacuuucuuagccugucugugacacaguugucuucuaguaagaugggaagaaauauuucugucauaggugauuaugucaucauuugaguuagaacacguaaauccuuugaaguaaugcccgguacauggggaguguuccaaaacuuuaguucuugcuguugcucuugucaucgcuguuuuuaguuucugaccuuucuuuaaagccacuaagaacauugucaucucugaagacaccacuuguauucuagcucaucuggacaccucacuugguguaacaaauguaauaucuaaaacuuucauagggauaaccauguguuuauuucuuauuuuguccacaaaagugagaaaugugcaccgauuuagauaauauccuaaucuccuauugaauuuuauaaaacccaaaaucagggagacguaauuaucucacagauacuuuuaauggauaugucaaaacacacuucaaucaaauugaugugacaguucucuccucuucucauuuuauguaaagauaagagcucacccacugcucauauugaaauguguuuuucauuucagggaucuuugacauucagggauguggcuguagaauucucucaggaggaguggaaaugccuggacccuguucagaaagcuuuguacagggacgugauguuggagaacuacaggaaccucggcuuccugggugaggauaguuuuccuccagaaguuaggaucuucccuugugcauuuuuguacuuuccuuauuguguuucuugugaggcccuacauuauuugacagagacugaagccuuguugauucacaaauaaaaagcuucauaaugcugcaucuggccuuuaacugucccauuucuauggauauucugcuuccuucuuuguacauuaguggugacuccagagcugagguacguguaaaaccuuauggcggaguuaauauauccaauucccuguucuuccuguuuucuauccuugugcuuuuuuuuuuuuuuuuugacacagucucagucugucacccaggcuggagugcaguggugugaucuugugaucuuggcacacugcaaccuuagcuucuugggauaaagccauccucccaccuuagccuuccaaguagcugggacugugggugugcaacaccaugcccagguagagacaggguuucacucuguugccuaggcugaucuugaacuccugugcucaagucaucuucccgucuuggccucccaaagugcugagauuacaggcuugagccaguaugcuuggccuaucccuguguuuuugauucaguauuucuugggagagagcuagauaucuucaucuuacaguguucacuaagcauucagaaggaggcaaucaauggaugaguuugugaaauauuuuguagauucaacugcaguguuuucucuucuaccuagacauuaggcuggguucuggaaaaaccgugggacaucuucuuucuuuuuuuauaagcaggacucugucuuccugaccugaauauuaucuccauguuggagcaagggaaagagcccuggacuguggugagccaagugaaaauagcgaggaacccaaacuguggggaaugcaugaaaggcgugaucaccgguaagagcucagaugggcacaauggaagcgguaccaugaaauugugugcguaagacucugcaagugggagaguucuguggggaaacaaauuugauuuucugugagcuccagaaguuuucuucuuuccugcuuaucacuuugcuuuccagacacguauaacuuuaccuuucacucuccagggguugcugcagcucaaacagagcaaaguacaagacuguuaugauggaccacagugucaucuguauugugugaacucugaugcuuugacucuguggcaugggaagggccuuuucaaagaagucucuuucccguguggucucuccuccuguucuugauuccaucugauccucaguucucugauccauauagauuggagcugagggcuccauaguccuggugccuggaacuuuucugguuccaccccauuuccuauacuugaaagugcuggucaggagaugaggaaacauugguugcccuuccuuugaagcugggguccuagaacuggacuaucuucagcccucucugccuguucaggucccucagccauuuucuuaguucuucuuuggacacucuucuuggguuugugacacgggaaugaguugggucuccugagauuguuacauauaagaauuguaaagacaguugacacaaagguccucucuuuauucuuaguccuacacagggagcguaucucugucuucacacucuuaguuugggaucuguggacagagcacugucucauuucaagaucccucacaauccaauuccuguguuuuucucugucuuguuuaugccuuggcucuuucugaucuugcauucucuuuuauguuugugugauuuuuugccucugagacuugcuuuggauaaaugcauuucuagggucggacauuuuaugcuuuuuuccugcugugauaacccaucuugggguuaugaauaucuuguggacuauuguauggagugaguuuacuggguaagagaaaauuuuugaaggagagcacuuugaguaaugaguuuuaacaucaucuugcuacauacagagguaacuauuaaagccagaguagaaugaucagcauuugucaugauauucagauagagaccaucacaagagccugguuucugagaaaugucacaaaaguaucuuucaaggguacuguggcaauguugaucucauauacuaaugguccucuuuuuugagcuagcagugaaugguguaggaauuucucccaugccgggcacgguggcucaacgccuguaaucccagcacuuugggaggcugaggcggguggaucaccugagguuaggaguucuagaccagccuggccaacuuggugaaaccccgucucuacuaaaaauacaaaaguuagccgggcgugguggcaggcaccuguaaucccagcuacucggggggcugaggcaggagaaucucucaaaucugggaggcggagguuguagugagcugagauugcgccaugcacucuagccuggggaacaagagcgagacuuugucucaaaaaaaaaaauuucucccgggaagaacauuguccagguucacagcuucaucucugcagggcuguugccugaaccacugcucaugccacacuuuucuuccccaguauuuuuguuuauagugaguacgacuuugaucuugaggaagcuaaugaaguugaaugaggcuuaucuuuuuuaaguccacaaaauucguuuuaagcaaccauugcuuucaucugaugcauuuucauguauuauaaaugaacuuuguuuuuauuuauuuaaucaguuccauauuuuugaggauacucaguuuucuuuguuuuauguuucuauugugguaguguuguguuggggaaugcauauuguuuuauguauuuuacaagauuuccuucuuuaguacagaugguauagcucagcagcaguuucccuaaaacuuacagaaacuccauaauguuguauugauaguaucaguuauuccuuuuacuucuguuucaccugacuuaauuccuacuaugaaaguauauauuugucgguuaaauugauuacaguuuuuaaguuggaaauuuuuaauaucuugagcauaauuuuuuaaguuacuaucuuaauuguggaaauaccauuuaauagauugaucguucuuuguuauauaacauacauugcuuuucuguaguaaguuucaguuuccuaaauauagcuugcuggguuuuguucaaauugcacuguuuuuuucuuucuuggaacaaaugcuguauuauaauaacuauucuccuaucuacauucauguccaucauguuauacugaaucauuauuuaaaaaucuaacuuuauuuuaaacuuagcccauuucuuacacuucagggacuucucuacuauuuauaaaaccuauauauuuuuuucgugaugcucaagcaaugaagaauaaauucucuuaaaaaacugguauugggccaggagcaauggcucaugccuguaaucccagcacuuugggaggcugaggcaggcggaucauuuugaggucugaggucaggaguucgagaccagccugaccaacauggugaaucccuguuucuacuaaaaauacaaaaaaauuagccgggugugguggcacaugcauguaaucucagcuacuugggaggcugagacaagagaauugcuugaagccaguaggcagagguugcauugagcugagaucacacugcuguacuucagccugggcgacagagcaagacccugucucuaaaaaaaaaaaagaaaaaaaaacaacaacuuguauuuuguccagaaaaguuuuuccuagauuuucuucuagaauuuuuguagcuugaagacuuaauguaagucguuauucaucuugaauuaauuuuuguauaugacaagagauaggaguccaguuucauucuucuauauauggcuagccaguuuuucuagcacccuuuauugaauagaaugucuuuucccaauuuuuuuuugacuaucaaggaucaguugguuguagguguguggcuguauuucuggguuuccuauucuguuccauuggauaucuucuguuuuaauguuagcauuuauaucugcagauuuucuaucuuagcacuguuuuuccugcauucacaaguuuugguauguucuauuuucauuuuccuuuguuuugagauuuuuaaaauuucccuugugauuucuaauuugacauauuggcuguuuaagaguaugguccuuguuuguuuguuuuuguuuuuugagacggaguuacgcucuuguuguccaggcuggagugcaguggugcaaucucggcucacugcaaccuccacuuccuggguucaagcgauucuccugccucagccucccgaguagcugggauuacaggcaucugccaccaugcuuggcugaggguuucacuauguuggccaggcuggucucgaacuccugaccucaggugauccaccugccucagccacccaaauugcugggauuacaggcgugagccaccacaccggccuaagaguauguuguuuccacauauuuguugauaaucuaauuuucuucugcuguugaucucuaguuuuauuuuauuaugaugggauaaguuaugcuuuacgauuuuagucuuuaaaaaguuuaaaauuuuuuuucuuuuccgauauuucuuuugaaaaauguuucaugugcaguucugaaaaauuuguauugcacuguuuuugggugauguguuaugcauauauagguuagguucaacuugauauauaguuuagguucucuaguuccuuguuuuucuucugucugauuguccuauuuauaaguaaaaauaggccauugaagucucuuauuauuacuguggaacuacuucucccuuuaguuacguuaauuuugcuucacauauugaggaucucuauauaggcacauauuguuauauccuccuagugaauuaaccuuuuaaucauuauauaaugcccuucuuugucucuuguaccaguuuugacauaaagucuauuuuggcugacaucaguuuagccaccucugaugucuuucgguuaacauuuugagggcauaucuuuuuucaucccuucaguucagccuauguguguccuuugaauuaaaaugaguauuuucuggauagugugcagcugaagccaguuuuaaaaauuuauucagccagucucugucuuuugacuguggaguauaaacacuuacauuuaauguaauuacugauagaaaaggacuuauauugccauuguguuaagugcuuucuauaucucuuuuagauuuuuuuguucuguuugucuuacugccuucguuuuuauauaguugauuuuuuuuuccugaaauaguuuuauuuccauugugugugucuucuauacauucucugugguuaccguugcaauuacagaaaacacuuuagauuuauaacauccuauuuuaaacuaauaacagcuuaacuucaauuacauacagaaaugacuuuuuacagaucugcuuccauguuguguuuuugauaucccaggauacuuucaucguauauacugugucuccauuaacauauauuuaaaccuugacaagagucuccugcuuucuuuguuuucucaaaucuuugccuguugugcuacggguccucauucugcaccccgucuccuuaacguucuuguacuaucaguaaaguuuuguggugucuuuguguguguacaaaaugaauucauccaucuccucuucguggccauuuucagguuuuuucuuaaggauugaauuguaagaacagucuuucacauaucucuugauauguaggguuguugagcauauaccuggaaauagaacuuaugggacauucaguuugauaaauuucauagcaaauauuauagagacauaaaucuguuuucuucccauaucaucacaccgccuccuuuuuaauugucuucccuuguuguccugcacccauaguauaauucucauguuuaaguauuagucaguacaauacuaccucuacauuaguuucucuuuucuuccaaagccaggauuuuagcuguuucuugugcaauucuauucccacagcucuucaagcacaaacccugcugcuccaugcucauuacuccuugaucuccccucuugcccuuuguccuccugggccuuuccuaacauauuacuuuguccagauggacuacccaguuacugacuagcauauuaauuuuauacucccauuauugcagaacucccucaccucccaugcuacucucacucuguaaggggugaccccuacucauucacuugaccacugucugauaacacugcguaaaucaauaugugcaggggaugaugacucagauaccguucguuauucaugacggauggcugaauaaugcuuuuggcaacacagcauugcagggagccaaagccugugggacgugaccaacucagcauuccacuggaggcuauaugaucaaacagcaaacuguuuaucaugaaugcaggaugugggcaaacucaugacugcuccugcugacagaagguuugcuggaggcaaucacuuccuggugccaggguuaucuacugccauaucuagagccuguuguuugaggaaugcagucuugcaagccuacucuggacugcgcagcugaccccuucuuccaccauccuucucacuaucucucuugccuaauaaauacggacggcuguguaaagcucagggcccuuguccacuacaggcaaggugccccugaccccuucuuccaaauauacucuuuugucucuugucuuuuauucccgcauucgcccccuuuguucaguccuccuagguccauguggguuacauaguggcacccugaacagcgacagaaucaggugcucuacacaaaauggcucuugaaguauuucuacacucuugauauuuggguugaccuguuaucugcacugcuuguuugggaaguuguuuuuaaaaaacauguuugaucuugcaaacccagguucuugugucuuacuuucuuuguaaauuggguauagauacauaaauccugugggcauauuuagugugcuuguuuguuaaauagugauaauuuaccuaaagacuuuuuaaacaaguuaaugcuguuagcuagcuuagaauauugcauguuuuauaguacagacucacaaauuuguuuaauaacguguaucaacauuguuucauguuuauaaugagauagcauauuggcuuuaccuuagucagcaugacuagcuauaucagauaccauagauagggugguuuaaacagcagaaauggacuuuucacagaucuggguggugcaaaguucaacaugucagagccagccacuuugguucuugguguggacuuuuuucuggugugccauggcugacucuguguucucauguggcagagagauugucaugcaaaaagcagaggcuuuuucacguuucugcuaauugcauuccugaaguucuaugcaccauccugaccuaauugccuuccaaagaccacacuuccaaauacuaucacauugaggauggggccuuaacauaggaauuuuggcagacauaagucuuuauaucagagcagucuacauuguaucuguaaguuuucauuuugcaguuugguccaaacgguguugucuuuuaucucaguucaugcauuuuccaaguacaaucucuguaucauauauauuuuguggccaaggaacuggauaauaaagacagugaauaggacugggcacgguggcucaugccuauaaucccagcacuuugggaggcagaggugggcagauuguuugagcuuaggaguuccagaccagccugggcaacauggcaaaaccucaucucuaccaaaacuacaaaaaaauuaaccgggcaugauggcaugcaucuguggucccagcucucaggaggcugaggugggaggaucgcuugagccugugaguuggagguugcagugaggugggaucaugccacuguacuccagccugggugacagagugagacuccaucucagccaaaagcaaaaaaagacaaugaauacauagggacuugcucuguuguuuguuacauaguuguaggcaugaaaucauaacugagauuucugauuuccuuucccaaguuuuauucuuuuuuugaggcagucucgcucuguugcccaggcugaagugcagugucgugaucuuggcugacugcaaccucccccuuacagguuuaugugauucucgugcuucagccuccugaguaguugggauuacaggcaugcaucaccacgcuuggcuaauguuuuauauuuuuaguagagaugagguuucaccauguuggccuggcuagucucaaacucuuggccucaagugaucugcccaccuuggccucucaaaaugcugggauuauaggucugagccaccauaccugucuccauuuuuuuuuuuuuuuuugagacugcucugucgcccaggcuggagugcaguggcgaaaucuuggcucacugcaaccuccgccuccuggguuccaaugauucuccugucucaggcuccggaguagcugggauuacaggcacgugccaccacacccggcugauuuuuuuuacuuuuaguacagacgagauuucaccauguuggccaagcuagucuugaacuccugaccucgugauccacccaccucggccucccaaagugcugggauuacaggcuugagccaccgugcccggcugaccuguccccaauuuuuauucuuuauuauuuuauauauuuaccuuucucucauccaaguacuaaccaguucugacacugcuuaguuucugagaucagacaagaucagaugcauucacggugguauggccauagacauauuuaccuuucuuuuaucuuuaaaagccagugaucucaacauauuuucuaguuauauacugccucuagaauauaaauucuugcuuauuauugauggagaauuguuuagaauuucauacuauagauuuguauuuugugguuguucauuauuuaccugcugguuuuaucacaggcuauuagaauguuuuauuaauuaauuuauauuaugauuauuuauuaguuaauauuuaccauuacaguauaucuugcuguugcuuggcauucauuuguaugaaauaaauauauguaacuuuuuuucucuccuauuaugagggagccauauguuuacugccaauuggugugucauuuggggucagcgauugcaaaauacuuguuuuggugcucauauauguuugcauaacaugagucuuuuggucgaaggauguuugaaacuaggcuuuccuaaaauugauuuaaauuacauguaaucacuuuuucuuuacuauagaauucuauucauuuugcauuucuacaaauagaagaucaugguagaaaaguuucacaacuugcuaguauaaacauuauguuuagcguaguguguuuucaguauaaaauaauauuuaccaauaauaguuauuuuaaaaccccauguucauuauauuuugcagguaucucuccuaaaugugugaucaaggaauuaccaccaauacagaacaguaacacaggagaaaaauuccaagcagugauguuggaaggacaugaaagcuaugacacugaaaauuuuuacuucagggaaauccggaaaaaucuacaggaaguugacuuucaauggaaagauggugaaauaaauuauaaagaagggccgaugacccauaaaaacaaucuuacuggucaaagaguucgacauagucaaggggacguagaaaacaagcauauggaaaaucagcuuauauuaagguuucaguccggucugggugaauugcagaaauuucaaacugcagagaaaauuuauggauguaaucaaauugagaggacaguuaauaauuguuuuuuagcuucaccacuucaaagaauuuuuccugguguccaaaccaacauuucuaggaaauaugggaaugauuuuuugcaacuuucguuaccuacacaagacgagaaaacacauauuagggaaaaaccuuacauagguaaugaguguggcaaagccuucagagugucuucaagucuuauuaaucaucagaugauacauacuacagagaaaccuuacagaugcaaugagucugguaaagccuuucaucggggcucacuacuaacaguacaucagauaguccauacaagagggaaaccauaccaaugugauguauguggcaggaucuucagacaaaauucagaucuuguaaaucaccggagaagucacacuggagacaaacccuacauauguaaugaauguggcaaguccuuuaguaaaaguucccaccuugcaguucaucagagaauucauacuggagagaaaccuuacaaauguaaucgaugugggaagugcuuuagucaaaguuccucucuugcaacucaucagacaguucauacuggagacaaacccuacaaauguaaugaauguggcaaaaccuuuaaacggaacucaagccucacugcacaucauauaauccaugcaggaaagaaaccauauacaugugauguauguggcaaggucuuuuaucagaauucacaacuuguaaggcaccagauaauucauacuggagagacaccuuacaaauguaaugaauguggcaaggucuucuuucaacguucacgucuugcagggcaccggagaauucauacuggagagaaacccuacaaauguaaugaauguggcaaggucuucagucaacauucacaucuugcagugcaucagagaguucauacuggagagaaaccuuacaaauguaaugaauguggcaaagccuuuaauuggggcucauuacuaacuguacaucagagaauucauaccggagagaaaccuuacaaauguaauguguguggcaaggucuuuaauuacgguggauaccuuucgguucauaugagaugucauacuggagagaaaccucuccauuguaauaaauguggcauggucuucacuuacuauucaugccuagcacgucaucaaagaaugcauaccggagagaaaccuuacaaauguaauguguguggcaaggucuucauugacaguggaaaccuuucaauucauaggcgaagucauaccggagagaaaccuuuccaguguaacgaaugcggcaaggucuucaguuacuacucaugccuagcacgucaucggaaaauucauaccggagagaaaccuuauaaauguaaugauuguggcaaagccuauacucagcguucaagccucacuaaacaucugguaauucauacuggagagaacccuuaccacuguaaugaauuuggugaggcuuuuauccaaaguucaaaacuugcaagauaucacagaaauccuacuggggagaaaccacacaaauguagugaaugugguagaacuuuuagucauaaaacaagucugguguaccaucagagaagacauacuggagagaugccauacaaauguauugaaugugggaaagucuuuaacuccacuacaacccuggcaaggcaucggagaauucauacuggagagaaaccuuacaaauguaaugaauguggcaaggucuuccguuaucgcucaggccucgcacgucauuggaguauucauacuggagagaaaccuuacaaauguaaugaguguggcaaagccuuuagaguacguucaauucugcuuaaucaucagaugaugcauacuggagagaaaccuuauaaauguaaugaaugugguaaagcuuuuaucgaaaggucaaacuugguuuaccaucagagaaaccauacuggagagaagccauacaaauguauggaauguggcaaggcguuugggcggcggucuugccucacuaaacaccaacgaauucauucuagugaaaaaccuuauaaauguaaugaguguggcaaaucuuacauuagucgcucaggccucacuaaacaucagauaaaacaugcuggagagaaccuuacaacuaaacucaauguggaaaggccguuagauguuguccuaaccucugggauccccaaauaauuuauacuuacucauauagcuuguauauuuguccuuucccuuugaagucucauguggaauuguaguaaucuccaguauuggagguggagccuagugggaggugauuggaugauggggguggcuuucucaagaaaguuuuaguaccauccccuuguugcuguccuugugauaguucucaugaggucuggcucaugccuguaaucccagcacuuugggaggcugaggugggcggaucacuugaggucaggaguucaagagcagccuggccaacauggugaaacccuguuucugccaaaaauacaaaaauuagcugggcuucguggcggguacugguaguaccagcuacucgagaggcugagucaggagaauugcuugaacccuggaggcggagguugcagugagccgagaucgcgccacugcacucuagccugggugacagagugagacuccaucacgcacacgcacgcacgaaagugaauggcaccucccucuuguuuguucuucuggccaugugacaugcccuucaccucccaccaucauuuuaaccuuccucagguuucccgagagggugaacagacgucagcgccauguuuccuauaaagccugcaaaauugugagucaauuaaaccucuuuauacauu

SEQ ID NO: 192016 - RNA, 14483 nt, Homo sapiens
ggaccguuagggagcccaaugggcgucgccgccaggccccguugcagagcgcgucuagccaauaggcagcggcggcgggcgggcgcgggcgacaggcggcgcagcugaggcggagcaggcgcugcggcaggagggaagauggcggacgaggagaagcugccgcccggcugggagaagcgcaugagccgcagcucaggugccgcgggggucggggcuggggcgggacugcgcgggcccgcguaagcagggcucgagcucgccccuugggcgcggcggcagcgcugccucccucccaugggguccuggcucuuccgcgucguccccgggguaacggccccggcccgcccuguuguggggacugcgagccucaggagccgccgggaagccugaggaagcugaggcagggggcugggcgggugaggguccggggaguccggggcgauggcccuggcccugccggcccggcugauaccucucggccuaaugcaccugacaccccgggggacgucucugcaccuugcugggcccgggggcaccccugggagggagacaccccaguacccugcaaagggcguaggguguugcccggccucggguccacaaccuaccccugcuaacaccccuacuguguacaccuaaugcugagucugcgacaucgcccgugacauucugccagacgauggccccugugcuuaggcccgauuuaaggguuagccacaaugauaauauugccaguaacagggcauguuuuucucugugucaagcgcuuuaaguucucucugaauugccgcaacucugggagccagguaguuauuacuuccaccuuaccagcaaggaaacugaggucagaaaacugaaggaacucguccaagaucauucauuucaggggccggggguuggauuaggaccuaggcaguuugccuacaaaucccccuccccgugucacugcaaacuccugaggagcaggcccagcaucugugggcaggucccgagucacucugcugccucuagagcccauagcaaucgcauuugcaauaauaauucuccuugguugagugccagguucuggugaacuguuuggauacauggacucuccucauuaaccccaugagguuugaucuccuuauucucuauuccccauuuuucagaugagaaaacugaggugcagggagauuagagcccauugccaagguuuuagagugagucaguagcucagcugcauuugcaccuggaacccgcgcucucgcccacccugcucuagcccuggccuguggcugggaccuccagcauaaaccggaugcucugcccagcucugggcccauuucugcuguuucugcucaguucaacccugauggcuuccuuuaugggugacacuccaugucacccaggcgaacugucagccuuuggaguggcacccaguagggucuuuacuuccaguuucuuguucacagucuucacuccuucauaccccucacucccuggguaacaucgggccaccaguaaugcugguuccuagcucugcaacaccaugcacgguguaguagcuaagagcagagcuuucgggugugaaguaccugaguacaguuccugccuuccccugugugugccuggaacagaguaaacacucaggaagcguuacccacugcugccauucccagagaugcaaaaggugaggucuccguuuugccaucuauacaauagagauaauaaaggcuaucccacucuuaaugugugccaguuucuguccuaggcauuuuguagaugugugagcuuauuuagugcuuucuuauuauuauuuuuggagauggucucacuguguggcucaggcugcagugcagccucugccucccaggcuuaagcaauccucccaccucagccuuucaaguagcugagaccacaggcguguaccacccacccauggcuaauuuuuuauuuuuuauuuuuuauuguuuguuuguuuguuuugagacagaaucucacucugucacccaggcuggagugcaguggcaugaucuuggcgcacugcaaccucugccucccggguucaagugauucuccugccucagccucccgaguagcugggauuacaggugccugccaccacgucuggcuaauuuuuguauuuuuaguagagacgagguuucaccauguuggccaggcuggucucgagcuccuaaccucaggugauccaccugccucagccucccaaagugcugggauuacaggccugagccacugcgcccagccagccuguuguuuuuguuuuuguuuugagacaagagucucacucuaucgcucaggcuggagugcaguggcaugaucuuggcucacuguagccuccaccuuccagauucaagcaauucuccugccucagccucccgaguagcugggauuacagacauacaccacaacgcccggcuaauguugguuuguuuguuuguuugugacggaguuuugcucuuguugcccaggcuggagugcaguggcacaaucucagcucacugcaaccuccaucucccggguucaagcgauucuccugcuucagccuccccaguagcugggauuacaggugccugccaccaugccgggcuaauuuuuuauauuuuuaguagagaugggguuucacuguguuggccaggcuggucuugaacuccugaccucaggugauccaccccaccuuggccucccaaagugcugggauuacaggugagagccaccgugcuuagcccuuuuaaaaauguuuaaaaauuauuauuuaguccuuucaaugacccuaagguaggaacuguuaucuccauuuugcaggugagaacaccaaggcccagggaagauauaucacauuugaacccagauucagauuugaauccagguggccuggcugcugagugcaugguuugagucacucccugucccccagcuuccucuguuccaucacucuggguuauuuuccuccuugaaguuaucagggauugauacuauccuguguuucauuugcuuguuuagcaccugucugcucucaccuagaauguuagcucucuaagggcagggacuguauccugccacauuggcccacgucuggagagccuguggcacaugguggauacaccauggauuuguugaaugaaggcgcccccugcaagccaggcccucacccuggcuucuggcugugggcccagggguguccugggagcacaacccuagcugaauuccugccugcccuccccuccaggccgaguguacuacuucaaccacaucacuaacgccagccagugggagcggcccagcggcaacagcagcagugguggcaaaaacgggcagggggagccugccaggguccgcugcucgcaccugcuggugaagcacagccagucacggcggcccucguccuggcggcaggagaagaucacccggaccaaggaggaggcccuggagcugaucaacggugagcagggcgagggcaggggcuugggagggggucuucucccaggugagccuuuguagaagucacaucagacccuucaccccagcuugcucagcugccaggcgugguguuggccaacacaaaaacgccagugcaugaccugacccugaccuucacagcagccauucucuuucuuuuccaucuggcauuugagggugagccagguaggggcagaggacccagccugggggcuggcagacauggguucagguaguagcugugccucugugaacucugugaccuuugggaggggacucgugucaccuccccuagacucagcuuucucuguaaaaugggcauccucuaaggaccauugugaagguucaagggaauaaggcaauggauuuugcacaguaggcccucagucugugggaaguguugucaauaguaauaucauccacuaggggccugagucauaaacauagguggauccagagagagcagucaggaagguagugagugcaugcagggugcgguggcucacgccuguaaucccagcacuuugggaggccuuggagggcagaucaccugaggucaggaguucaagauuagccugggcaguauggugaaacuccaucucuacuaaaaauacaaagauuagccagauguguugacgcaugccuguaaucccagcuacucgggaggcugaggcagggaggcagagguugcagugagccgagaucgcaccacuccacuccagccugggcagcaaagugaggcaccaucucaaaaaaaaaaaaaaaaaagagguagugagugccaguagauagugaguuaauucugaccuaagggaggaagcuauucccugcucuguucuguguuuccucugcagucuggcaccaagguggcaaacuuuaaaggccagaugguaaauauuuuagguuuugugggccaugcagucucuaucagcucugcuuuguaacuggauagcacucauaacuaauauguaagcaagcacauggucauggcugugugccaagaaaacuuuacuauuuacaaaaucugggaggauuuggccugcaggccaucauuugcagagcccugucuaaagcuguccaguuuggcugccacucccacccugugcgggaggaucacuugagcccaggaguuugagaccagcuugggcaacauagcaaaaccccgucucuaaaaaaauaaaaaaauuagcuggacaugguggugcacgccuguagugucagcuacuuagaagacugaggugggaggauccuuugagcccaggaggcagagguuguaaugagccgagaucacacuaccgcacuccagccugggugacagagcaagacccugucucaaaaauaaauaagauaauaucaaaaauugguuucucaauugcacuggucauacuuuagcugguggcugccaucuuugacagcgggaauauaaaacauuuacauucuuggccgggcgcgguggcucacgucuguaauuccagcacuuugggaggccaagguggguggaucacgaagucaggagaucgagaccauccuggcuaacacggugaaacccugucuuuacugaaaauccaaaaaaauuagucuggcaugguggcgggcaccuguagucccagcuacucgggagauaggcaggagaauggcaugaacccgggagguggagcuugcagugagcugagaucgugccacugcacuccagccucggcaacagagcgagacuccgucucaaaaaaacaaaaacaaaaacaaaaaaaaacacuuuuccauucuugcaguaaguugugucugaugccuuucucagaguccccaaaccugggcugucccuacuccaaacaacccaucucucaaccaugcccagacagccuggguugcuaugcagcucugccacguccuggcuaugugcucuugagcaaguuacuuaacaucucugggcuucaaucuuuuucuccuucuucuuuugagacagggucuugcucugucacccaggcuggagugcaguguucauagcucacugcagccucaaccuccuugggaucaggugauccucccaccucagccucccaaguagcugggacugcaggcucauaacaccacaccuggcugauuuuuguauuuuuaguagagacaggacuucaccauguugccuaggauggucucaaacuccuggccucaagugauccuuccaccucagccucccgaaguguugggaugacaagcaugaaccaccgcccccagcugucagucuuuuucauuuauaaaauuaguauuagaauaauaagacccacuucacaggguaguugugaggacuccuggcuaauacaguaaagcgggaguaacagcuccuggcaucgguaaauguucugucauuguuaguggucacugucauugcuguuguugguugugguagcacagggcccagcacagaguguacacucggucaguauuggcuguuguuuuacucucucaucacuugguccaguuggccuguaggauguuauuacauaugcacacccccaacauggcaucuaggacaguaagugccacccguuagucuuauauguaagcauggcagagagaagccgaguucuugcacagaaucuugaaggcugauugaagagccagccuccugaccucugagggcagggacuggaucucucucuuuccccuguauucccauccugccacacaaagccuggcccagagucagcccucacagccuuguuucaugagccaguaggaagcaagaaggauuccuggcacaggacggggcagaaguaaaggccuaggacuaggauguagccagaacucuggggaaggcuuugcagggagcuagggggugaugagacccuucacgggcaggucccagccagguugaggaggguccuugucaggugaggagguuugguucuuuccuggaggcagcaggacauauguggccaugugggaccaggagaggaacccacagugcucugcuuucagcagagaucugugaagcuagaaugucaagggccagggaaguggaaggcccagaaccuucagggguucugguugccccagagcaagaagaagaaguggagggagaagccaggagagaauugcaagaugacccuucagguccucccagcucuaguggucucuguucugaggcuuccggacccuauaagagugagcaggagggugcaggcauuuggggauggagcggcaugaagugggcuccugggggucagcagagcagccaggcgcaggacagagcugcuccaagcaauccugaugagagcuggcagaaggcugaggucgguggggauagugaggagggcaugggucuggguguggugggcgagggugucucgcccaucucuggguuggacaggugcaccugguaaguagccaggcccugaggcgucaccguagguaccugcagauucuggaaugucagcaggagccuugccugcccaccugguggaagcugugggaggaauuggagcaagaggcggugugacuugaacuugggggcuggaaguggaagaagaagugagagggagcagacccgagagagauucaggaggcaggauagagaggacugggugauggauuaggugggcaagggugggaugucugggggagggucagggcagaacagcguggcccacccugggcucguacagggcuggauuucagugccagcuguguggucuucauuuccugagccucaguugccucaucuguagaauggggagaggguggcuaugaggauccaggagcuaugggcucaguggcuggcgugcucugcacgguggagccucagccccagucauugggguguggacgaugggggagcugaggucaagucaaggccucugcucacgggcagccccugcugccaccccacagcccguagaaagaguuccggauaggaccacaggaggccuggugggcucagcacacagaugaugaccuuggcacacgaccucccucuccugguauccuccugccugagacggugcuggggcagaucuccucagaggucgauaggaggaugcagugagguggccccggccgagguacacucgguaacagaucaucaugugcagugucggcgcaggcauugggcaccugggccucauuuucucuuccaugaaguggauguucuccccucgaggguucaugccgggugaucaggagaccaugauuugggcagcucacuccccagcuggcagccgggcuaaaucucaucagugcccauuuagaucuggugcuccgcccuugccccgaagggacaggcugccugcagagagagccgggaccuccacauuuucugcugaggcuccuuuucccagcauuggcuccucugcagcugcugggccacagccagaggcugucagagauccaagggagucauugccaguguccuugucuaaggaggaugggccauggagaagcccucccugcccgcucuccacccagaucuguugacagccaccccucacaugcccagggccuggagggucccagcaaggcugagacuaugagcagcuguccuacucacauacccaucccagcauccaggucagccccuuuguccugggguccucaaggucacuggcgcccuuccagccugcuggccuugggccagccucuagccccuccuucuggaucuuggucuucucagaucugacccugucaccucuuuccccgaccaggccccuuccccucuggugccugggcagccugggggaaguaugcuggaagcagcguaaugaucuggcaaggcagaggagacagcacgucuugaaacauuuuuggggucaaggacuaccccauuuguucccucacucccaccuaggucacugaugugcauuagcuuggacuguuguaacaaaauaucacagacaguguggcuuaaacaacagucaucacuuuccacaguucuggaggccagaaguccacaauccagguucccucagauucuguuccuggcgagaacccacuuccuggcuuguagacggcugcccucucacugugcacucacauggcauuccccaggcgcaugugcacggagugaaggagcacgagcucucuggugucucuuauaaggacacuaauccuggccaggcgcaguggcucaugccuguaaucccagcacuuugggagacugagguggguggaucaccugaggucaggaauucaagaccagccuggccaacaugguaaaacuccaucucuacuaaaaauacuaaaaaaaaagccagauguaguggcgcacaccugugaucccagcuacucaggaggcugaggcaggaggaucgcuggaaccugggaggcagaggucacagugagccgagauuguaccacugcacuccagccugggugacagagccagauucugccucaaaaaaaaaaggggcgcuaauccuguuggaucagggccccacccuuaugaccucauuuaacccuaguuacuuccccaaaguccccaucuccagaugcagccacacuggagguuagggcuuuaacacaugaauuuggggugacacaaacauugaguccauaacggaugggcagcuuggaucugucaggggccugcucugcaacagccacugcuuaagcggucacugauucacuccuuggaacaggcuccaacgugggagcagcgguuaccccauuuuacaggccaguugagugaggcuccaagagguaaagucaccugccagacucucauuguucaggagcagcagagguaggaucuggaccugauggagucuggagucagcacccauaacauguccuccuggaccuuggggauacacugugagcaggcuggcuggggucugccagcacagauaggugccauucuguuuugcauacuauuucaggggguccugaacaccuugaagcagguggaggccccugcuccagacugggagcuccuggagaggccacccugugucugugugguucuaagcuggagccacaucgaaucaggauggggcuccagcacccgacaguccccaucaaauuucacagguuuuggcgccgucgggcaaggcugacacauugucuuggaggaggcccaggaagucuggccuuagggucgcagccugaguuucaggcagauagggcaugagauuccagcauuucugcuucgagccccgugguagaucccugucucccuccuuccccauggccuauuucugucucauuuauucauuaacuucuugaacauucgugaacaccuguuuugugcacagugcuggguucugagggugcagcaaugaagaaggccaacccagcagccuccauuccugcacugugaggcgggcaagcaacacaccaaugggacgguaguaaaugcagcacccagggggaggcaccuaacacagugggggauuaggggaggcuucuuggggagaccagaggauagcugaugaguuucaggcaggacaagaggcuuaaaccaaggucugcgaggugggagucggaggaugucauugucgcggggucagguacaggcugagcuaacaagacacacaggaccaaaccccucaaggucagccucacagagcaggaacucaggaagaaagcguuuuuguuuguuuguuuguuuguuuguuuguuuguuugaaauggaguuucgcucuuguugcccacgcuggagugcaguggcaacgaucucagcucacuguaccuucuaccucccaguuucaagagaaagcguuuuuuuguuuguuuguuuguuuguuuguuuguuugaaauggaguuucgcucuuguugcccacgcuggagugcaguggcaacgaucucagcucacuguaccuuucuaccucccagguucaagagaaagcguuuuaaaaaaaaaaaucauuccagcuacuugcgaggcugaggcaagaggauugcugcagcccagggguuugaggccagccugaacaauaaagugcgaccccaucucugcaaaaggaaaacaaaaacagucauugcaggcucccaucauagcagaaaauuuuccaagagagcuggcaggucagaggcagaucugggugauaugagcuauuggugugccaaaguguggcuuuuauuuguuuuuaagugguauggcuugcacacuaugugugugagagaggacaacuugggcgggcuguccaauuucagggaucccuguggcuguguccccagcccuggccgcugggggcuguggcaaggugaugcuuguucagggccugggccuggcuccucagacgcucagugccugcaggcaguccugcuuccccgaaguagguggguaccucugggggcaccgugcgauccccuggcuggcuuagugguccagacagaaggggggacaggggacuccagugcucugugccuaaggccaaggagauaccuagaaguucagggagaggaggggugggaggggguccuagcaacaucugguuuaagucggagucacugguggaugugucuggcacagaggaggaccccguggcagcccuggaagcggggcauucugaucaaaccagggcaucacgggcagaagccucuguaaugugccaucccaacagaagcuggggcccuguauggcaucgaugucccugucagaccaggacacgugggccggcagggccaaggauagggagagcagagcaguagaggcugcgucaucccugggaugcaguccccauggaggggaagaaugaugacagcaagggacguuggucaggguccugcucggugccgggcacuaugcugcaugucacagccacuggcacaagacugucaggcggaggggcacagggaugucagggcagcaggucguggugacauccagcucagauaccaggacacugguggcugccaugacgugcagccaaacagggagcuauggcugugcucucacggugguaccauuuccacugcagucccaagcagguuagagcgugaggccgaggggcccuggggacacuuggaucaguccaguguguucagcaggugccacgguuggguguccaggccucccagcacuggcuaggucacccagcaguguucccgugggucuccaacaggcuccaggccaguguaucagcuauguauguccugggcaaguuggccggcaggugugucauggcaucauuuaggucagaaggagcaaggguagaagugucagggugacauuaagaaacccccuacugagugugucagggugaccuucacguuggagagaagaacuggugucccuggagaguggcugccaggccuuaggguacacggggcgggugcaguucacccagagggcugcccuggcuugcuggggcugucgcaccacuggccuagggaggacacuggaagggacgcccguuugugucagagcaagaggauugggguagggcaggcuuuggcccaugggcaccuuccuggggguggccuggagucaggaaggcgguagccauuccuccugaccuggcacgugcacaagacugcauacacacacuugcucacacacagucacaccacacacaccacgugcacacacacgcagcccuccccacuuggcuuccgaaacgugagucacucagaugcuacucugcugccgucuugcccccucugcuggcagcccuguuccuccuaacuccaccagcccuggccuccuccgccuccuggagagucagagccgaugggcuaguuugggccacacaggguggggccacccugaguucugccagcaugcagacuguagguggggagccgggagaagagcuauguugccugccucugggacccuggggcuacagcccacgagugucccuugcagagcccaccagggugccuuggaggcccaucccagugccaggcuguucuucccagaugggacagcuggggccacaggcugccguggcagugcugggcuuucucuggacagcucucccaccucugcccagggggcccggggggccagcccccugccugggucagccucucccugccugcugcucuccucuggcccauccagcuuguauguagauuuucccucacgugugugugugugugugcaugugugugugcuggugagagugacagcgggagcagggaugugagaccugcaggguggcagggcucauggaugacuggcggggugcauuaagugcucaugcucgugaaaggcaccucuucuugggugugggugaggacaggugugacugcgcaugcagguaugugugaggagagggguuguggggagcaugugcgccugugaggggaggcuuuccaacugaagugcugccucccccgcuggccagcucuggaguccuccauccugucuggucaggccccccccaaccccugaccuggcacucccauuccguuccauguccacaggcuacauccagaagaucaagucgggagaggaggacuuugagucucuggccucacaguucagcgacugcagcucagccaaggccaggggagaccugggugccuucagcagaggugcgcaaggaaugggccucaccagguugggggacccuuaccacccugagggguagaggccaggagggucugggcauugggcucccaggugccacaccggccuucgggguccagcagguggcagcacagccccuuccucaggcuucagaggcugcucugcugggcagggccagggccacacagggaggggggcugcagcacuuucuuccuggcaucaucucuacccuggggggcauggucucuugugugucugugcacagauguccucaucccaggcccaccaagguggguacauccuguccucugccucuuccuuuuugugguuuaagguugagggcccugagagucccagggccugucccccagaaucccucucaaagguggggaaaccaggggugagaggagguggcccugaguuuaggccugucuggccaggacaguggaaaucagggacagaggggacuaggccuccuccucuuccuccucuucaguccucggggucuacagaaaaacaucagggagaggccaggauggguugcaggguguggugugcaggugucuuagugggguggggcggcagcauggggccagcagcugcccaccuccuccgaggaggcuggugggacagaugacauggcagggcugggaaccaggcccagggagacgaguucacuaccgaaguggccccuaaaugcacggcggcggccguagcccugccugcuauccuucaugcuguccucgggcuucccagggccuccuuaauggcccugccacccccagcugggccgccgcucagcacuggcaauaaacauggugacggaugaguguggacgagugugaggcucagcgcaggcaggagccccaucugucgcggcugccacccgcccugccucauccuggccucugccagcccagcccugacacccccaccgccccuccuggcucccaggucagaugcagaagccauuugaagacgccucguuugcgcugcggacgggggagaugagcgggcccguguucacggauuccggcauccacaucauccuccgcacugagugaggguggggagcccaggccuggccucggggcagggcagggcggcuaggccggccagcucccccuugcccgccagccaguggccgaaccccccacucccugccaccgucacacaguauuuauuguucccacaauggcugggagggggcccuuccagauugggggcccugggguccccacucccuguccauccccaguuggggcugcgaccgccagauucucccuuaaggaauugacuucagcaggggugggaggcucccagacccagggcaguguggugggagggguguuccaaagagaaggccuggucagcagagccgccccguguccccccaggugcuggaggcagacucgagggccgaauuguuucuaguuaggccacgcuccucuguucagucgcaaaggugaacacucaugcggcccagccaugggcccucugagcaacugugcagcacccuuucacccccaauuaaacccagaaccacugcucugc

SEQ ID NO: 192017 - RNA, 14483 nt, Homo sapiens
gcagagcagugguucuggguuuaauugggggugaaagggugcugcacaguugcucagagggcccauggcugggccgcaugaguguucaccuuugcgacugaacagaggagcguggccuaacuagaaacaauucggcccucgagucugccuccagcaccuggggggacacggggcggcucugcugaccaggccuucucuuuggaacaccccucccaccacacugcccugggucugggagccucccaccccugcugaagucaauuccuuaagggagaaucuggcggucgcagccccaacuggggauggacagggaguggggaccccagggcccccaaucuggaagggcccccucccagccauugugggaacaauaaauacugugugacgguggcagggagugggggguucggccacuggcuggcgggcaagggggagcuggccggccuagccgcccugcccugccccgaggccaggccugggcuccccacccucacucagugcggaggaugauguggaugccggaauccgugaacacgggcccgcucaucucccccguccgcagcgcaaacgaggcgucuucaaauggcuucugcaucugaccugggagccaggaggggcggugggggugucagggcugggcuggcagaggccaggaugaggcagggcggguggcagccgcgacagauggggcuccugccugcgcugagccucacacucguccacacucauccgucaccauguuuauugccagugcugagcggcggcccagcuggggguggcagggccauuaaggaggcccugggaagcccgaggacagcaugaaggauagcaggcagggcuacggccgccgccgugcauuuaggggccacuucgguagugaacucgucucccugggccugguucccagcccugccaugucaucugucccaccagccuccucggaggaggugggcagcugcuggccccaugcugccgccccaccccacuaagacaccugcacaccacacccugcaacccauccuggccucucccugauguuuuucuguagaccccgaggacugaagaggaggaagaggaggaggccuaguccccucugucccugauuuccacuguccuggccagacaggccuaaacucagggccaccuccucucaccccugguuuccccaccuuugagagggauucugggggacaggcccugggacucucagggcccucaaccuuaaaccacaaaaaggaagaggcagaggacaggauguacccaccuuggugggccugggaugaggacaucugugcacagacacacaagagaccaugccccccaggguagagaugaugccaggaagaaagugcugcagccccccucccuguguggcccuggcccugcccagcagagcagccucugaagccugaggaaggggcugugcugccaccugcuggaccccgaaggccgguguggcaccugggagcccaaugcccagacccuccuggccucuaccccucagggugguaagggucccccaaccuggugaggcccauuccuugcgcaccucugcugaaggcacccaggucuccccuggccuuggcugagcugcagucgcugaacugugaggccagagacucaaaguccuccucucccgacuugaucuucuggauguagccuguggacauggaacggaaugggagugccaggucagggguuggggggggccugaccagacaggauggaggacuccagagcuggccagcgggggaggcagcacuucaguuggaaagccuccccucacaggcgcacaugcuccccacaaccccucuccucacacauaccugcaugcgcagucacaccuguccucacccacacccaagaagaggugccuuucacgagcaugagcacuuaaugcaccccgccagucauccaugagcccugccacccugcaggucucacaucccugcucccgcugucacucucaccagcacacacacaugcacacacacacacacacgugagggaaaaucuacauacaagcuggaugggccagaggagagcagcaggcagggagaggcugacccaggcagggggcuggccccccgggcccccugggcagaggugggagagcuguccagagaaagcccagcacugccacggcagccuguggccccagcugucccaucugggaagaacagccuggcacugggaugggccuccaaggcacccuggugggcucugcaagggacacucgugggcuguagccccagggucccagaggcaggcaacauagcucuucucccggcuccccaccuacagucugcaugcuggcagaacucaggguggccccacccuguguggcccaaacuagcccaucggcucugacucuccaggaggcggaggaggccagggcugguggaguuaggaggaacagggcugccagcagagggggcaagacggcagcagaguagcaucugagugacucacguuucggaagccaaguggggagggcugcgugugugugcacgugguguguguggugugacugugugugagcaaguguguguaugcagucuugugcacgugccaggucaggaggaauggcuaccgccuuccugacuccaggccacccccaggaaggugcccaugggccaaagccugcccuaccccaauccucuugcucugacacaaacgggcgucccuuccaguguccucccuaggccaguggugcgacagccccagcaagccagggcagcccucugggugaacugcacccgccccguguacccuaaggccuggcagccacucuccagggacaccaguucuucucuccaacgugaaggucacccugacacacucaguaggggguuucuuaaugucacccugacacuucuacccuugcuccuucugaccuaaaugaugccaugacacaccugccggccaacuugcccaggacauacauagcugauacacuggccuggagccuguuggagacccacgggaacacugcugggugaccuagccagugcugggaggccuggacacccaaccguggcaccugcugaacacacuggacugauccaaguguccccagggccccucggccucacgcucuaaccugcuugggacugcaguggaaaugguaccaccgugagagcacagccauagcucccuguuuggcugcacgucauggcagccaccaguguccugguaucugagcuggaugucaccacgaccugcugcccugacaucccugugccccuccgccugacagucuugugccaguggcugugacaugcagcauagugcccggcaccgagcaggacccugaccaacgucccuugcugucaucauucuuccccuccauggggacugcaucccagggaugacgcagccucuacugcucugcucucccuauccuuggcccugccggcccacguguccuggucugacagggacaucgaugccauacagggccccagcuucuguugggauggcacauuacagaggcuucugcccgugaugcccugguuugaucagaaugccccgcuuccagggcugccacgggguccuccucugugccagacacauccaccagugacuccgacuuaaaccagauguugcuaggacccccucccaccccuccucucccugaacuucuagguaucuccuuggccuuaggcacagagcacuggaguccccuguccccccuucugucuggaccacuaagccagccaggggaucgcacggugcccccagagguacccaccuacuucggggaagcaggacugccugcaggcacugagcgucugaggagccaggcccaggcccugaacaagcaucaccuugccacagcccccagcggccagggcuggggacacagccacagggaucccugaaauuggacagcccgcccaaguuguccucucucacacacauagugugcaagccauaccacuuaaaaacaaauaaaagccacacuuuggcacaccaauagcucauaucacccagaucugccucugaccugccagcucucuuggaaaauuuucugcuaugaugggagccugcaaugacuguuuuuguuuuccuuuugcagagauggggucgcacuuuauuguucaggcuggccucaaaccccugggcugcagcaauccucuugccucagccucgcaaguagcuggaaugauuuuuuuuuuuaaaacgcuuucucuugaaccugggagguagaaagguacagugagcugagaucguugccacugcacuccagcgugggcaacaagagcgaaacuccauuucaaacaaacaaacaaacaaacaaacaaacaaaaaaacgcuuucucuugaaacugggagguagaagguacagugagcugagaucguugccacugcacuccagcgugggcaacaagagcgaaacuccauuucaaacaaacaaacaaacaaacaaacaaacaaacaaaaacgcuuucuuccugaguuccugcucugugaggcugaccuugagggguuugguccugugugucuuguuagcucagccuguaccugaccccgcgacaaugacauccuccgacucccaccucgcagaccuugguuuaagccucuuguccugccugaaacucaucagcuauccucuggucuccccaagaagccuccccuaaucccccacuguguuaggugccucccccugggugcugcauuuacuaccgucccauugguguguugcuugcccgccucacagugcaggaauggaggcugcuggguuggccuucuucauugcugcacccucagaacccagcacugugcacaaaacagguguucacgaauguucaagaaguuaaugaauaaaugagacagaaauaggccauggggaaggagggagacagggaucuaccacggggcucgaagcagaaaugcuggaaucucaugcccuaucugccugaaacucaggcugcgacccuaaggccagacuuccugggccuccuccaagacaaugugucagccuugcccgacggcgccaaaaccugugaaauuugauggggacugucgggugcuggagccccauccugauucgauguggcuccagcuuagaaccacacagacacaggguggccucuccaggagcucccagucuggagcaggggccuccaccugcuucaagguguucaggacccccugaaauaguaugcaaaacagaauggcaccuaucugugcuggcagaccccagccagccugcucacaguguauccccaagguccaggaggacauguuaugggugcugacuccagacuccaucagguccagauccuaccucugcugcuccugaacaaugagagucuggcaggugacuuuaccucuuggagccucacucaacuggccuguaaaaugggguaaccgcugcucccacguuggagccuguuccaaggagugaaucagugaccgcuuaagcaguggcuguugcagagcaggccccugacagauccaagcugcccauccguuauggacucaauguuugugucaccccaaauucauguguuaaagcccuaaccuccaguguggcugcaucuggagauggggacuuuggggaaguaacuaggguuaaaugaggucauaaggguggggcccugauccaacaggauuagcgccccuuuuuuuuuugaggcagaaucuggcucugucacccaggcuggagugcagugguacaaucucggcucacugugaccucugccucccagguuccagcgauccuccugccucagccuccugaguagcugggaucacaggugugcgccacuacaucuggcuuuuuuuuuaguauuuuuaguagagauggaguuuuaccauguuggccaggcuggucuugaauuccugaccucaggugauccacccaccucagucucccaaagugcugggauuacaggcaugagccacugcgccuggccaggauuaguguccuuauaagagacaccagagagcucgugcuccuucacuccgugcacaugcgccuggggaaugccaugugagugcacagugagagggcagccgucuacaagccaggaaguggguucucgccaggaacagaaucugagggaaccuggauuguggacuucuggccuccagaacuguggaaagugaugacuguuguuuaagccacacugucugugauauuuuguuacaacaguccaagcuaaugcacaucagugaccuaggugggagugagggaacaaaugggguaguccuugaccccaaaaauguuucaagacgugcugucuccucugccuugccagaucauuacgcugcuuccagcauacuucccccaggcugcccaggcaccagaggggaaggggccuggucggggaaagaggugacagggucagaucugagaagaccaagauccagaaggaggggcuagaggcuggcccaaggccagcaggcuggaagggcgccagugaccuugaggaccccaggacaaaggggcugaccuggaugcugggauggguaugugaguaggacagcugcucauagucucagccuugcugggacccuccaggcccugggcaugugagggguggcugucaacagaucuggguggagagcgggcagggagggcuucuccauggcccauccuccuuagacaaggacacuggcaaugacucccuuggaucucugacagccucuggcuguggcccagcagcugcagaggagccaaugcugggaaaaggagccucagcagaaaauguggaggucccggcucucucugcaggcagccugucccuucggggcaagggcggagcaccagaucuaaaugggcacugaugagauuuagcccggcugccagcuggggagugagcugcccaaaucauggucuccugaucacccggcaugaacccucgaggggagaacauccacuucauggaagagaaaaugaggcccaggugcccaaugccugcgccgacacugcacaugaugaucuguuaccgaguguaccucggccggggccaccucacugcauccuccuaucgaccucugaggagaucugccccagcaccgucucaggcaggaggauaccaggagagggaggucgugugccaaggucaucaucugugugcugagcccaccaggccuccugugguccuauccggaacucuuucuacgggcugugggguggcagcaggggcugcccgugagcagaggccuugacuugaccucagcucccccaucguccacaccccaaugacuggggcugaggcuccaccgugcagagcacgccagccacugagcccauagcuccuggauccucauagccacccucuccccauucuacagaugaggcaacugaggcucaggaaaugaagaccacacagcuggcacugaaauccagcccuguacgagcccagggugggccacgcuguucugcccugacccucccccagacaucccacccuugcccaccuaauccaucacccaguccucucuauccugccuccugaaucucucucgggucugcucccucucacuucuucuuccacuuccagcccccaaguucaagucacaccgccucuugcuccaauuccucccacagcuuccaccaggugggcaggcaaggcuccugcugacauuccagaaucugcagguaccuacggugacgccucagggccuggcuacuuaccaggugcaccuguccaacccagagaugggcgagacacccucgcccaccacacccagacccaugcccuccucacuauccccaccgaccucagccuucugccagcucucaucaggauugcuuggagcagcucuguccugcgccuggcugcucugcugacccccaggagcccacuucaugccgcuccauccccaaaugccugcacccuccugcucacucuuauaggguccggaagccucagaacagagaccacuagagcugggaggaccugaagggucaucuugcaauucucuccuggcuucucccuccacuucuucuucuugcucuggggcaaccagaaccccugaagguucugggccuuccacuucccuggcccuugacauucuagcuucacagaucucugcugaaagcagagcacuguggguuccucuccuggucccacauggccacauauguccugcugccuccaggaaagaaccaaaccuccucaccugacaaggacccuccucaaccuggcugggaccugcccgugaagggucucaucacccccuagcucccugcaaagccuuccccagaguucuggcuacauccuaguccuaggccuuuacuucugccccguccugugccaggaauccuucuugcuuccuacuggcucaugaaacaaggcugugagggcugacucugggccaggcuuuguguggcaggaugggaauacaggggaaagagagagauccagucccugcccucagaggucaggaggcuggcucuucaaucagccuucaagauucugugcaagaacucggcuucucucugccaugcuuacauauaagacuaacggguggcacuuacuguccuagaugccauguugggggugugcauauguaauaacauccuacaggccaacuggaccaagugaugagagaguaaaacaacagccaauacugaccgaguguacacucugugcugggcccugugcuaccacaaccaacaacagcaaugacagugaccacuaacaaugacagaacauuuaccgaugccaggagcuguuacucccgcuuuacuguauuagccaggaguccucacaacuacccugugaagugggucuuauuauucuaauacuaauuuuauaaaugaaaaagacugacagcugggggcggugguucaugcuugucaucccaacacuucgggaggcugagguggaaggaucacuugaggccaggaguuugagaccauccuaggcaacauggugaaguccugucucuacuaaaaauacaaaaaucagccaggugugguguuaugagccugcagucccagcuacuugggaggcugaggugggaggaucaccugaucccaaggagguugaggcugcagugagcuaugaacacugcacuccagccugggugacagagcaagacccugucucaaaagaagaaggagaaaaagauugaagcccagagauguuaaguaacuugcucaagagcacauagccaggacguggcagagcugcauagcaacccaggcugucugggcaugguugagagauggguuguuuggaguagggacagcccagguuuggggacucugagaaaggcaucagacacaacuuacugcaagaauggaaaaguguuuuuuuuuguuuuuguuuuuguuuuuuugagacggagucucgcucuguugccgaggcuggagugcaguggcacgaucucagcucacugcaagcuccaccucccggguucaugccauucuccugccuaucucccgaguagcugggacuacaggugcccgccaccaugccagacuaauuuuuuuggauuuucaguaaagacaggguuucaccguguuagccaggauggucucgaucuccugacuucgugauccacccaccuuggccucccaaagugcuggaauuacagacgugagccaccgcgcccggccaagaauguaaauguuuuauauucccgcugucaaagauggcagccaccagcuaaaguaugaccagugcaauugagaaaccaauuuuugauauuaucuuauuuauuuuugagacagggucuugcucugucacccaggcuggagugcgguagugugaucucggcucauuacaaccucugccuccugggcucaaaggauccucccaccucagucuucuaaguagcugacacuacaggcgugcaccaccauguccagcuaauuuuuuuauuuuuuuagagacgggguuuugcuauguugcccaagcuggucucaaacuccugggcucaagugauccucccgcacagggugggaguggcagccaaacuggacagcuuuagacagggcucugcaaaugauggccugcaggccaaauccucccagauuuuguaaauaguaaaguuuucuuggcacacagccaugaccaugugcuugcuuacauauuaguuaugagugcuauccaguuacaaagcagagcugauagagacugcauggcccacaaaaccuaaaauauuuaccaucuggccuuuaaaguuugccaccuuggugccagacugcagaggaaacacagaacagagcagggaauagcuuccucccuuaggucagaauuaacucacuaucuacuggcacucacuaccucuuuuuuuuuuuuuuuuuugagauggugccucacuuugcugcccaggcuggaguggaguggugcgaucucggcucacugcaaccucugccucccugccucagccucccgaguagcugggauuacaggcaugcgucaacacaucuggcuaaucuuuguauuuuuaguagagauggaguuucaccauacugcccaggcuaaucuugaacuccugaccucaggugaucugcccuccaaggccucccaaagugcugggauuacaggcgugagccaccgcacccugcaugcacucacuaccuuccugacugcucucucuggauccaccuauguuuaugacucaggccccuaguggaugauauuacuauugacaacacuucccacagacugagggccuacugugcaaaauccauugccuuauucccuugaaccuucacaaugguccuuagaggaugcccauuuuacagagaaagcugagucuaggggaggugacacgaguccccucccaaaggucacagaguucacagaggcacagcuacuaccugaacccaugucugccagcccccaggcuggguccucugccccuaccuggcucacccucaaaugccagauggaaaagaaagagaauggcugcugugaaggucagggucaggucaugcacuggcguuuuuguguuggccaacaccacgccuggcagcugagcaagcuggggugaagggucugaugugacuucuacaaaggcucaccugggagaagacccccucccaagccccugcccucgcccugcucaccguugaucagcuccagggccuccuccuugguccgggugaucuucuccugccgccaggacgagggccgccgugacuggcugugcuucaccagcaggugcgagcagcggacccuggcaggcucccccugcccguuuuugccaccacugcugcuguugccgcugggccgcucccacuggcuggcguuagugaugugguugaaguaguacacucggccuggaggggagggcaggcaggaauucagcuaggguugugcucccaggacaccccugggcccacagccagaagccagggugagggccuggcuugcagggggcgccuucauucaacaaauccaugguguauccaccaugugccacaggcucuccagacgugggccaauguggcaggauacagucccugcccuuagagagcuaacauucuaggugagagcagacaggugcuaaacaagcaaaugaaacacaggauaguaucaaucccugauaacuucaaggaggaaaauaacccagagugauggaacagaggaagcugggggacagggagugacucaaaccaugcacucagcagccaggccaccuggauucaaaucugaaucuggguucaaaugugauauaucuucccugggccuugguguucucaccugcaaaauggagauaacaguuccuaccuuagggucauugaaaggacuaaauaauaauuuuuaaacauuuuuaaaagggcuaagcacgguggcucucaccuguaaucccagcacuuugggaggccaaggugggguggaucaccugaggucaggaguucaagaccagccuggccaacacagugaaaccccaucucuacuaaaaauauaaaaaauuagcccggcaugguggcaggcaccuguaaucccagcuacuggggaggcugaagcaggagaaucgcuugaacccgggagauggagguugcagugagcugagauugugccacugcacuccagccugggcaacaagagcaaaacuccgucacaaacaaacaaacaaaccaacauuagccgggcguugugguguaugucuguaaucccagcuacucgggaggcugaggcaggagaauugcuugaaucuggaagguggaggcuacagugagccaagaucaugccacugcacuccagccugagcgauagagugagacucuugucucaaaacaaaaacaaaaacaacaggcuggcugggcgcaguggcucaggccuguaaucccagcacuuugggaggcugaggcagguggaucaccugagguuaggagcucgagaccagccuggccaacauggugaaaccucgucucuacuaaaaauacaaaaauuagccagacgugguggcaggcaccuguaaucccagcuacucgggaggcugaggcaggagaaucacuugaacccgggaggcagagguugcagugcgccaagaucaugccacugcacuccagccugggugacagagugagauucugucucaaaacaaacaaacaaacaauaaaaaauaaaaaauaaaaaauuagccaugggugggugguacacgccuguggucucagcuacuugaaaggcugaggugggaggauugcuuaagccugggaggcagaggcugcacugcagccugagccacacagugagaccaucuccaaaaauaauaauaagaaagcacuaaauaagcucacacaucuacaaaaugccuaggacagaaacuggcacacauuaagagugggauagccuuuauuaucucuauuguauagauggcaaaacggagaccucaccuuuugcaucucugggaauggcagcaguggguaacgcuuccugaguguuuacucuguuccaggcacacacaggggaaggcaggaacuguacucagguacuucacacccgaaagcucugcucuuagcuacuacaccgugcaugguguugcagagcuaggaaccagcauuacugguggcccgauguuacccagggagugagggguaugaaggagugaagacugugaacaagaaacuggaaguaaagacccuacugggugccacuccaaaggcugacaguucgccugggugacauggagugucacccauaaaggaagccaucaggguugaacugagcagaaacagcagaaaugggcccagagcugggcagagcauccgguuuaugcuggaggucccagccacaggccagggcuagagcagggugggcgagagcgcggguuccaggugcaaaugcagcugagcuacugacucacucuaaaaccuuggcaaugggcucuaaucucccugcaccucaguuuucucaucugaaaaauggggaauagagaauaaggagaucaaaccucaugggguuaaugaggagaguccauguauccaaacaguucaccagaaccuggcacucaaccaaggagaauuauuauugcaaaugcgauugcuaugggcucuagaggcagcagagugacucgggaccugcccacagaugcugggccugcuccucaggaguuugcagugacacggggagggggauuuguaggcaaacugccuagguccuaauccaacccccggccccugaaaugaaugaucuuggacgaguuccuucaguuuucugaccucaguuuccuugcugguaagguggaaguaauaacuaccuggcucccagaguugcggcaauucagagagaacuuaaagcgcuugacacagagaaaaacaugcccuguuacuggcaauauuaucauuguggcuaacccuuaaaucgggccuaagcacaggggccaucgucuggcagaaugucacgggcgaugucgcagacucagcauuagguguacacaguagggguguuagcagggguagguuguggacccgaggccgggcaacacccuacgcccuuugcaggguacuggggugucucccucccaggggugcccccgggcccagcaaggugcagagacgucccccggggugucaggugcauuaggccgagagguaucagccgggccggcagggccagggccaucgccccggacuccccggacccucacccgcccagcccccugccucagcuuccucaggcuucccggcggcuccugaggcucgcaguccccacaacagggcgggccggggccguuaccccggggacgacgcggaagagccaggaccccaugggagggaggcagcgcugccgccgcgcccaaggggcgagcucgagcccugcuuacgcgggcccgcgcagucccgccccagccccgacccccgcggcaccugagcugcggcucaugcgcuucucccagccgggcggcagcuucuccucguccgccaucuucccuccugccgcagcgccugcuccgccucagcugcgccgccugucgcccgcgcccgcccgccgccgcugccuauuggcuagacgcgcucugcaacggggccuggcggcgacgcccauugggcucccuaacggucc

SEQ ID NO: 192018 - RNA, 82677 nt, Homo sapiens
ggucgggacgccgggcuaggggcgcgucauguggccgcucacggucccgccgccgcugcugcugcugcugugcucaggccuggccggacagguaggggcccggcgggcaggugcgggcgcggguggcuccgggagaggaggggggcgcggaggguucccggagaaacgggguugggaggcuccacaagcccccccagcugcagggcggcgaggggcgggggucgcagcgggggaggggccgggacgugcacucucuggcuugggagaggacgaggggggcuucaaauccagccucaagcugggcugguuugggggguggcgucuuugggguucucaaccccuccauggccccgagcccccaccccgccaucucgcuggagcugaaugggguugggagggaaacuucagggggcauuggaggggggcgguugcuuacccuugacuuccucuucggggccgagaugcccaguuucugaagcccuccacuccucgccugcagcccccaguguggggcaggggacgggacucacgugagagugacugacggggacgcgugugaaaugcugugggggugcaggguaaacgugugugucuuugugucgugguugggugugaccggggggaguuuguguguguggcgguuggggggcuuguccaacuagugcccgaguuggggugugaucaguacgugagacagagucugugugugaccguguccucauuacuggcuccagaugacuggguguuguacaauacguguguggccagguguguggccgugugagagccuuggagugagcgugugcuauucuguaccuuuggguaaaucacucuaaaagggugugugugugugcaagcgcugugugugcaaacguguccauccaugcacguguguguguguaucuuggugccuugcucacaaccgcacacgccauucauacccuuacagaagcgggucucccuccccauggcaccuuucucuugggcaggcucagggaggcuugcaaaauguggggcguccacgcucucuuuugcuauuggaaagccccucuccuccuccaucuugggagugagagcacccccaaguucucagaucuguaggaguucacagggaagcugggaucaaaaauaauaaaauagucauuaugauaacagugaucauucauuacgugcuaauuugagaggugcuguuucaaucacacagcacagacuaaggcauuuaacccccucugccuccucccuacuagagcaugguauuguuaccucauuuuauggauggggaaacugaggcgcagaaaaguuaaaucacuugcucaagcucgagagugacagaggugggacugaaccgaggcaguccggcuccugagcccacacgauuacccucuuguuaaauaauccgcuccauggguguggacagcguccgugaagacauugcuaggugggcuuuuagguagauaggcaggggagaaacaauuugggcaccuuccccuuaucaagaaaagaaucagacccuugugcucaccccgagggggguguugggaggaauggagguuagacuccagauagaaggauuuccaggccacgaggagagauugugggguccccucccucgcuccuccauuuccccacgcaucucagcacccacgcgcugggugggauagggagugugcccagccccaggcaugaggacacacacaauagguacucaauggaugugugagccugagagaagccaagagacacaccugggagacgagagaccaaaagaggcacacacuugagaaaccaguggaaaaaaaaugagccaggaaucaaguugaauuauccuugaccuagcagaggagacagagaaccacccccuguggcuucuccuccacucccugcuaggggggcacuagauuuucuggcuucucaccaagauuggcuaggaugccagaguuugcugccagaauugcaauuggagggugacuccuacagcccccagggcugggagggaguugcuuugggggcgggacuaacgaggucaguggaggcggggcuaaaggacaacgggggcguggccaaaugagguaauccguuagggcggggcugguggaauccugccgcgggcugcagugccuccaggcggccaccgcgggaacuacaugguugugaaacagucucggcgccccauacacccccuuggcguuggcccaccaagccuggcaccccagggaagggaggggucugcagagaggaugcucuacccacucuucgcucccuccaucacuuuccaaagacuucuucccugucccugaugggcccagggguccuuccuagaaaucauugguuaauccauucaaugaacagauaugauuaugcacuggggauacagccaccaacugagucaucaaaucccugcucuccuggaguugaccuagcagaggagacagaaaagagccgaauaaccauguaauacggugucggcaacuaaauauacauauaauacaaugcaaguagcaugaagaauaacagauaaaguauagaagauuagacuggagccgggugcuguggcucacgccuguaaucccagcauuuugggaaguugaggcaaguggaucgccugaggucaggaguucgagaccagccuggccaacauagugaaacccugucucuacuaaaaauacaaaaaauuagcugggugugguggcaggcgccuguaaucccagcuacuagggaggcugaggcaggagaauugcuugaaccugggaggcagagguugcggugagcugcgaucgccauugcacuccagccuggacaacaagagugaaacucugucucaaaaaaaaaaaaaaaaaaaaaagauuagagugauagcagucgggcauggaggcucacgccuguaaucccagcacuuugggaggccagggugaguggaucacuugaggucaggaguuugagaccagcccggccaacauggugaaaccccgucucuacuaaaaaugcaaaaaauuagccaggugugguguugcacaccuguagucccagcuauucaggaggcugaggcaggcgaauugcuugaaccugggaggcagagguuccagugagccaaggucaugccacugcacuccagccuaggcaacagaacaagacugucucaaagcaaaaaaacagaaaaagauuacaaggugggggcuauuugagccaguguggucagggaaggugucucuaaggaaguaguguuucaggugacaucugaaggaggugagagagggagccuugugggugucugggggaagagcauugaaggugggaggaacagaaggugcaaaggcccugggguaagaacaagcuuggugaguuucagaagcaguguggacgcugguguggcuggagaggucgcggggagaugaggccggggaagccagaccacuuaggaacuuguaagcugugggcagaaguuuggauuugacccagagagcaggagaacaggaaagcagggccugucagaggcauuguccauucauccaggaucuauccaagauguucuggguucuggccugggagugacuaccagagagcuugacaguucugagccccacuauuuuccuuguggaaaagaugccuuccugaucccugcgaaggccucccuaagaucuagcuacaucguuggcacuaucuggguuugggaccaacucuuuccuggggcuuucagaggauggggagaaggaauaauucaguuuagaucacgugccucagggacuucacacuugcuguucccucugccugugacacuguucccccugguagcuauuuaucucugauuucugcuuaaaugucaccuccuccaagaggcucacccugaacagcuaagugaaauagcccccugcugccacucucugagugcuuacuccguguucuuuuucuuucucucucuuucuuucuuuuuuuuuuuuuuuuugagacugagucucacucuguugccugggcuggagugcaguggcgcaaucucggcucacugcaagcuuugccucaccgguucaagugauucucgugccucagccucccgaguagcugggacuacaggcacgugccaccugaugcccagcuaguuuuuguuguauuuuuaguagagacaggguuucaccauguuggccaggcuggucuugaacuccugaccucaggugaucugccgcccaaagugcugggauuauaggcaugagccaccacgcccggccauauuuuucuuuauagcccucguuuccacauuucuaugauucuucuauucauucauucucuguuuccccacuagagcggcaguuuaucaggguucagcuagcuuuguuguuucuccagugucuagagcagagccugacacacaguaggugcucaagaaauaucugcugaauggaugaauggauggauggauggacccccucacacacacagagugucuuucuuucucaaaccacaggauucuuuuaucaagagagugucaggggaacacucgcuccuggauggaaggcaccaagaaaauccauucuucaggccaggugugauggcugauaccuaugaucccagcauuuugggagaccaaagccagagggucucuugaggccaggaauuugagaccagccugggcaauacagcaagaucccaucucuacaauaacuuuuucuuuuuauuucuuuuuuuuuuuuuauuuuugagauggagucuuguucugucacccaugcuggaguacaguacaguauugugaugaucucagcucacugcaaccucugccucccgggcucaagagauucuagugccucagccucccgaguagcugggacuacaggggcgugccaccacacccagcuaauuuuuguauuuuuaguagagaugggguuucaccauuuuggccaggcuggucucgaacuccugacaucuugauuugucugccucggccuccuaaacugcugggauuacaggcgugagccaccgugcccggccucugcaguaacuuuaaaaaaaauuggccaggcuuguaguucuacucaggaggcugaggugugaagaucacuugagcccaggaguuugaggcugcagugagcuaucauugcacuacugcacuccagcuugggcgacagacugagacccugucuccacaaaaaagaaagaaagaaaacccaucuucuuuaccugugccugacauuccaccgauagggcacuguuguuuagggguaagacgauguucuccuggggcuccuuuagagcauguaaaugucccaguggagggaaguaaaaggaaauuuaaagacuccgaguuaguguaggaaagagccccuuggggcuggauuuaagauuauggagcuugagcgacaucuaguggucgagugagguuugugcagggacugugugcgucugugugacuggugggugaaugugugugguugugcaccugugcgugggcgcgugcguaugugggaugggggugcccaggucaggguaaaacaggugagauacucgccgcgggugcaaacauuuuaaaaaguugaugaugaugaugaugaugauauuugaaacagagucuugcugugucguccacacuggagugcaguggugcgauuucggcucacugcaaucucugccucccggguucaagcgauucuccugcucagccucucgaguagcugggauuauaggcgcacagcaccacagccggcuaaauuuuuuuuuuuuuguauuuuuaauagagacaggguuucaccacguugcccacucuggucucgaacuccagaccucagaugaucugcccgccuuggccucccaaagugcugggauuacaggcgugagccacggugccgggccuauuucuaagacggggucuuguucugucacccaugcuggagugcaguggugcagucauagcucacugaagccuccaacuccugggcucaagugauucuucugccucagccuccugaguagcuagggugacagguacaugguacagaguucagcuauaguacaaaauuuaaggguaugccccccaaaaaaauaaaaaccaguaaccaagauaaauaauauuuuaauggaacauuuuaagaaaaaucuaaauugaugcaagaaaaaucuauaaugaauaaaaacaaauuuuuaaauaaauaugggcucccccucugcacuugcauaacuugccucacucuaacuuuggccccauaggcaugugucuguggugucaugcguguauguguauguuuggugacugugugcauguucagggaccaugagcacagggacaugcuuguaucaucaucacaccagugacuguauccauguaggccaaccauaugguauguguggauuucuuucuuucuuucuuuuuuuuuuugagauggaguuucgcucuuguugcccaggcuggaggucaguggcgcgaucucggcucaccgcaaccucugccuccuggguucaagugauucuccugccucaaccucccgaguagcugggauuacgggcaugcaccaccacauccagcuaauuuuguauuuuuaguagagacgaggguucuccauguuggucagguuggucucgaacuccugaccucaggugaucugccugccucagccucccaaaaugcugggauuacaggcgugagccaccacgccuggccugguauguguggguuucugaugagcccaguggcuggugugggcaaugacuuuguagccccaggauucaguguuagugccugagagacaguaaugugcuguuuucauuuguuccuacaugcauguauucauuuauuuuauuuuauuuuauuuuauuuuauuuugagacggggucucacucugucgcccaggcuggcgugaaguggugcaaucucggcucacugcaaccuccaccucccgaguucaagcucuucucccgccucagccucccaaguagcugggacuacaggcacacaccaccacacccaccuaauguuuacauuuuuaguagagacaggguuucucuauauuguuguucaggcuggucucaaacuccugaccucaggugauccacccgccucagccucccaaagugcugggauuacaggugugagccaccgcgcccggcccauguauucauuuagagagcauucauugagagccuucuguaucucaagcguuguacuaugcaacaagcacugggugguaguuugugcuuucaagggguggaguagauuuaacuucuggaggaguugagucuggcuguguugggaaaaaacuugucaugacaggaacauuuuauucccauaucuagggaacucuugucugagaacauugacauguccucccugccaagguggaagcccauucuaucucuuuuuuucuuuuugagauggggucuugccauggugcccaggcaggccucgaacuccugggcuuaagcaauucuccugccucagccucccaaguaguugggauuacaggugcacaccaccucagugugucuugcaacuucauccauccagagugcagccacaaaccaagaagucaccaggaaagagcagagaguagggagaguagauuccaugaagacuguauacaaaagcuuauucucuuucucucuuuuuuuuuuuuuuagacagagucucacucugucgcccagucuggagugcaguggcacgaucucaucucacugcaaccucugccuccuggguucaagcaauucucaugccucagccacccaaguagcugggacuacaggcgugcaccaccaugccuggcuaguuuuuguauuuuuaauagagacgggguuuugccauguugcccaggcuggucuugaacuccuggccucaagugauccacccaccuuggccucccucagugcugggauuacaggcaugagccacugcauccagccuggaaaagguuguucuuguugcuccuggggacccaguagacucucggucccaguuuacucuuacuuuacacauaguuccaacaauccugggcagcuaguaacuagccuugcuuaauagaugagaagacaggugucauugcacaagaagaaagaaacaaaaaggcaaagccaguucagccaucaaaugaaauggcaaauagcuucucacuuuuuaggcucuaagagaguccuggugaaucccaggaagaauacaugaugagcacauggugagccggguucuuuuuaaauuuuauuuuguuuuuuuuuuuuuaagacgcagggucuugcucuguugaccaggcuagaguggaguggugugaccacagcccacuguagccucaaccuccuuggcccaagugauccuccuaccuuagccucucaaauaguuaggacuacagguguguaccacuacauccagcuaauuuuucucuuucuuuuucuuuuuuuugguagagaugggggucucacuauguugcccaggcuggucuugaacucuuggccuuaagugauccucuugccucagccucccaaggugcugggauuacaggcaugagccacagggcccagcuaauuuuuguauuuuuaguagagacaggguuucacaauauuguucaggcuggucucgaacuccugaccucaagugauccgccucagccucccaaggugcugggauuacaggcaugagucacugcacccggcccacauuguuucuguuccuaauuucucuaguaauuucuaugagaaagacacugauagaggcacucacucacucaggagggacgugacacaguccgcucugaauggcugucaguugccaaauuugggagacagaugcagccgacacaugguacaaagugccagaugucaagagucaagugggcuuccugggggagguggcauuugagaugggccuugaaggaugagcgagugaagacuggaggguggacacagaagaaagucauuggucaugcugacaagaccugguggguuuacccuuauuuuacaugauucuaaccauguuuaaaagaggggaaguuucuggaaaugggaacuaggguaagugugugguugaugccuauggugggugcagauaggagaagggaagugagcuugaaaagguugugaucugacuguaaaggcuucgaaagcuggguuaaggauuuuagaauuuauuuauucauuuauuuauuuauauuuuuuucgagacagagccucgcucugucgcccaggcuggagugcaguggugcgaucucagcucacugcaacccuccccucccagguucaagcaauucuccuaccucagccucccaaggaacuggguuaacaggcgcgugcuaccacgccuggcuaauuuuuguauuuuuaguagagacaggauuucaccauguuggccaggcuggucucaaacuccugaccucgugaucugccugccucggccuccuaaagugcugggauuacaggcgucagccaccgugcuggaccuuauuuauuuauuuuuagagauagagucuugcucuguugcccaggcuggagugcagugacgcgaucacagcucacugcagccucaaacuccugugcucaggcaauccucccaccucagccaccugagucacugggaccacaggcgugugccaccaugcccacauaauuuuuuuuguuuauuuuuuguagugacagggucucacuauauuguccaggccggucuugaacuccugggcucauaagaucuuccugccucagccucccaaacugcugggauuacaggcgugagccacugcacuuggccuagaauuuagugagcugguaauagugacucauagaagagguugugcauguuuaaauggaagacuuuaaaaauuuuuaauugugguaaaauacacauaauauaaaauuuaucacuuuagucauuuauuuauuuauuuauuuauuuuugagauggagucucgcucucugucccaggcuggagugcaguggcgcgaucucagcucacugcaagcuccgccucccagauucaagcgauucucccaucucagccuccggaauagcugggacuacaggcggccgccaccacgcccggcuaauuuuuuguauuuuuaguagagaugggguuucaccauguuagccaggauggucucgaucucccgaccucgugauccgcccgccucagccuuccaaagugcuggaauuacaggcgugagccaccaugccuggccuagaauuuccauccuuuuaaaggcugaaucauauuccauguauggauauaccacauuuuguuuauccauucauucaucaauaaauagacacuggguuguuuucagcuuuuuuuuaaaaaaaagucuuaauguuacagaggaggucucucuccaucacucaggcuggagugcaguggcaccaucacagcucgcugcaaccucuaucuccugggcuccagggauccuuccaccucagccucccaaguagcugggacuacaggugcaugccaccacggcuggcuaauucuuaaauuuuuucuguagagauggggucuugucaucuugcucaagcuggucuucaacuccuggccugaagcaauccucucaccucagccuuccaaagugcuaggauuacaggugugagccaccgcgcccggccugguuguuuucaccuuugggcuuuuuugaauaauacugcuaugaucacggguguaccaauaucuuuuugagacacugaguucaauucuuuuguguacguauucagaaguggcauugcugggccaggcgcgguggcucacaccuguaaucccagcaauugggaggcugagguggguggauugcuugagcccaggaguuugagaccaaccucagcaacauggugaaaccgugucucuacaacaaauacaaaaauuagcugugccuguggucccagcuacuugggaggcugaggugggaggauuacuugagcccaggaggucaaggcugcagugcgccaugauuguaccauugccugggugacaggguaagauccugucucaaaaaagaaaaaguauugcugggucauaugguaacuauguuuuaaguuuuugaagaacuacgauaauguuuucuacggcgacugcgcuauuuuacauucccacaaaggguuccuauuuuuccacauccucaccaacacuugcuauuuuugucaaaagccucugaccacaacguuuuugucaacugaauaauauauaacuuuuuuuguuuuguuuuguuuagacagggucucacucugucccccaggcuagagugcgguggugugaucuaggcucacugcagccuccgccuuccggacucaagccauucucccaccucagccucccaacacgcugaguagcugggacuaugcaccgccaggccuggcuaauuuuuuguagagcuaggauuucaccauguugcccaggcuggucuccaacuccugggcucaaacgaucugccugccucagccucccaaagugcugggauuacaggcaugagccacggcgcccagccauaacuuuguuuuauguguguuucuguuuuagaauaucauauauauauaucaaucauaucuauauauauacacgcauauauauauauauaucacauauauauuuauuuuuugauucauuaacauugaacucccggccaauagcacuagaucugaugccugaaugaagcuucuguaacacgucuuuucuccgugacacacgucacggccuucuugacuuagaaacacuagacuacacuucagcacggugcgugggggccacugaagauagcagagucaccaacaaacagcacaaaaauaugaaaagcuuggcacuaaauggaccauaaaaaagacacuugcauguaguaucagagcuggaggaagaaagcagagugucuccuuauuagaccucaacaggguugggugacugaguauguugucaggccgggagcaauggcucacgcccauaaucccagugcuuuggguggccaaggcggaaggauggcuucagcccaggaguucgagaccagccugggcgacagagcgagaccuccauuucaaaaacaauuuuuuuuuuuuuuuuuuuuuuuuuuuggagacagagucucgcucugucgcccaggcuggagugcaguggugugaucuuggcucacugcaagcuccgccucccggguucacgccauucuccuaccucagcuucccgaauagcugggacuacaggcgcccgccaccacgcccagguaauuuuuuuguauuuuuguagagacgggguuucaccguguuaggauggucucgaucuccugaccucgugaucugccugccuuggccucccaaagugcugggauuacaggugugagccacugcgcccgggcuuuuuuuuuuuuuuuuuuuuuuuuuguagagacgagguuauugcucuguugcccaggcugaaaugcagugguacgaccucggcucacugcaaccuccaccucguggguucaagugauucuugagccucagccucccgaguagcugggauuacaggcacacaccaccaagcccggcuaauuuuuguauuuuuaguagagaugggguuucgacauguuggccagguuggucucgaacuccugaccucagguaauccaccugccuuagccucccaaagugcugggauuacaggcgugaggcaccacgcccagcucuacaaaaaaaauuuguuuaauuagcuaaguguggugcugcaugccugaagucccagcuacuugggaggaucgcuugagcccaggagguaaaggcaaucccaccacugcacucuuuucuuuucuuuuuucuuucuuuucuuuucuuuuuucuuucuuuucuuuuccuuuccuuuccuuuucuuuccuucucucucucucucuuuccuucuuuccuuucuuuccuucuuucuuucuuucuuuucuuucuuuuuuuuuuuuuccugagacagucucacuuuguugccuaggcuggagugcaguggcgaugaucuugucucacuacaaccucugccucccagguucaagcaauucuugugcaucagcuucccaagcaucugggauuacaggugugcacccaccauaccuggcuaauuuuuguauuuuuaguagagacaggauuucaccauguuggccaggcugguauugaacuccugaccucaagugaucugcccaccuuggcaucccaaagugcugggauuacaggcaugagccaccgugcccagcuacuccacccuguuucuaagcaagaaaaaaaaaauuaucacugugcauguccacaaaugaccacaaaugccccagcgaguauugaucuuagaguauaaacaaauugcaacaaguaggcaaauuugccaaucuggaauuuucgaaucaugaagcucaacuguauauauguaggaguggaauugcugggucauagggagaaacugcuguacagucuuccaaaguuucagagacucuuccaaaaagucaacaacucuuccaccaguaguguaugaaguguuccaguugcuccauauccuccccaacacuugguguugucuuucuuuuucuuuucuuuucuuuuuuucuuucuuuuuuuuuuuuuuugagacagggucucacucugucacccaggcuggagugcuguggcacgaucugugcucacugcaaccucaaccucccaggcucaagcgauccucccaccucagccucucaaguagcuagaaccacaggcaugcagcaccacuccuggcgaauuuuuuuguagagacgggguuuugcccuguugccuaggcuaaucuggaacuccugagcucaagcaauccacccaccuuggccucccaaaguacugggauuacagguaugagccacugugccuggccuuuuuuuaguuuuagacauucugaugggugccaaauaguauugcauuguggguuuauuuauaaauuuauuuuuguuuuuuugagucagggucugguuaugcugccuaggcuggucuccaacuccugggcucaagugauccucccaccuuagcuuccuaaagugcugggaacauuguggguuucauuuacauuuccugaugaugagugaugugccugaugaugaauuaagugccuuugcauauguuuauugacaacuuggauauccacuuuugugaaaugucuaagucuuuugcccacuucucuguucagaugucugguuuuuucuuacugauuuguaggaauguguguguguguguguguguaucuagauuuuacauagauacauauucauauuuuacauaacuauaaaaucaggauaugagauuuuuauuggacauaaugacugcaaauaucuucucuguagcuuuucuuuucauucucuuaguggugucuuuuaaucaauagaauuccuuaauuucauuucauuucuuuuuuuuuuuuuugagacagggucucacucuguugcccaggccggagugcaguggugcaauuacggcucacugcagccucgaucucccgggcucaagcgaucuucccaccuuagccugccgaguugcuggagcuauaggugcacaccaccacacccagcuaauuuuuguaguuuuuuuagagaugguguuucaccguguugcccaggcuggucucaaauuccuggguucaaaccauccucccgccccggccucccaaagugcugggaugacaggcgugagccacugcacucagccaggauuucuuaauuuuaauguaguucaggcugggugugguggcucaugccuguaauccuagcauuuugggaggccgaggugggcggauuacgaggucaggagaucaagaccguccuggcuaauauggugaaaccccgucucuacuaaaaauacaaaauagccaggugugguggcgggcgccuguagucccagcuacuugggaggccgaggcaggagaauggcaugagcccgggaggcagagcuugcagcaagccaagaucaugccacugcacuccagccucggugacagagugagacuccgucucaaaaaaaaaaaaaaauuuaauguaguucaaauaauuuuuucuuucauggcuagugcuuauuaguguccuauuuuaaaaaccuuugccuagcugggugcaguggcucaugccugucuucccaguguuuugaaaagcugaggcaaggggaucgcuugagcccaggaguuugagaccagccugggcaacauggcaagacccuguuucuaccaaaaauaaaaaaaaauuagccaagcaugguggcaugugacuguagucccagcuacucggaagguugaggcagaaggaucgcuugagccagggagguugaggcuacagugaaguaugaucaugugacugcacuccagccugggugacgguaggcaaaacccugucucaaaacaacaacaacaaaaucccaaaacaaacaaaagaaaauuauaauucugucuguugcauauagguauucugaggguuaaaugaguuguuacauguacuuugcugcaaauggugucuggaacaugauaguacuaaauaaaucucagcaauuauugauauuuuuccaacaguuacgaguuuuuuaccacccagaaauuucaagggaaauaaacuuuuuuuuuuuucaagauggagucucacucuguugcccaggcuggaguacaguggugugaucucugcucacagcaaccucugccucccagguucaaauaacuuuccugccucagccucccaaguagcugggauugcaggucugugccaccacaccuggcuacuuuuuuuuuuuuuuuuguauguuuaguagacacagaguuuugccauguuggccaggguggucucgaacuccuggccucaagugaucugccuaccucagccuuccaaagugcugggauuacaggcaugagccaccgcgccuagccccagaagaaacauuuuuuuucaguggcuuaccagcacgauguucacagugaugaugauggggaagaggggacacuuucuugagauauuucugcaucaggauuagcuggcucuggugcugguuugaauagaagaggagugauggagaaggagggguaaaaaguaaauaaucucucauuucugaccguggguacaucauugccaggaccagggugaugcaagcaaggaaucuugggcucaaaauuuaaggagacaccuauucuuguguuaguacagugcagggcaccucaaagagggagcuugcaaguaaaguuuaaaaaugccucccccuuuuguacaggcagggucuugcucuguugcccaggcuggagugcagaggugccaucauagcucacugcagccucaaacacuugggcuuaagcgauccucccaccucagucucccaaguagcugguacuacagggacaugccaccaugcccagcuacuuaaaaaaauuuuuuugguggggaggggccaggugugguggcuuacagcuguaauccuagcacuuugggaggccaaggugggcagaccaccugaggucaggaguucgagaccagccggccaacauggugaaacccuaccucuacuaaaaaaaaaaaaaaauacaaaaauuagcugagcaugguggcuugccccuguaaucccagcuacucaggaggcugaggcacgagaaucacuugaacccuggaggcacagauugcagugagccgagcucucaccacugcacuccaaccugggugacagagcaagacucugucucaaaaaaaaaaaaaaaaaaaaaaauggcagugguccaggugugguggcuuaugccuguaaucccagcacuuugggaggccgaggcaggaggaucaccugaggucaggaguuugagaccagccuggccaauguggcaaaaugcuaucucuacuaaaaauacaaaaacuagccaggugugguggcgugcaccuguaaucccagcuacucaggaggcugagguaagggaaucacuugaacccagaggggaagguugcagugagccaagaucaggccacugcacuccagccugagugacagagcgagacucugucucaaauaaauaaaugaauaggaagaaaugaggucucggccgggcaaggugucucaugccuguaaaucccagcacuuugggaggccgaggcagguggauuacgaggucaggagaucgagaccauccuggcuaacacagugaaaccccaucuccacuaaaaauauaaaaaauucuccgggcguggugguaggcgccuguagccccagcuacuccggaggcugaggcaggagaauggcaugagccugggaagcggaacuugcagugagccgagaucaucccauugcacuccagccugggugacagagcgagacuccaucucaaaaaaaagagagagaaaugaggucucacugcguugcccaggcuggucucaaacuccuggcuucaagcaauucucccgcuucagcuucccaaggugcugggauuacaggcgugagccaccgugccugguggaucuucccuuuucagcaguuuuauggagguauaauuuacagagcauaaaauucaccuguguaagcgugcaauugagugacuuuucguaaauuuacagaguugugcagccaucaccccgauccaauuuuaggacauuuucaucaccuccaaaacagcccccgugcccauuugcauuccaucuccacucccacccccacuugcaggcaaucucucgucuacuuucugucuguauugauuugcugucccuggacauuauguauaaauagaaucauaaacuauguggucuuuugcgucuggcuccuuuuacuuagcaaaauguuuuugaggaucauccacauuguagcauauaucaggagcaaauuccuuuuuaugguggaauggcauuccauuguauggauguaccgcaauuuguuuauucacucaccaguugaugggucuuuggauuguuucauucauuaugaccaaugcugcuaugaauauucauguuuaggucuuuucauagacauaugcuuugguuucucuuggguagauggaauugcugggucuuuaaaaagaguuuuagggucuggcgugguggcuuaugccuacaaucccagcauuuugggaggcugaggcagguggauugccugagcccaagaguuugagaccagcccgggcaacauagugagaccccaucucuacagaaaacuuaaaaaauuagcugggcacgguggugugccucuguagucucaccuauucaggaggcugagguaggaggaucacaugagcccaggaguuugagguugcagugagcuaugauugcaccacugcacuccagccugggcaacagagugcccagccccucgccuuaaaaaaaaagauaaaagaacuaaaguggccaggcaugguggcucaugccuguaaucccagcacuuugggaggccgagguggguggaucucuagaggucaggaguucaaaaccagccuggucaacauggugaaaccccaucucuacuaaaaauacaaaaauuacccaggcaugguggcaugcaccuguaaacccagcuacuugggaggcugaggcacgagaauuacucgaacccaggagauggagguugcagugagcagagauuucaccacugcacuccaaccugggcaacagagcgagacuccaucucaaaacaaaacaaaacaaaaaacaacuaaaguaggguaaguggcacagaguggugggguguucagauuguagaugagguggccagggaagguccuuuggauaagaucaccauaucacugagggucuuguuagggaaacaaacuacguguuucagagaggggaaauuuaauacagggaauugguuaagugggagaagaaagaguugagaagccacaugggaugaugaggaaaucuggcauaagcuacagcagaaagcuacuggagggacauggcaaagagaggaugugauaaggaagggacccuuggggaggaacuggcacuauggaggagguguagccacugucagaaaacacccuccaccccaagcagacacaggagagaaacacccuggcuucugccuuccucuccaaucuccgaucucccuccaguggcucccauuggauaaaccgaccaggaagccaguaugcaauggaaucugggaaauguaguuuucugggggaagggcagggcauggcucugacccacacaaugacagagcagagauauaaauuaaauaaaggaccgggaaugguggcucgcaucuguagucccagcuacuugggaggcugaggcaggagaauagcuugagccuaggaguuagaggcugcaaugagcuaugauugaaccacugcacuccagccugggugacagagcaagacucugucucuaaaaaauacauuaauuaaguaaaggaacaagccauggggggcauccuugauguauuuuguguagaaggaacaggaaguucaaagguccugagguugcagugucccagauggagccaaaaccuugagagugggugugaugguccaggcagaaugagagcggcagggaacccaggacaaagcccugaaagauacagaguuuuagggaguagcaggagacagcgacggcacagccagagaggugggugcagaacuaggaagugauaccgugucucugaagucaagggaaaaaggaguuucaagaaggugauggugaguggggacugacugacugugagaaugaucuaaugaggacuggcaugaggguguggaccuggcaaauuggcaccuuuggugagaagaguuuuggaaacguuggggaggugggaggcaaggaguuaaaugcaagcaagugcaaacucgagcacagaccacuccuuggagaagccuggaugcgcugaacuaaggcaguuucccacagcacccauggccagagagugagaaaguuuguuugggucccaaauugucuaagccaggaggccuggagcccaguuggucuuagggucugaaaucagacaguccugguuucaaaaccugggcccccacuucccugcuggguuccccugaucugggucccucuccucucugagcucaguuuccucaccuggaaauaggggugucacuguacuguuuauggauguugcagcaguuguuaacauugcaucugcaaaguguucagcacucaucagugaaagcuuuagaacaagcuggcaagaacucaucuuuuuuuucuuuuagacagggucucacucgucugucgcccaggcuggagugcaguggcucgaucuuggcucacugcaaccucugccuccuggguucaagcaauucucccaccucaaccucccaaguagcugggauuacaggcgugcaccaccauacccggcuaacuuuuguauuuuuaguagagacaggguuuuaccauguuggccaggcuggucucgaacuccuggccucaagugauccacccuccucggccucccaaagugcugggauuauaggcaugagccacugugcccggccucaaauaauaacaacaaugguagcuacuauuugaaaaacuuaccaugucccagacacuuguaaaguauuuuacaaacaucaucauuccuuauucucccccuggcucacuccaacuacacuggccuccuuccugguccucaaacacuccugccccagggccuuugcacuugcuguuccuguugcguggaacucucuuccccuagauauccagaugguucccuuccucacuucaggucucugcuuaaacgucccuuucucgccaggcgcggugguucacgccucuaauuccagcacuuugggaggccgaggugggcagaucacgaagucaggagauugagaccauccuggcuaacacggugaaaccccgucucuacuaaaaaauacaaaaaauuagccgggcgugguggugggugccuguagucccagcuacucgggaggcuaaggcaggagaauggccugaacccgggaggcagagcuugcagugagccgagaucacgccacugcacuccagccugggcgacagagcaagacuccgucucaaauaaauaaauaaauaaauaaauaaauaaauaaauaaaaaagucccuuucuccaaucacucuguuuaaaguuuacuuccccuuccuccuaauaucuuauguacuuuacuuuuuucccguauuucuugacugucucaccccauagaauauucaucuucacauccaacccggaggcucauucuuggaaugccaacacuuugggaggccaaggugggaggaucgauugaggccagggguucgagaccagccugggcaacauagcgagaugcccaucucuaccaaaaaaaaaaaaaaaagagagagaaaagaaaaagaauauucaauuucacacaggcaggcauuuuugucuguuguucacagugccugggacauaguagaugcucaguaaauuaccugauucucaggaugaccaagcccuuuacacguguuaggucuccaccacccacuuugcagauggggaaacugaggcagagaggaacagucaucccuacaggucacacuugcaucuugguguuguccagcucagaaaaaaagacgguucgagaccccuagccccccuccccgcucaugcuuggcgcuccuccccagccagagcccucagccccaggccgccgccuggaaaggccugagucaucgccgccuccagacggcggcggccgcgggcugagggcgacggcggcggcggagcgaggugaugcggggacgccaggagggggcgugagugcaggcaaaacagaggaaauuaaaacuagcccggcgcuccucuccgcggcccagcggcugccgccgccggcugaugcgugggcggacgggugggcggcgagggcacugcgcuucccgcucccccgagggagcgggccgggagcgggguccccggggccgcgaggaagguccgaagcgugagugccccgcccccacccaaaguuaaaguugcaaguagacaccugcccgggacucgccuccuaaaagccgcgugccaggucuccguggucccuggguaggaaacugcccuugguagucgugggaacuccucccguggccgaagugaccccaggaccgcaccugcacccaaacaauuucgucugcuggcccuggaucacgccacccugggggcacgaaaugaccgaaggauccuuagaguggucucagugcccgggaaggaagccccuucccccagcuaaaggagacccuuggugacccgauucaugggagcgcacgagcgugucgcccccccacgccccccaaugcccgcuguccgagguuuuagguagccagggugggugucccaacaguggguggguggggauuugcgacuccggcccccugccgucuuuggguggccggggugggccgagggcgccuuuacgcgcggggucccgcggcucaggcucgaagagggucugcgugcgggaggcgguccgggaacaccgccuagggggaggggggccgggaauaccguuggggggcggggcuggggaaugccaccgcgguggugguggggcgcuuggggaaugccaccagggggaggucccccaccccauggagagguccucggcggggggcgggcgagggcgugggguggggggugggggcagucugggcgccccccgccccccgccgggcuccgggccggaggcgugacgucacggcggcuggaagugcccggcgcggaggcgcgggagggggcgggggcccgagccggcgcuuuauaagaggagcccgccaggcgcgccgagccgcagcccgcguccccgagcccccccucaccccgucccggacccccugccccgcagcucgcgcucgugcccccucccccacgcccccccggggcgccugggugucgagggaccgagcgccccgcggcgggccagagaagggacgcgcggcgggcggccgcggggcaugaggcggaggcgcgaugucggugccgcugcucaagaucggggccgugcugagcaccauggccauggucaccaacuggaugucgcagacgcugcccucgcucguggggcucaacggcaccgugucccgugcgggcgccucugagaaaaucgugaguggccgccgcgcggggggcgcucccggggggcgugguacccgcgccacagccgcugccgccgccgcagcccccggggcccccaccugucccccucuaccccugugcuucccacgacccugcccggcacgccuggguaggggacgcccucucgggguuccagggucggacguggaggcagaaggagccccgggaccccuagccaccuccgcgccauuuaggaugguucuugcuguuauuauugauuauuaugauuauuagugagcaaugucugagcgcgaauagcguaccaggcucgcuccggccccagggcggaggcgacaagggcugcagaauugagcugaguccgggcugaguggggugcagcgggaggagggugagacucggggguuuagaaggacccugucucugaaagaggggaggaucgagggguuuccgagugucuccaccuucaaggucucugccugguugcgucucggcgucucugaguaguucugucugagucucuauucauuuccccugcuuugcgucucugggucucuuucuauuaauauuucuaucuuuccuugucucugucucuguggcgcugagaauuuguaucucuuuuuuucucucuuuuucucuccccugcaccccuuccgccauucuugccucgccaugugcugaauauuuauccccauaacucacccucccugggagguagacggggcgcagacuggggccggagcugacacugccuccagaagcuccaggauggcgccuucccaucccaucccccuuugaggcuuuauccuccagcuuccccacuacagagcuucccuggaucagggaagaaggagagaacucagugggguucuccccgugguguccugaggagagaggggagggguuuccuucacugcaaacuucccugggccuccuccagauaugccuuuccccccacuccucaaccucugguagccccaccccuguuccaucuguuuggggggcuccucccaaaucaucccccaaacccaggcugcgaugccuggggcucccuuucuuuagccccaacuucaccaacccucccuugcuuagccccaaauggucaucccgcagcuucuuucuccuugaugggagcaaagaagaauuugcucccuagggucgaaggcaagggugugugguggugguggggacaccugagaaggcuuuguccagccccuggugggggugguauugggcuugacacaggugagagcuuucaggcuagauucuuagacuuggcagccaaugugugagacgguguguuucugugugucugucacauuaaguguuuauuauuuggguauguccuggugugucuauauguguguguuucgguguguauaugggggaaugggaguggagaaaguuuaugugcacugccggcaugggguccgaugugccuuccugugugugagggugcaucccagaaugagugugggugugucccugagugacugugcuuggguguggacguaucagcauguguaucugcaauugccugucccugacuauggguuugccuguguuacaagauugcaugugugcauaugaguuuguuauacacaaguaugauacaggcuucuugccguugccaucugagaagggagagagaugguaucucauugaaaucagaagccaaauuucccucuaccaccauugaaagcaagugagucuguguacauguguucuaugcagguguguguaaaugugugcauauggugugucugcagaauguauaaauaaguauauaagagcaugucuaugaguuaugauuuugugugugcauauguaucugugcaaacgugugugcaaguaucuuugugugcauauguguggacagguaugucuuuguaagugugugcauauaacugcaaguguguauuuaugaaagugugugugugugccugccuugugugcauguggguaggaugcccugugugcuguguguuuucuguaaguguguaugugugugugcccaaacagaccugaucuccacucuggcccauucguagcuaacagcaucuucauccaaugcuuccaugaauucaccugcugaaagccaauggcccucccaucccugacaccaccccaucccucagucucauuauacuuugucaaaagggaucugagaagugagauguuaagguacucagggugagggcugggaggggacugugacaugaggguguccauuuugggagucugaaagaccuauguuggaaucuagauuuuguccccaacuugcucuaugacucuggccagugccuuugucacucugagcuauuguuuucucaucuauaaaaugggaaugaugucuuaccucacagaauuguuguggguaacagagaucugcuguucaaauucccauccuuccacgcuuccauauaucucuucauccauccauccauccuucccuccaucuauuauuucaucuauccaucuguuuuuacgcccauccuuccaucugucuugcuauccauaucuccauucauucauucauccaaccaccuguuauuccaucagucuguccaucuauccaucaauuauuucaucuacccauccauuuucucuccauccauucacucauacacccacccacuauuccaucuguccauccaucuguacauccauccuuucacacauccaucucuuuauccuuccacccaucucuuuucaucuauccaugaugcaucauuugucucucuguucuuucauggauccauucuucuauccauccaucucuauccaugcauucaccaauuccuccaugcaugcauuauccauuauccaacucucuuuuucuauccucugugcauccauccuuccaccauccaucugccucuccauccauucaucuauccuuccauccauuguauuuauuccacaaaacuauuuuuuuaagagguggagucucaccauguugcccaagcuggucuugaacuccugggcucaagggauccucccuccucggccucccaaaaugcugggauuacaggcaugagccaccagugccuggccuauuccacaagacuaucaagugccucuucuaugucaagaauuuuuauguuugaaaacccccagcucagugccuaagauagcagaugcucaguuagugauaagauuuuugagucaaacauaucuggguuugaauucuggcccuguaauuuacuagcugugugacuuugggggaaauuauuuaauuucucuaagccccaacuuccuuauuguuauuauuauuaauauuauuauuuuuagagaaagagucucacucugucacccaggcuggaguguagugaugccaucauagcucacuaacaucuggaacuccuaggcucaagucauucuccugucuuagccuccuaagaagcugggauucgauuuccuuauuagucagggggaauuuagagucuuuaugagaugguaagauccuugaagacaucuguguuuugcucacuacugaacccuaagguguggcgcacauaggccuacaauaaauauuuguccaaugacugaauccacaaucacaccuucauaaggauuuguggauuccuccuucaaacaaaaacaaauaaauaacgggcacauaguaguguuuaguaaggagggguuguuuuauuuaccccucuagccaagccuggaauaaacauuucucaagugucuaaauccauuucaccuuccucaggacuggggagaacaaauggaaagugaccaggcacacaguagguguucgguuaggaggagaugucggaagguuuagcaccccaacgucggggaggcugagggguucaggaaacaaagcaguauggauucccaaagucaggaggcggaagguuggaugcugguguuuggcuuuaaaaaggaacucagugguguggggcggugagcguagagccuuggggguccugcuucucucuggcuuccuccuccugaauugcagaagcagcuuagcauuccugugguuauagaccaucucugggaagacguggggaggaagcugccgcuacuaccuuuggccaacucccagccauaaaccaucccugugggacaggagccuucagcggaauggcuucucaccuggggaucauaaauccaggaccagacuaagagcugucagcuguauugccagccacggacaucauuucgaggccugaaguaaaauaccugaaucuuguauguuauacccuugaccgucgccucugccuggggggcuggagagagggaaggggagauggaggaggggugugcuauuugagggggaccuuuugcuuuaugggacgaauaaggaggagcugagcaguucucagcaaaaggcucuuagaguggcacuguggcucaugccuauaauucucaagcuuuggaaggcaggggugggaagauugcuugaggccaagaguucaagaccagccugggcgacauagcaagauccugucucuacaaaaaauuaaaauaggcugaccacagugggcucacauguguaaucucagcacuuugaggggucaaggugggaagauugcuugaggccaggaguucgagaccagccuggacaacauagcaaaaccccaaaagaaaauacauuuuuagccaggcacgguggcucacaccuguaaucccagcacuuugggaggccaaggcagguggaucaccugaggucaggaguucaagaccagccuggccaacauggugaaacccgguggcucacaccuguaaucccagugcuuugggaggcugaugcgggcagaucacgaggucaggagaucgagaccauccuggcuaacauggugaaaccccgucucuacuaaaaauacaauaauuagcugggcacgguggcgggugccugcagucccagcuacucgggaagcugaggcaggagaauggcgugaacccaggagguggagcucgcagugagccgagauugcaucacugcacuuccagccugggugacagagcaagacucugucucaaaaaaaaaaaaaaaaaaaaaaaaaaaaaaauuagccaggugugauggcaggcaccuguaaucccagcuacuuaggaggcugaggcaggagaacccaggaggcagagguugcagugagccgagaucgcgccauugcacuccagccugggugacaagagcaaaacuccaucucaaaaaaaagaaaaagaggaaaaauaaaaagaauuagcugggcaugguggugcacaccuguagucccagcuacucaggaggcuaaagcaugaggauugcuugagcccaggaguuggaggcuacagugagcuaugaucgcaccacgccuggcauguuggaggaacagggaggaggcccaugucuggagcauagugagcgagcggaagagggagaggaggugagggaaggaaggugaugggagccauaucaugucguggggagggggaucuuucagggacuuuagauuuuuaaaauuuuuaaauuuuauuuuauuuuuuuuugagaucaagucucacccuguugcccaagcuggagugcaguggcacgaucuuugcuuacugcaaccucugccucccggauucaagcgauucuccugccucagccucccaaguagcuaggauuacaggcaugcaccaccaggccuggcuaauuuuuuguauuuucaguagagaugggguuuugcuauguuggccaggcuggucuccaacucccgaccucaagugauccacucaccucggccucccaaaguguugggauuacaggcauaagccaccaugcccggccuauaucugucucuuuaucucauucaugucugucucuccaugucucucugugucugucugucucuaccucugggauucuaucuccaucucaccauaggacccugacggggacccugggaaacagacuagaauucuuggacggcagaggcuucuagggccaggaccuguguuggauguuaggaaggauuuggugacagagggcaggaugaccaagaccaccucucuuauuuauuuauuuguuuguuuguuuauucauuuauuuugagauagaaucucgcucucacccaggcuggagugcaguggcaccgucuuggcccacugcgaucucccucaaucaccucccggguucaagcgauucuccugccucggccucccaaguagcugggacuacaggugugcgccacccugccuagcuaauuuuuguauuuuuaguagagaugggguuucagcauguuagccaggcuggucucaaauccugaccucaagugauccacccgccucagcuacccaaagugcugggauuacaggcgugaaccaccacgcccggccccagaccaccucucuugagggccccaaagagaggcauuggcagugucuggacccccuggguaugcuggugauggggccaaguguugacuggagauggaggugggcucccaagcuccgggugaccccuugcccccucugcccccgagcaccauucccccuccccggcugccacucaggagggcgucccucuaggacccagccaccaggcccaguacuggcuccaagauggaacagcugucugggcugcagcugcagaagcucauuuugaacaagggagaugauugcaagagugauugggggagggagagggaaggggaggguagcuagggccaaaaggaaucaggccugauuguuacugcugccugccgcugcagagaguggauugcccaggagauggggaaggccaagccaggcgggaaaaggcagaggggagguuugucugcccagccgcacguccaucuguccccacucugguccucccaguugcaaaguuucucugccugcgucucucucuuccugcauuucagaguccguaucucugacucugcaguucgguuuguauuugaguuuccgcaucuccccuugccuaaucucucugccccuccgccuggaucucugaaucucugagccuucccgcuugucccucagugcugcugucgugaucagaaacacagcuaagguuugagcagcucuugggcgcgcucuuucuugucuugucauuucugcgauacucaggggccagagacacauagaggcaacaaauucccaggaaacggauggaaugguguccuucgauaaagggauauuugcaaagauaucucaaugaggacuaauuaauuaagcgagccacuuccccugcccucucccccacccugugugcccgcagccuccugggagggaaccagccaaugaguggauggcagagccuggugcucagacagugucucgauguuuaauuuauaacagccuucuccccgccgccccaucaauccaucuggaagggcaagguggccaugggcguguagacuguggcagagguuggagaccuaccugguccccgugaaagcaugcuugggugugugugugccccugugugucagagcgugucauagcauguuugagcgugucuucauggcaagcacgccccaucguguaaggggaaucugauggccaucaguugugucugaacccaagggacguguuggagugaaugagagcgugucuugugugcggaaugucugagcguggcaaagccaugccugacuguugaggugcgauggggcuuguggagcacauaugaggauauggcacauguuggggcugcucaggguauagcgccugugccaggcugccaaggccuguacuugcagguaaagcuuuucuucucaagggcauggcaagguagguuuuuggcaggggcuccugguaagaacagcagagacaggacaaggauccacagcuuccaagaggagccaaucugaaucuuuccggccccuucagcacuaguggcucaagaagguugaguuccaacuuuuuuuuuuuuuuuuuugagauggagucucauucugucgcccaugcuggagugcaguggcgcaaccuccaccucccggguuccagugauucuccugccucagccuccugaguaacuggaacuacaggcaccugccaccaugccuggauaauuuuuuuuguauuuuauuuuauuuuauuuuauuuugagauggagucucgcucuguugcccaggcuggaaugcaguggcgcaaucucggcucacugcaagcuccgccuuccggguucaagccauucuccugccucagccucccgaguagcugggaccacaggcgcccaccacuacgcccggcuaauuuuuuguauuuuucguagagacgggguuucaccguguuagccaugauggucucaaucuccugaccucaugaucugcccgccucggccucccaaagugcugggauuacaggugugagccaccgcacccggucuuuuuuuuguauuuuuaguagagacaggguuucaacauauuggccaagcuggucuugaacuccugagcucaggcaguccacccgccuuggccucccaaagugcugggauuacagccaugagcuacugugccuggccucaacuuuuuuuuuuccucccaagacagggucucacucugucacccagacuguagugcaauggcaugaucauagcucacugcagccucgacguccuguguucaagugauccuccugccugagccucccaaauagcugggacuacaggugugcaccaccacaccuggcuaauuuuuaaauuuugcauagagauggagcucacuauguggcccaggcuggucucaaacuccuguccucaagugauccucccaccuuggccucccggaguguugggauuacaggcaugagccaccaugccuggccagaauuccaacucuugauauaauaguugcuuuucuguccucuggcuucccacccccaguguguggcuucagaguccccaguuuuccucaucucucuaguccuaccaggccccucagagucacuucucaaccccacuucugcuugccccuucacacuacacacaggggagcuaccagugcugagggaaaguguugccuguuaaguuuagcuuucuaguuaugaagcccucaguauaauacucagacugggcugggcaugguggcuuacgccuauaaucccaacacuuugggaggcagacguggguggaucaccugaggucagagguucgagacuagccuggccaacauggugaaacccugucucuacuaaaaauacaaaaauuagcugggcguggugguacaugccuauaaucccagcuacgugggaggcugaggcaggagaaucgcuugaaccugggaggcggagguugcauagagccgagauccugccccugcacuccagccugggcgacagagugagacuccaucucaaaacacacacacacacacacacacacacacacacacacacacacacacacacacaaacaauacucagccugggauuggaggccuuaagggcaagacuaacagggugguucagacaggucugaugaugcaacccucaguguaaugcccaaccagguaaugcagccuucaguauaaugacaagucuggugaugcagcccucaguguagugcccaugauagugauguggccuucaguauaaugacaaaucuggugaugcagcucccaguguagugcccaucagaguaaugcaaccuucaguagaauaacaaguagauguagccuuuagugugaugccaggauaguauugaggccaaaaauguaucuuaaauaugacuuugguucugcagauagaugcuggcuggggcacuuggugcagugagaaggaaaggaaauuuguuuauucuugggaguaaauagccagacauucucuggcuauuccaggaguccaggguuuccuaccuugcuggccaaggcuggcuccauuagcccucguaagugccaugugaccucagcaggacaucaggcuuauuaguagagcagaaguucugcaggaauauuucagguuucaccgcaaugcuaaugaguucguuggggagaccuaagauggcagcugacagauauauacagaugccaguuccuccugaaaggagcguaggaauguuuguggauacaggcggcugaacaaauggguguggagaguuaaucauggaagggcacaguuguuacuugaauggaugcaaguguguggcuucugugugauuaacauguuagugaauaacauguuuuuggcuccuggugagcauacauguggguaccuggcuguucaggagagcacacagagggccauggguguucacagggaggcguucaccugugugaugggcucucaugcuggcacauguggcagagcuauuugugaguauggguaugugcacuucuguccauggcugcagaauuauccaggauaaaagcaauggccaggugcaguggcuuauaccuauuaucucagcgcuuugagaggccaaagugggaggaucacuugaacccaggaguucaagaccaaccugggcaacauugugagauccugucucuacaacaaaauauguaaaaaucagccaggcaugguggugcaugccuguaaucccagcuauucaggaaaucgaggcugucuguacaaaaaguacaaaaauuagcugggcguggugguacccgcccguggucccagcuacuugggaggccaaggcaggaggaucacuugagcucaggaguucaagaccagucugggcaacauagggagauccugucucuacagcaaaaaguauaaaaaauuagccaggcaugguggugcaugccuuuaaucccagcuacucaggaagucgaggcuccagugagcuaugaucgcaccagcacuccagccuaggugacacagugagaccuugucucuaaaaagaaaccagaaaaggcugggugauccucccaccuggucuugaacuccugggcucucaccuguaaucccagcacuuugggaggccaaggcagguggaucacuugaguggaguucaagaccagccuggccaacauggugaaaacccaucucuacuaaauacaaaauauaaaaauuagccaggcacagugguggguuccuguaauccuagcuacucgggaagcugaggcaggagaaucgcuugaacccagaaggcagagguugcagugagccgagaucacgccauugcacuccagccugggcgacugagugagacuccaucucaaaaaaaaaaaaaaaaaagaugaaggcaaguaaacacagauauauccaguguccucaauaucaauauagagucggcugggcgcaguggcucacgccuguaaucccagcauuuugggaggcugaggugggcgaaucacgaggucaggagaucgagacccuccugguuaacacggugaaaccccgccucuacuaaaaauacaaaaaauuagccaggcuugguggcgggugccuguagucccagcuacucgggaggcugaggcaggagaguggagugaaccuaggaggcagagcuugcagugagccgagaucacgccacugcacuccagccugggugacaaagcgagacuccaucucgaaauauauauauauauauagucaguauauaaagugauuacgcagguugacuugugggcucacgaauuguacacagaaucuauggaaauagaauguuugugaacaugugugaacaaaaggaauguuuauugccauuggcaacagcacacagacauacauauccucuaaugcacaauggcguuucccuggauuuccacugaugugcacauaugugcauagcuaguuacaggcauguccagauacuccacaugugcccuaaacgugggaauucacaggugccuguggauaaacaacacaggcguccacaucugguugcagaaucccugugcacuccaaugccuacaugcugcucuuuuggaacacaaauaaccaaaucuccagaaauucucugaacuccuggcaaagcgagaucucaaagccaacaaagguggccucaaaagugcccucaggcucuuuucaaaggaguacagagggaaguucagagucaggugggugucugaguucucggccauccuggauagugagccaggaauacagagcccugagcacagcccugcucaccacaccaaccuuucuuucauuauguuuuuuguuuguuuguuuguuuguuuguuuguuuuugagacagagucucacucugucgcccaggcuggagugcagugacgcgaucucagcucacugcaaccucugccuuccaggcucaagcaagucuaauuccucagccucccaaguaguuggaauuacaggcacaggccacuguauccagcuuccuuccuucccucccucccucccuuucuuucuucuuuccuuccuuuuuuuuuuuucuccuuucuuucuuuccguccucuuuccuucuuuccuucuuucuuuuccuuccuuccuuucuuucuuuuucuuuccuucuuucuuuccuuccuuuuucuuucuuuccuuccuuccuuuuuccuuccuuccuuccucacucucuuucuuucccucccuucccucccucccucccuucccucccuccccgcuuccuucccucccuuccuccuucccucccuccccccucccucccuuccuuccuuccuuccuuccuuccuuccuuccuuccuuccuuccccuucccuccccuucccuuucccuuucccuccccuucccuccccucuccucucuugaaacaaggucuugcucugucacucaggcuggagugcagugcugcaaucauagcucacugcagccucaaccuccugggcucaagucauccucccaacucagccugcugaguaguugggacuacaggcaugcaucaccaugcucagcuaaucuuuaauuuuuuuguagagacaggguuuuacaauguuguccgagcgggucucaaacuccuagguucaagcgacccuccugccucagccacccgaagcgcuucaccagccuuuuuuagcugggauuucucuccccacccccaucacguuucacaccuuucccccaucagagcuaaguauggggggcaaugcaaagaaaggugcccggcacaaggaagggugcagugcgugguagagaccgugguuuuuauugagucgaaucaugauuacuaucaugaauauucuccaccaguguggugcagagagaucccggcccuuuucugucucauuuuccagccuuuucucacaccuccugcgugugcuuguguccaccguggugugccuccaucauccacugaugcagcuccgucaguuucucuccuucccugcuccagcuggagaagguccaucuuuucaagucaucccucuccuccccuucccagguuuccucucucggcaguuagcucuucccugacaccucucuucauuuucauuugccuccuguuggccauggggugggugggagucagagagucuguuuggaauugaaagccuccuaaccggcccagggaaguaggagcuuuauguaaggaaugcaggggaucucacaaaacccaauagcuggggcuccagggaccuagaaagccaugauucgcucauuugucaauucggucaacagauauuuauuaugcaccuacuaugugccagggggacacgugagacaaggcacuugcucuuguggaacugacauuguggugggaggagaucaauaacaaacaaauaaacaagaaauuaucaucuggccauaagcgcaguacagagggcuaaacaguauccggcggggguggggcgggugugguggcucacauauauauguaaucccagcacuuugggaggcugaggugggaggauugcuuggucccaggaguucaagaccagacugggcaacauagugaaacccuaucucuaaaaaaaaauacagaaauuggccaggcaugguggcgugcaccuguagucccagcuacuugggaggcugaaaugggaggaucacuggggcccagaggucgaggcugcagugagccaugguuacaccacuguacuccagucugggugacagagcaagacucugucucaaaaaagaaaagagaagaacaaaacaaguagaugggagagaguaugagugggugagccccauuauguugggucacugggguaagcucuuuggggagcugauugagaaggagccagggagacgggcaucaugagagagggagcugcaugugcagaggcccugagguugaaacaagcauagugcacucuggaaagagaaggcuggagagggagagagaauggaguuguagagguuggcagggaacacugcauucgaggcuucuggccacagugaacuguuggcuuuuauucuuuuuuuuuuuuuaauugagauggaaucucauucuguugcccaggcuggagugcaguggugcaaacuuggcucgcugcagccuccaccucccggguucaagugauucuccugccucagccucccaaguagcugggauuacagguggcugccaccacgccugucuaauuuuuguauuuuuaguagagaugggguuuugccauguuggcugggcuggucucgaacuccugaccucaagugauccaccuaccucggccucccaaaguuguuggcuuuuauuccaaacgcagugagaagcugcuggacgauuugccgugggguggagggacuugaucugauucacauuauuuaaagaucucucuagcugcuggguuggguaauggauucccggaagugagaguagaaucagaaggaccgagcaagcccgguguuaucugaaccagaacagugguagcuggaauggugagcagugggcagacugguacaucucagaagcagagccgucagcacuugcugauggaucagaugugaugaauugggggaagagaggaacacagaaauggcgugguggcuggagagacuuauaaggcccagggagaauuucuuaaagauaaggagggggccaagcacaguggcucaugccuguaauuccagaacuuugggagguugaggcaggaggaucgcaugagcccaggaauuugagaccacccugggcaacauagcaagacccagucuccacacacaaaaaaauuuuuuuuuuuuuugagacggagucucauuguugcucaggcuggagugcaauggcacaaucucuguucacugcaaccuccaccucccggguucaagcaauucuccugccucagccuccuaaguagcugggauuacaggcgcccgccaccacacccagcuaauauuugcauuuuuaguagagaagagguuucaucauguuggccaggcuggucucgaacuccugaccucaggugaucugccugccuuggccucccaaaguacugagauuacaggcaugagccaacacucccagcacaaaaaauuuuuuuaaaaaaauuagcuggggccaggcgcuauggcucaugccuguaaucccagcacuuugggaggccgagguggguguaucaccugaggucaggaguucgagaccacccugaccaacauggugaaaucccgugucugucucaaaaaaaaaaaaaaaaauuagcugggcacaguagcaugcaucuauagucccagcuacuuggaaggcugaggugugggaggauugcuugagcccaggaggucgagguugcagugagcuaugaucacgccacugugcuccagccugggugacagagcgagacccugucuaaaaguaaaaauaaaauaaaagacaaggagaaucaaggcagaacagacaucagacaggucacucugcauguuaauagccaggaaguaacaaugauccgaacccccuuccaugcuccaugggaagaaagccagugugucccccaagauuuuugugacucuguggaggagccugaauugucuuggucacugugcuucugacuucuugcuucugcugaauuauuauuccccaccuggcaucucaugcccuuggguuuuugcucugaccuuuacugagaccgggagggagcucagccccugaggucauggagagccucaaaugccaggccaagucacucagacuagauccugaaaacagcggagccauuuauccauucguguauuuauuuauucaacaaguauuuuguuuuuauuuuauuuuauuuuugagacagagucucauucugucguccaggcuggagugcaguggcgcgaucccagcucacggcagccucaaccucccuaggcucaggcaauccucccaccucagccuccugaguagcugggacuacaggcucacaccaccaugccuucuaauuuuuuuuuuuuuuuuuuuuugagacgaagucucacucuguugcccaggcuagaguguaguggugggaucuuggcucacugcaaccuccaccucuggguucaagugauucuccugccucagccucccaaguagcugggauuacaggcaugcaccaccaugccugccuaauuuuuguauuuuuaguagagaugggguuucaccauuuuggccaggcuggucuugaacuccugaccucaggugaucugcccaccuuggccucccaaagugcugggauuacaggugugagccaccacaucuggcccacauccucuaauuuuuuguagagacagggucucgcuauguugcccgggcuggucuugaacuccugggcucaagcgauccacccgucucagccuuucaaacugcuaggauuauaggugugagccacugcacccucaacaaguguuuuugaggacuucuuauaugcuuuuaagggagaaauuauauucaaccaaacagacauggauguguggcgcuuucugcaaaacagggagguaggugaugauuauguaguugcaaauaaauauaauuggcagcugugauuaacagcuuugagggaaagauucuuggugcucuaguagcuucuaauaaggagauuugauguaauuuggaagucagaggaagcaagagcugagaucugaugcagagaggaaaggaugcucugcgcagagggaauugcuuaugcaaaggcccugggguaagaggaaggauggaaaauaugauggacuaaagaaggccuugcaaggccaggugaggugguggcucacaccuauaaucccagcacuuucggaggccggggugggaggauggcuugagccaggaguuccaggcugcaguaagcuacacuugugccacugcacuccagccuggguaacagagcaagacucugucucuaaaaaaaauuaaaauaggcugggcgcuguggcucacgccuguaaucccagcacuuugggaggcugaggcgggcggaucacaaggugaggagauugagaccauccuggcuaacacagugaaacccugucucuacuaaaaauacaaaaauuagucgggcgugguggcgggcgccuguagucccagcuacucgggaggcugaggcaggagaauggcaugaacccgggacgcggagcuugcagugagccaagaucgcgccacugcacuccauccagccugggcaacagagcaagacuccgucucaaaaaaaaaaaaaaaaaaaaaaauuaaaauaaaguaaagaaggccugggaacgaggagaccagaugaaagcagagaaguaaguaaagugcagagccacaggcucuuguggcgacauuaaggaguuuuaucucuauccuaagaauaaaaggaauccaccaauaugguuuuggccgggaggauaauaugaucacacgugcguuguaaaguuucccagcuuucagaggccaaggcgggugaaucacuugaggucaggaguuugagaccagccuggccaacauggugaaacccugucucuacuaaaaauacaaaaauuagccaggugugguggcgugggccuguaaucccagcuacucaguaggcuggggcaggagaaucacuugaacccuggagguggagguugcagugagcugagauggcaccacugcacuccagccuggacgacagagcgagacucggucuaaaaauauaaauaaauaauaaaaauaaauaaaguuucccagaagcucccauguguagaguuacuagcaagaaaaaagguagauugagguagaccgaauagacuuuauuuuuauuuaaauguuuugucauauuuuacauuuauuuauuuauuuauuuauuugagacagggucucacucugucacccaggcuggaguguaguggugugaucacggcucacugaagccuugacuucucaggcucaagugaucccccaccucagcuucccgaguagcugggacuacaggcgugugccaccacaccccgcuaauuaaaaaaaaauuuuuuuuuugguacaguuaggguccuaguauguugcccaggcuggucucaaacuccuaggaucaagcaguccucccaccucggccucccaaagugcugggauaacaggcauaagccacugcacacagccuagacuugcugaauugugaaaguggcuuggaccauugcauggugauagagaugaagaaugaugcaugaauucuaaagcuaucuaggaguuaacaucaguaggauuuggugagggaguaaaaugagggugaggauaaugcccgggugucugacccacuggcccggggguggggaggauggagauggugacauaaggaauguuggauaagaacuagguuagggagggaaggcugugcacuucaguuugagcauguugggcuugagaugccuuagagauaucuggggcagggggagcggucaaggagucagaugaugaauauaugcauuggagcucugaggacauauauacaggcagguguugauggacgcuuugguaagggucagacuccuuagagaaagauaaagagaaaaugcaaggcuaagucuagagcugugguucucaaccgaggagugggaaguuauuuuauuuauguauuuuuuuaauuuuuuauucuuuugagacggaguuuugcucuuguugcccaggcuggagugcaauggugcaaucucggcucacugcaaccucugccuccuggguucaagccauucucguggcucagccucccgaguagcugggauuacaagcaggcaccaccacaccuggcuaauuuuguauuuuuaguagagacgggguuucuccguguuggucaggguggucucgaacuccugacuucaggugaucugcccgccucagccucccaaagugcugggauuacaggcgugagccacugcaccuggcuuuauuuuauuuauuuauuauuauuauuauuauuauuauuauuauuauuauugagagagagucucacucuguugcccaggcuggagugcagugacaccaucccgguuucacugcagccgugacuuaccugggcucaggugacagcagguuuugacccuuccuguuuagcacauguuaccaugaucucugcucacugcaaccuccccuucccggguucaagugguucuccugccucagccuccugaguagcugggauuacaggcgugcgccaccacggccggcuaauuuuuguauuuuuaguagauaugggguuucaccauguuggccaggcuggucucgaacuccuggccucaagugauccauccgccuuggccucccaaaguugcugggauuacaggagugagccaccaugcccgaccaagaaaacccucuugaaugcucucuccugaacuccugaccugagguuuggugucugaggcuggggagagcucagauagagggauguucaacucuaguaucuaugaggugagacucaggaugguucuuguaacgucuugaaaccucuugaagauuuaugcuguguguaauagcucaucaagaaacccugguaauaauccuugaaauagaccugcgaacucugcuuuaaugaauuuuacaugauggcguuggagaaaugaaauccccuuacccucauuaauccugagacacagcaaucauuugcaguagacguucacccaagaggccccaaacacuuuaagagaagugcuccacacgugagaaggugcccaggaaggggaaauuucugccaugaaauccucaccugauugugaacguucuacuagggcaggguguacccagguacugagauagaccaggcucagcucagguuccaagacgggggguucacucaaguccuggaacagaacacagauacauccccaagguguuaagaugcuccaugauuggccgggugcgguggcucacgccuguaaucccagcacuuugggagguggaggcggguggaucaccugagguugggaguucgagaccacccuggcuaacauggugaaacccagucucuacuaaaaauacaaaaauuagcugggcauggugguaggcgccuguaaucccagcuacuugggaggcugaggcgggagaaucacuugaaccugggagguggaggcugcagugagcugaaauugugccauugcacuccagccugggcaacagagcgagacucugucucaaaaaaaaaaagaaaaagaaaaaaaauaaaagaugccuugugguuugacucuaugacagacuagagucaagcccaagccuuggacagacaaaggcuuaacugggagagaccaaagagaaaccugguucuaagagaugaagagggccaggaccaaauccgaguccuggguagaucagggcuacgcuguggacuugagauagacaaggccaaacccaaguacugagauagaccagaguuuaacuugaauccugagauggaccagggcugaacccacauccugagacagaucagaccagaaccuugugaggagagaaccagaaaaugggcuuaucuuagagaaguugugggagaacagguuugcucucccuacuuguugagccgcgucacccaaacugucgagugccucugggaugaauggccauugcagaugacuuggaaugucccaggacucaugaggggaugagaauuuuauuuuuauuugauuugauuugacacagagucuugcucugucacccaggcuggagugcaguggcgucaucugccuccugggcucaagugauucucccaccucagccuccugaguagcuggaacuacaggcacccgccaccaagccuagcuaauuuucguauuuuuaguagagacaggguuuugccauguuggccaggcuggucucgaacuccuggccucaagugauccacccaccuuggccucccaaagugcugggauuacaggcgugaggcaccgcacacagccagaauuuuauuucccaaugccaggucauccuaggauccaagguugagccaggucaggcccaugagccaacagcacuagggaugcccaggguggcugucccucccugugguguuggcuguauguacucugauacagacuugagugaugcccccacuccauauaggcugucacacccaggguaucacauauccacacagcagcagauacacacaugcacacacacagucacaccaacccaugcacgugccucagauacacagcaacacguggcacagacaugcacauugacaccccaaacccuggcacacacacguacagaccacaucacagucuuacaaacacagccaacuggcacacucagacauagcccuccucacuaugccaguuucacaucugcaauagugcccgacuccagggucaugguguucucggagaacagugucccuggaguuuucucacuuaucuaucaucugacaccauccuguuuuauacauucauaugcauaguuuuauacacuugcugaugcucacacacauaaaccuauauauagcuaccugcucauguguguucuugaucauguagacacagacgugccacaccucagucucacacacucacuggcucugugccagucagcauaggcuagguuuugcuguauaacaaaacagcccccaagucucagaggguuaguacaaccaaaugagcuuuugcucaugauacaugaggguuggcagggucucugccuagucuggccacucagggaccccagugauggaggcuucauaccaacaugcacuuuuuuuuuuuuuuuugagauggagucuugcucuguugccaggcuggagugcaguggugccaucucagcucaccucugccucccgguucaagcaauucuccugccucagccucccaaguagcugggacuacaggcacgugccagcacaccuggcuaauuuuuauauuuuuaguagagacaggauuucaccauguuggccaggcuggucucgaacuccugaccucaagugauucaccuaccucggccucccaaagugcugggauuacagaugugagccacugugccuggccccagcaugcacuuuuuuuuuuuuuuuuuccgagauggagucucgcucuguugcccaggcuguagugcaguggcacgaucucggcucacugcaaccucugccuccagguucaagugauucuccugccucagccuccuaaguagcugggauuacaggcacccaccaccaggccuggcuaauuuuuguauuuuuaguagagacuggguuucaccauguugaccaggcuggucuugaacuccugaccucaggugaucugcgugccucagccuaccaaagugcugggauuacaagugugagccacugcacccagcccaacaugcccuucugcgguugcugagggaagacuguggcacugcacacuggcuugccucuuuuuuucuucguuguuucagagacaggguuuugcucugugcccaggcuggagugcaguggugugaucacagcucacugcagccuccaacuccugggcuuaaacaauccuccugccucagccuccugaguagcugggaauauaagugugcaccuccaugcccgauaaauuuuuaaaauauuuuguagaauaggggucuugcuauguugcccaggcuguucucaaacuccuggccucaagcaguucuccugccuuggccucccaaagugcugggauuacaggugugagccaccacaccugguccacaccggcucuuaaaguauucaccuggaagucacugccguuuaaaaggcauuggcuaaaggaagucacguggccacacuggggaaguccuacagccccaucaugugccuaagagaaaagaacuagaaaaugugucaacaguucuguugacuacugcagucucuuacauguuccaacaguuacucacuccuguagacacguccacaugcacgcacuuuauuccuucucacgggcacccauucucaugaccuguuuccuuccuugaggcagggcaggaggccacagugcccgcccccuccccccagagucuucccuuagcuucagauacaucagggggaucucccugucucuguugagcugggggucccagggguaaugaguuucugagcugcagcuagagcuggagcugagaaaacagugcagacaccuucucugcccccggagugggugguauuuuuccacagacacuggggaagaagaauaauaggugcugguagaugucuccaccagcccagcgccuuccccgucuugccagcugcagcuuggaagaggggagcccagagggaagagaaggcaaaaccagagagaccccuguccucccgacccgugugagcucccagcgccacuggggacccuucguuguccccucuccucccggcuccuccuucugacuacucaaauauuccaaggcaggaaacucaugaauauuuauaggggccuggcagugaggcagauauaaaaaaaaaaaaauuggaauuuaugaaccaggauucgucuauaaauaacaggccuguggcuggugggguucuucccucacccacaacauugcuucaacugcagcuccagccccauccaaagcucacagagccuccccuucacacacauacacacagcuucacuguggaugcacaauuucccauccgccagugcauuggcgcacacacacgcauucauacccagccgaacacacagacacguguucacaccugccugggucuggcccacugccucccuuccacucacagacaccccgaugcaaagugagccugaaugcauccuccucuguccacauucgggcugaugcagccacucacacugcaucugcacaaaacacacaguugggcugggugugguggcuuaugucuguaaucccaauacuuugagaggcugaggcaggaggauugcuugagcccaggaguuugagaccagccugggcaacauagugagacccuaucucuacaaaagaagacaaacauuuacuaggcaugguggcaugcaccuguagucccagcuacuugggaggcugaggugggaggauugcuugagccugggagauugacacugugugugcugugaucgcgccacugcacuccagccugggcaacagagcaagagccuaucucaaaaacaaaaaacaaaauacaaaaaacacacaguugcacacauacacaccauggagagacacauggccacagcucacucccuaacccaugacccaagcacacccccuccccucuccaggccucaguuuccucacccacauaaggggcacaccgagaguuccuaccucauaugguuguugugcagaauuguuuuuuuuuuuuugagacggagucucgcucugucacccaggcuagagugcaguggcgcaaucuuggcucacugcaaccucugccucccggcuucaagccauucuccugccucagccucccaaguagcugggacuacaggcacccgccaccaugcccggcuaauuuuuuacauuuuuaguagagacgggguuucaccguguuagccaggauggucucgaucuccugaccuugugauccgcccgccucggccucccaaagugcugggauuacaggcgugagccaccgugcccggcagaauuuuaaaaauaacaaauggauaccaggugccuguugugugcaagaugaucuauuuuaagugcuggcaacacagcagugaacaaaaacagguaaaaacuccugccugacguucuggaggggaagaaagauaauuugcaaaauuaaugcauaaaugauguggcggaagcagauggaguagggaaguggauggggggugcuggggcacuuguaguucuggccaggggagaucagggaagguuuguuuuuuguuuuuuuuuuuugagguaaggucucacugucgcccagacuggaguguagucgcaugaucucagcucaccgcaaccuccgccccccaggcucaagcgauucuccugccucagccucccgaguagcugggauuacaggcacgcaccaccacacccggcuaauuuuuguauuuuuaguagagacggggguuucaccauguuagccaggcuggucucgaacucccgaccucaaaugauccacccaccucagccucccaaagugcugggauuacagacaugagccacugcgccaggccagcagggagggucuuuugagacaaugacauuucaguaagggucugaaggagguggaaggacauuucaggcagaggggauagccagugcaaagaggugauauagaagaaauauguuugggguuuugcaggaacaguguggcuggaacagagugagugagagggagaguggaaggaagugagggcagggaggugaugggacagauugugaaggaguuacgugccuuggggagaacucuacuuugagacaaggagagaucauggcucaccacagccucgaccucccaggcucaagcgauccucccacuucagccuccuguguagaagggacuacagacacaugccaccacuuccggcuuauuuuuuaauuuuuuguagagauggggucucacuauguugccuaggcuggucucaaacuccugggcucaagugauccucuggccucaaaauacugggauuacagguguaaucacgcuuggcugaggauuugggcuuuuaacucaggggagaugggagccauggaggguucucagcacgggagagacucagugugauucauguguucacaggugcucucuggcugcugugggggaagcagacugugggggcaaguagggggaacugggagaccauggaagggaugaacucugcugguucaggugagcaaugccaggggcuugaccauggagauggccaucaagaggguagagcaauggguagauucuaaagguaaggcugaugcauugguauaagagaaagagagggugggcggugcggugguucaugccuguaaucccaacacuuugggaggccgaggcaaguggaucacuugagguuaggaguuugagaccagccuggccaacauggagaaaccucaucucuacuaaaaauacaaaaauuagcugggggugguggugugugccuguaaucccagcuacucgggaggcugaggcaggagaaucgcuuuaacccgggagguggagguugcuguaagccaagaucacaccacugcacuccagccugggcaacaagagcgagacuccaucuaaaaaaaaaaugaaagaaaaagaaaaauuggguggauucuguuugcaagugaauguacuuaaacgauuuauucuugaaugccagagauguuuauugaacaccugcugcgugccaggcacuguucuguuuugaggacacagcaaugaacaaagugauaaaaauuccugcccuuuggggaguguacauaugagagcgacagacaagaaauaauaugaggccaggcacgguggcucacaccuguaaucccaacacugggaggccgaggcaggcagaucaccugaggucaggaguuugagaccagccuggccaacauggugaaaccuugucuccacuaaaaauacaaaauuagccaggcgugguggcacaugccuguaaucccagcuacuugggaggcugaggcaggagagucgcuuggacccaggaggcagagguugcagugagcugagauuuaaaaaaaagaaagaaagaaaaagaaacgagaugaauguaaggugcggaaaaaugcaucagggaugguccuggagcaugacaggggcugcacauguggacgaggcagacugggcagaaucgaggaugcauuucgaagugagggcugcuuucgggguugugcaggauggauugccuauuuagguggaaaugacagaacucggugccagggugugaaugugaaccugaagggacacugacauaaauacccucuuagggcccagugcgguaauaccaacauguugggaggccaaggugggcagaucaccugaggucaggaguucgagaccagccuggccaacauggugaaaccccauuucuacuaaaaauacaaaaaauuagcugggcaugguggugugugccuguaaucccagcuacucgggaggauggggcaggagaaucacuugaaccuggaaggcagagguugcagugagccaagaucacuccauuguacuccagccugggcaacaagagcgaaacucugucucaaaaaacaaaaacaaaaacaaaaacccucuuagguugaauguucaucauuucccccaucuuagguuggguuccugagaagcagaacuagagacguaaguuuccagcacuuuuuuuuuuucuuuuuugagacagggucuugcuccguugcccaggcuggagugcaggggugcaaucauggcucacugcagccucaaccuucugggcucuagcaauccucccaccucagccucccauguagcugggacuacaggugugcgccaccacaccugguuaauuuuuuaaucuuuuguagagacagggucuugcuguguugccuagccuggucuuaaacuccugggcucaaugauccuccugccucggccucccaaaguacugggauuacaggcaugagccaccgugccugacuguggagcacauaauugaaagucagggcaggggugaggggagcaggaccuggaagagaauagauugagcaaagaugagauccuagguaaagucccgguuuggcuugcuccacaaggguggggggacacuguggaguuaucucaccaugagaagaggagugggcuuuuuaccccugcaucagucauuagcugccccugggaguaggugacaccucccaagcaucuccaaggugugguggcucccaaaagccaugggcagguccagagaagaucacagcugcuagcaaugagccgccgugcucagcagcugcaggguggguacaucuaggcagucagcagcucugggcagagccccaggagcaucucccacacucccccagcccuaacgaggggggucauaggagcaccaggcauuugugccaaucacagcguggaugucugacaccagaccauguucucagcucucuugggaugaaaaccaggccaacuuggcacuggggcuccucugacacagcugagauuuuuuccggauucauuaacugccggagacucagcccucugccucccagucugggaauugcagucugggaaugggucagaaucacucacucaacaguaaggcacuacuaucacucccauuuugcagguggggaaagugaggcacagagagguuaagucacuuucccauggucacacagcuagaaagagaagccggguuuugaaguucaaguugucggccuccaggguccaugugcuucacagcuacacucaacuaccuuugacuccaugaccgcuucaaaacccagagccccuguauccacccugugaugggagaggaaggaggaagagagcagacagaggguguuggggagucggggaggaaggggucacauggaaaacuuggaguguacaggaagcauucauucauucauucauaucuugaugccuguccauugucuccagcaucugcugguguugggaccauagcauggaagaagacagacucagcccugcccuuuuggagcucacauccuaauggggcaugcagacacccaccaugcaaggaaaagaauaaaauauaagaacuuuguggagggaaggggcagggagcuguggagaugugcacaggaaggaacacagaccuaucuuagaugauggagaaggcuuccuggagguggugguguuugcugugagcucugaagaaugccuagaacuggcgaguccuagcuguagaaacaccagcaucucuacagucccauagaccuggggcuggagugcacuggcacaaucucggcucagugcaaccuccaccucccagguucaagcgauucuccugcaucagccucccgaguagcugggacuacaggcaccugccaccacacccggcuaauuuuauauauuuuugguagagaugggauuucaccauguuggccaggcugguuucgaacuccugaccuugugauccgccugccucagccucccaaagugcugggauuacaguccugagccacugugccugggcuuuuuuuuuuuuuuuuuuuaauuuuugagacagggucucacucugucacccaggcuggagugcaguggcaugaucacagcucauugcagccucaaccucccugggcucaggugauccuccucuuucagccucccaaguagcugggacuacaggugcgcaccaccaugccuggcuaaucuauguauuuuuguuagagacggaggucucacuauguuacccaggcuggucuugaacuccugggcucaagccauccuuucaccccggccucccaaagugcugggauuauaggugugagucaccaugcccagcuaagacuacugugauuuuaagcucugugugcgcaggcauucguucaaccuccgugacugcccuaagagggggaugcugcuguucaccucguuuuacagauggggaaacuggcgcaccaugaggcuuaagucacuugucugaggucauggcuaggagguggugcgaugaggucccccgugcacacaucgugcaugcaaaaugccuggcacacgggcaaugcuugacuaaacuggugaagauguuaucacuugcuggaugcugcucuuuggugcaugccauggcuagaggugauacugaagugcgugcucagccggggauggauacaggcgcuggcggguacaaugcaggcugauugaaggcccucugaguccugccaccuggcagagcagucuucagccuccucuggcuccacucccagcccuggagaagcuggggggccacgggccucucuccggcagcuuugacugggagcagcugcucagugcuuagccaggauugauuucccuuuaagcagcccauucucgcuaacaaaggucuccggugacccagguggccgccacuacccccuccccuccaagcagaggacgugccugccucuaggcuggagcuguuuucugccucugagauugauucaucugaaagucuugggcuuacccagagggaugggcugagucagccuggauaugcuuaccuggaauuuguuggauuuuugccuguguuuugcccuggccaguucaccuuucaugaucuccuuggccacauccuuuuuuuuuuuuugagauggagucucgcucuugucacccaggcuggaguucaguggugcgaucucggcucacuguaaccuccacccccggauucaagugauucuccugccucagccucccaaguagcugggacuacaggcacuugucaccacuccuggcuaauuuuuuuuguauuuuuuuuuuuuuaguagagaugggguuucaccaugcuggccaggcuggucucgaccuccuaaccucauguaauccacccaccuuggccucccaaaguggggggauuacaggugugagccacugcgccuggcuuuuuuuuuuauuuuuuuuaauagauagggucuugcucuguuccccaggcuggaaugcaguggcacaaucauagcucacuccugagcucaaacaauccucccaccucagccuccugaggugcugaggcuauaggcaugcaccaccaugcccagcuuauuuuuuaauuuuuuguagacacagcgucucacuacguugcccaggcuggucucaaacuccugaggccaagugauccacccaccucggccucccaaagugcugggauuacgagugugagccaccgcccagccccugaccacauuccuaccccacucacacacagcuaugggcugaauuguguguuuccaccccccaaaaauucauguauuuaauucuuuuuuuugagacggagucucacucugucgcccaggcuggagugcaguggugcggucuuggcucacugcaagcugcagcucccggguucacgccauucuccugccucagccucccgaguagcugggacuacaggcgcccgccaccuugccuggcuaauuuuuuguauuuuuaguagagacgggguuucacuguguuagccaggauggucucgaucuccugaccucacgauccacccaccucggccucccuaagagcugggauuacaggcaugagccaccgcgccuggccuuuuuuuuuucuuuuuugagacagggucucacucuguugcccaggcuggagugcaguggcguuaucacagcucacugcagccuugaccucccugggcugaggugauccucccuccucagccucccgaguagcugagauuaguggugcgagccaccacaccuggcuaauuuuuguauuuuuuguagagaugagguuuugccguguugcccaggcuagucucaaguaauugccugggcucaagccauccacccgccucggccuccucccacgguguugggauuauaggcgugagccaccacgcccagcccauauguuuaauucuuaacacccaguaccucacaaugaaugugacuguauuuggaggugggguuuuuuuaagaggugauuaaauuaaaaugaggccuuuggaaugggcccuaauccaacaugacucaugucuguauaagaaaaggagauuagguccgggugcaguagcucacaccugucgucccagcacuuugggaggcugaggugggaggaucacuugacagcaggaguucaagaccagccuaggccacacagcaagaccccccaacuguaaaaaaaaaaaaauuaaaaauuagugggacaugguggcaugcacauguagucccagcuacucgggaggcugagcugagaggaucccuugaguccaagagguugaggcuguagugaggcuugaaggaaccaacccugcugacaccucgacuucugacuuccggccuccagaacugugagacaaugcauuuuuguugcuuaugcugcccagccugggauacucagucaaggcagccugagcaaacucacaugcacgcccuuggaaguuuccuacccuugaguccaucuuagaguccaucucucaguagcccugcccggucaggcuacuguauagggcaucacuguauagggcagggucccaggaaaaagcauaguuccuucaaaagggauuccagaggacaauucucuggaaugaaaugacuguuuucagagaugugggcaagguuaauagaaggagcaaagggauguugaaaaucccugggguugccgggcacaguggcucaugccuguaaucccagcacuuugggaggccgaggcaggcagaucacuugaggucaggaguuugaggccagcuggccaacauggcaaaaccccgucucuacuaaaaauacaaaaauuugccgggugugguaguaggugccuguaaauucagcugcuugggaggcugaggcaggagaauugcuugaaccugggaggcagaggcugcagugagccuacauugcgucacugcacuccagccugggugacagagcaagacucugucucagaaaauccuugggucugcagcugagaggagcuauugcuacccccaggccacagagagagcgccaaagcugcagaaauguguguuuguuuacuaggucugcugucaugaagugcuuugggcuggguggcuuaaacaacagaaauuuaauuucucacaauccuagaggcuugaagucugaaaucaaagcauuaguuucuuuugaggccucucucauuggcuugcagguggccaccuucuuacuguaucuucacguggucuuuuccuaugugugugucuucaucuccucuuuuauuuauuuguauuauuuauuuauuuuuagagauggggucucgcucucuugcucagguuggagugcaguggugugaucacagcucacugcaaccucaaacaccuggucacaagugauccucccaccuuagccuccuaaagugcugggauuacaggugugccccaucacaccuggccccaacuccucauuaaacaacuuucagguuccucuguuugccaugcgucuuccuacuagagcagaagcuuuaugagguuggggaugucugcgcgucuccuggacaguagugaccccaguaccuagaacagugccuggcacauagugggugcucaguaaauauuucugggaugaacggaugcucugcccucccugccuuugcccaugcugacucucgcuccuacauccguaaacuuagcuauugcaucuuccagaaggccauugcuacacccucaaaaccaggcucugggccaggcacaguggcucgcaucuguaauccuggcacuuugggaggccgaggugggaggaucacuugagcucaacaguuuaagaccagaccgggcccaguggcuuaugccuguaaccccagcacuuuaggaggcugaggugggcagaucaccugaggucaggaguucgagaccagccuggccaacaugaugaaaccuugucucuacuaaaaauacaaaaauuagccaggcaugguggugugcaccuguagucccagcuacucaggaggcugagccaggagacucacuugaacccaggagacggagguugcagugagccgagaucuugccucugcacucuagccugggugacagagugagacuccaccucaaaagacaaaaaagaguucaagaccagccugggcaacauagcccaggcucuuaaaaauuuaaauauaauuuuuaaaaauuaaaaaacuuagccaggcgugguggcgcacaccuggagucccaguguauuaguucguucucauacugcuauaaagaaauaccugacacuggguaauuuauaaauaaaagagguuuaauuggcucacaguuccacaggcuguacaggaaccauagcuggggaggccucaggaaacugacauucauggcagggggugaaagggaagcaggcggguuuuacacggccagagcaggagcaagagagagacugggggaggugcuacacacguuuaaacaacgagagcuuggcuggguacgguggcucacgccuguaaucccagcacuuugggaggccgaggggggcagaucaccugagauugggaguuggugaccacccugaccaacauggagaaaccccgucucuacuaaaaauacaaaauuagccaggcgugguggcgcaugccugcaaucccaacuacuugagaggcugaggcaggagaaucgcuugaacccgggaggcggagguugcaacgagcugagauugcgccauuguaccuggguaacaagagugaaacugucucaaaauaaauaaacaaacaaacagcgagaucucauaagaacucacuccuuaucaggagaacagcaaggggaaaccuagccccaugauccagucaccucccacugggccccuauuccagcauuggggauuacaauuugacaugagauuugaacgggacacaaauccagacccuaucacucagccacucaggaggccgaggugggaggaucgcuugaguccaggagguugaggcugcagugagccaugacugcgccacugugcuccagccugggcuaccgagucucaaacaagcaaacaaaaaauucaggcucuggagcccagagauagagcccaggucuuccaguguucugugcuucccugcaucguggcacuuaucacacccuguuauaauugccucuuccuuuuucuuucuuccuugcuuaucugugaauguggggaagcuguggagggugcuguccuaucuggaaaacagccacugguauuuccugagcacucucucugaaccagggcuugaagcacuuccguuguauuagcucgcuggagccucaaaaugccgacagggucaucucaucaccuacugccaguuucccuguuugagaaaugaaacugaugccaggugcucaugucuguaaucccagcuacuagggaggcugagacaggagaacugcuugaaccugggauguggaggcugcagugagcugagauugugccauugcacuccagcccgggugacaagagugaaacuccaucucaaaaaaaaaaaaaaaaaaaaaaaaagagagaaaugaaacugaggcucagagagagucacuuguccaggguaacacagagccaagauugaagcucagaugguccagcccaccuuucuguguucccagucagcaccgauuugcuuauuuuuauuccauaggcaauucugucacacucccuugaauaucacguugcguaugugucccggccuguuugcuguuacuauaacagacuaccacagauuggguaauuuauaaagggcugggugugguggcucacgccuguaauccgagcaccuaggcagccaagguggaaggguugcuugagcccaggaguucaagacccaccugggcaauguggccagaccccaugacuacacagauuuuuuaaauuagccagaugugguggcacguguguagucccagcuacucaggaggcuaaggcagggggaucgacugagccuggaauguugagacugugaugagucaggaucgcaucauugcacuccagccugggcaacagaaccagaccucaucuguaaaauaaucaauuaauuaaucuuucuuaaaaaaaaaaauuuauuuuuccaguucuggagacugggaaguccaagggcauagcaccagccucuggcaaagguuaucccauggccaaagggcugaaggcaaaagugacacagagagaggaaauuggaccaaaaucauucuuguugucaauagcccacugccaugauaacuaacccacuucccugauaauggcauuaauucaccuaaccucaucuuuaaaggugcuaccucucaacacuguuacuuuuuuuauuuuuauuuuauuguauuuauuuauuuauuuauuuauuuauuuauuuauuuauuuuugagacagaguuucucucuuguugcccaggcuggagugcaauggcacaaucuuggcucaccgcaaccuccgccucccgaguuccagccauucuccugccucggccuacagaguagcugggauuacaggcaugugccaccacgccuggcuaauuuuguauuuuuaguagagacgggguuucuccauguuggucaggcuggucuugaacuccugaccucaggugaucugcccgccucagccucccaaagugcugggauuacaggugugagccaccgcaccuggccauauuuuuuuuuuuuuuuuuuugagauggagucucacucugucgccaaggcuggagugcaguggcaccaucucggcucaucgcaaccuucaccuaccugguucaagcgauucucaucccucagccucccgaguagcugggauuacaggcgcccgccaucaugcccagcuaaauuuuguauuuuuacuagaggcaggauuucaccauguuggccaggcuggucucgaacuccuggccuuaagugaucugccccccuugaccucccaaaguguugggauuacaggugugagccaccgcacccagccucugaaguagcuauucuucuguuucuuuacuucucuaauaaacuugcuuucacuuuaaauaaauaaauaaauaaaauggauuacguuuccaacacaugaauuuugcggggacacauucaaaccauaacauuacguuaagccauucugauauauuaacaaccaccucaugacaucaguacuauucuuagcuauauacucuaacugggggaacggaggcacaggaugguuaagucaguagcccaaggucacacggcagaccugaggcucgaaccuaggagacccuuaaugaccacguccucccaccuccacugggggaauugaaugcauuugagacucauuucuuugaaacccuggaauguguguuggagguguagccaagggauaaaggguuuggacccagaguggacuugccacccgcaggggcgcauggggaccuagcaggaaagagcccuuggagguggguuuucaggaguccugguaccuggcugucuguuauuggcagguugaucaaugucaccuccuggcugugcuguccagccuucgaggccucccuccagccgcugccugggggacucgcagcaaacacuuccauuuuguauaggggugucccuggcuaucggugugaaaugccucagccagccauggaaguuaaaugucccccauggcgaccuuuuccacacgcggacggauugauuucagaaauccauccccggccaaagcgcccagccccagccccuaccacgggcgcugauggcugcaaauuuauauccaggccagaaauugaauuccuguaaguugaaggaacuaucugaaaagcucacccaggcucauuuuuacgucugaaaaacuucaggcaagagauuaaauuggggccagugucucccagcaguagggaccucgguggcggggagaugaccucgcugaagacagcuucuuuagauucucugccuucagcuuggccuccuggggcugagaaauaaaaagcagugagaccugcaggccugcauggcuaaagggauucccacuucugaccagcuaauguuagaaaagggacaugcucuguguacccaaggcaggcuuuugguccccgugguagcuauugagcuauucagagggacaggaaauaaaacugcuaauucaggccaggugcaguggcucauaccuguaaucccagcaccuuggggaggccgaggugggaggauugcuugagcucaggaguuugagacagggcgauacccugucucugugagaaaaaacaaacaaaaaacaaaagaaaaacaacaacaacaaacaaccagaugugcugguaagugccuguggucccagcuacccgggaggcugaggugggaggaucaccugagccagggaagucgaagcugcagugagucgugaucgugccacugcacuccagccugucucaaaaaaaaaaaaaagcugcuaauucaucuucauccccggccaggccccugcaccagcuccuaaggccaccucagucccagcaaauuggcgagguucuaauuaagcuuccuugggcuguggcagagaggacaucagagucuguggaucauuccagaacccucgcucuucccugcccccugccagaggcaugaaggcuggggaaggagaagcagauaaaucaagugacagcuccgugaaggaagaaaccccaucuugcuagaaagaucucucucgccugccuugaaaaaaugagacugaugcaaaugcggcugcuucucuuugguacaaaagcccuuaaauauuaaagaaaugaauccuugaugucuacaaagaaaggaucaaaaacaaaucuuucugaaaggagaaaagcuuuuauuucgccgugaacucuucuagaucuagccucuggcagggaugccugcggaacagggagcacaggaagauaaagcucucagugauggccauucaauauuuguucauuuaggaagcgucugaagcagcuacugcauuggguuacaggcuggggaaacguccagcaaagugaggccacaguuccugcccucaaaagccauuaggggacgggugcagugucucaugccuguaaucccagcacuuugugaggccgaggcaggaggauuacuugagcucaggaguucaagaccagucugggcaacacagcaagaccuugucucuaaaaaauaaaauaaaagacugggugcgguggcucaugccuguaaucccagcacuuugggaggccaggguggguggaucacuugaggucagcaauuugagaccagccuggccaacauggugaaaccccaucucuacuaaaaauagaaaaguuagccaggcaugguggugcacaccuguagucccagcuacuugggaggcugaggcaggagaaucgcuugaacccaggagguagagguugcagugagccgagauggcuccacugcaccccagccugggcgacagagggagacucuaucucaaaaauaaauaaauaaaauaaaagccggugguggcugggcaugauggcuuaugucuguaaugccaccacuuugggaggcuuaggugggagggucacuuaaggucaggaguuugagucuagccugggcaacauagugagacccccaucucucuuaaaaaaaaaaaaaaaaaggccaguggggcauucuccaaaacucccuggccaguaauccucaaaacugucaaggucagaaaaaacaagacagaaacgucauagaccagauaagucuaaagacaugugauaaccacugaguguaacgugggauccugcauuagauucuggaacagaaaaagcacucaagugggaaaacuggggaauuugaauaaagucuagaguuuaguuaauaguaauggaugcacggauguugauuucuuaguugugacaaguguaucaugguuauguaagauguaauaacagggaagucaggaugagagguacacaggagcucucuguauuauuguuguaacuuuucuguaaaccuaaaauaauuccaaaaguaaaaguugauuagguaggcaugguggcccacaccuguaauuucagcgcuuugggagaccaagaugggaagaucgcuugaggucaggaguucgagacuagcuugggaaacauagugagauccugucucuacaaaaaaaaaaaaaaaaaaaaaaaaaaaaaaaaaaauuagcugggcaugauaguguacaucgguagucccagcuacuugggaggcuaaggugggaggauugcucgagucugggagguugaggcugcagugagccaugaucacaccaaugugggacacggccugggggacagagcaagacccuaucucaaaacaaaaauaaaaauaaaaaaaguaucagggugugguggcacacaccuguggucucagcuacuccggaggcugaagcaagagaacugcuugagccuaggaggcugaagaugcagugagcuaugaucaugccccugcacuccagccuggacaacugcuugagacccugucucuuaaaaaaccaaaaauguuggccaggugugauggcucacgccuguaaacacaauacucugggaggcugaggcagguggaucccuucaacccaggaguucaagaccagccugggcaacauggugaaaccccgucucuacaaaaaauacaaaaauuagccuggcgugguggugugcaccuguagucccagcuacucagggagcugaaaugagaggauggcuugagccugggagguggagguugcagugagcagugaucgcgccgugauuacaccacugcacuccagccugcgcggcagagugagacccugaaggaagugacucuuguccucccagcauaguggcugagagucugauaggcuggcauccaaaucccagcucugugaauuuggguaacuugacuuuucucuguaucucaguuuucccaucuguagaauggagcuaguguuaguaccuaccaugagauggggcucuaaggauugaauuuugguaauauuuguaaagcaacuaagaagagcgagcucuacaaguguuaaguaaaauaugaaauucagaaugggaguagagcuuggggagggauggauggacagaugaaugaauggauggauggauagauggauggauguauauaaauggaugguuggaugaaugaauacgagugaauggaugaaugaaugaauggguaaacagauaaauggaugagcagaugaaugaauggauggauagauggauagaugguugguuuuaugaaugaauggauagauggaugaauggguggaaaggugaaugaauggauggaugaaugaauauguggauucacaaucacuuucuauccugaccccuccccgacccacaaggcucuuccaggcaaaaccccaguucucaggcugagggaggccccaggcgguucccaggcuuccagcauggcgcgggugaacuaauauuuuuuuuuuuuucuuuugagacagggucucgcucugucacccagguuggagugcaguggcgugaucucggcucacugcaaccucugccucccaggcucaggcgauccucccaccucagccuucugaguagcugggaccacaggcucgugccaccaugccuggcuaaauuauuuuguauuuuugguagagacagggucuuaccauauugcccaggcuggucccgaacuccuaagcucaagccaucugccugccuuggccucccgaagugcugggaaugcaagcaugagccacagcgccuggcugauaucuucuuuaaggccugucaagcuuaucacucaggggauauuugcccaauaccucaagguuugacaagagcaggcugcuauuaucucaagcuuuccaaagggacguggcccccugucacggcucagacauagcagacaggcacauucuccaucauucaucacggcccuccugccauucucgcagucagagagaagccacagccucugccuagccuacugggcaccugucugcagccuaaucucaggugauccuucccuaggacgaacaacagaagcaagcuccguggcagaaaggagaaauucacgguagaccugugaagguguuugcucucugucccacugguucaucagcauccucauucaacaaacauaccuugugccagguucugaggaucacggaugaauuguuugcacagcaaacaaaacuccccgcuccccugugguuuccuuucccaggguagaggcaggccuggagccagcauucccacccgugaggcccuccuaauggcgacugugaucagggcuuggaggaggacaggagaggugccgcaagccaguguagacuguguaaccagauggccuguguucgaauuccagcuacaucacuuacaggcagugaugcuuuggcaaagagcuuuuuuuuuuuuuuuuuugagagcagagucaugcuauguggcccaggcuggagugcaauggcgggaucucagcucacugcaaccuucgccuccaggguucaagcgagucuccugccucagccuccugaguagcugggaucauaguagcacaccagcacaccuggcuaauuuuuuuguauuuuuaguagagacggaguuucaccauguugcucgggcuggauucgaacuccugaccuugugauccgccugccuuggccucccgaagugcugggguuacaggugugagccacagcacccggaauuuuauauaauuuuuuuuuuuagacaggaucucgcuuuguugcccaggcuagagugcaguggcaccaucucagcucacugcaaccucugccuccuagguucaagugauucucuugccucagccuccugaguaguggggauuacaggcucucgccaccaugcccagcuaauuuuuuguauuuuuaguagagaugggguuucaccauguuggccaggcuggucucgaacuccugaccuagagugaucugccugacaugaccucccaaagugcugggauuacaggcauaagccacugggcccggucuggucuuaaacucuugagcucaccucggccucccaaagugccaggauuacagaugcgagccacuguaaaccacagacaugcaccaccacacccggcuauuuauuuauuuauuuugagacaaaguuuugcucuuguugcccaggcuggagugcaauggugcaaucucagcucacugcgaucuuggcuuacagcaaccuccaccucccgggugacuugagaggaggguaacgcguggcagggaccaccaagacugcuuuuggaagagaccugaacgcuugagccccggggauggggaagaguuagccuggcccuaagaaggggagagugcggggauuggcagcaggcccggcccgugcaaaggccuggagaugagaauaagcauccugugaccugggaagggaaagacaauuagagaggaugggccagagagaacacagcagugugcgccuacauccugguucagugccuguaaggauggagaaggaccuuggcuccccugcugccagguuauagcaaggagauauucuggaaaaggaagccagcugggccgcguggggacuaggauggagcaaguguccccucucaucccucacucuccucucucccucguuggacuuucuuugccucaugaucccacagccucaaccccaacuccaugagacuuugccagauccuuuuuauugugucaagacucacaccguuugaccucaggaaguuaccaaauuggccuuuugaguguuaugaagauaauaauagcagggcagcgugugaugacucaggccaguaaucccaguacuuugggaggcugagaugggaggaucccuugaggccaggaauccgaggcugcagugaaccgugagcgugcugcugcaccagccugggcaacauagugagacuccaccucuacaaaaaaaaaauuuuuuuuuaauuaaccaggugcaguggugcaugccuguaauccuagcacuuugggaggcugaggcuggaggauugcuugaggccaggaguucaagagcagucugggcagcacaguaagauccugucucuacaaaaauauuuuaaaaaauuaaccaggugcaguggugcaugccuguaaucccagcauuuugggagucugaggcuggaggaacugucugaggccacgaguucaaacacagcuugggcaauuauagcaagacucccaucucuacaaaaaauaaaaaauuagcugggcauaguggcacaugccuguagucccagaugcucaggaagcugauggccagaggaucgcuugaggucaggaguucgaggcugaagugagccaugauugugccacugcacuccagccuggacgauagagugacacccugucucuuaaaaaauaaaaauaauaguauuagcagacacuuguguagcucuuacuacaugcugaugacuguucuaauugcucuuauauauauuaugaacucauuugauccuccuagcaacccagagaaguagguagucaucauguccauuguacaaaugaaaaaacuaagaaagacacagagagguuaagccacuugcugaggucacacagcaagcgaauggugaagccagaacuuaaacccaggcagccugacuccaggacccugcucuuaccaguuggcccuacucuaccaucccaggaggaauaagaaacaucuagaggaaacuagucacuucuaucguaaggauauugcccggagagaugcuggugacaucacguggaauccuuuuugggaggacugugggagaaaucccugccaaaaauaauugagcuuucuccugagcaucugguguacuuuuguuucaggacacugagaaccgcauaaaugaccagcuuucccuuucugaguuggcugcuaaggagcuuggagccaaacuuauggcccggccauaugcugauuguucagguuuuuaagggaugaguuuuucuuagccucguuucuggcucuguuuuaugucccugcuuuuguuuuucuucuuuuucucccuugccaaaaaaaaaaaaaaaaauuuaagggacuuuuaaaaaucuuuuuuuuuucuuuugagauagggucucacuuugucacgcaggcuggaguguaguggcgccuucauagcucacugcagccaugaacuccugggcucaagugauccuccuacuucagcuuccugaguagcuggcacugcaggcaugugccaccaugcuaauuuuuaaauuuuuuguagagaugagguuuuacuauguugcccaggcuggucucaaacuccugggcucaagugauucuccugccuuggcuucccaaaguguugggauuacaagcgugagccacugcacccggcccuaaaaaucuuuauaagaacaauacacguucauuguagaaaacuuggaaaauaagauaaauuuaaagauggugauuaaaaucuccauuaaucucuaauuuuuaaugacugcauaguaucucauucuguagaugcaucuuaaauuuguaaauuggcuggacacagugccucacgccuguaaucccaauacuuugggaggcugaggugggagaacugcuugagcccaggaauuugagaccaggcugggcaacauagcuagucccuguuucuacaaaaaaucuuuuuaaaaauuagccugggccaggcgugguggcucacaccuguaaucccaacacuuugggaggguaaggcgggcagaucaccugaggucaggaguucaagaccagccuggccaacauggugaaaccucgucucuacaaaaauacaaaaauuagccgggcauaauggcaggugccuguaaucccagcuacuccagagacugaggcaggagaaucacuugaacccucgagguggagauugcagugagccaagaucacgccauugcacuccagccugggcaacagagggagacuccaucucaaaaaaaaaaauuagccugguuuaguggcucacaccuguagucccaccuacucaggagacagaggugggaggaucgcuugagccuuuggacaucaaggcugcagugagcuaugaucaugccacuguacuccagccuggguggcagagcaagacccugucuccaaaaaaaaaaaauuuuuuuucuagcauguguaauagcuuuugaucaaauuaauuucuaauuguccaauuuuaaacaaugcuuaaugaaccucccuugcaacaaucagaugcuguccacaaaguuuccaugggcugaauucuuagcuuuggauuggccgaauaaaaugcaaauugcagaaacuguaauggcuuggcuguggacuggcaggcuguccuccaaaaauaucuaauccccgcucucauauuuaauuggcgcuaucuuaugguauuuuacauauccuuguaaaccacuuagaguccucucuggaacaaggcagggcacaaauaaauauguaagccccaaggugccuuggcuuccugauuaaauuauccagccucaaacacaauaauagcuucauuuuauuaagaggcaggcgcuugcucucuuccuguuggcuacuuccugauagccaaugcuucuccuguccccaggacccuguagcaaugccuccguccccagggaaacaccaggaauuguuuuuuuuuguuguuguuauuguuguuuuuuugagacggggucucgcucuauugcccaggcuggagugcaauggcacgaucucggcucacugcaaccucugccuccuggguucaagcaauucuucugccucagccuccugaguagcugggcuuacaggugccugccaccacgucuggcuaauuuuuguauuuuuaguagagaugggguuucaccauguuggccagacuggucuggaacuccugaccucaggugauccgcccaccuucaccucccaaagugcugggauuacaggcgugagccaccaugccuggccaccaggaauuguuuuugaaccaagauauaggugguggaguaguaggagaugaugaucccuggcccgacagcaagaacagcuuucccugccuguguccuacucaguuaauccuggaccuguuuuagaggcugguguuuaauuagggcagccucagcaaaaguguuuguaagauuucagccagaaaagacauuugaggaacagauacuugagugcauagcuucacucccuuaaagcccauuagcaggaauauuaaacccugaaccaagagcucagcaaagagagaguggguuggcagggccgucgugauagcucacgccuauaauuccagcacuuugggaggccaaggcggguggaucacuuuagcccaggaguucaagaucggccuaggaaauguagugagauccccgucucuaccaaaaaaaauagccagucgugauggugcaugccuguagucccagcugcucgggaggcugaggugggaggauugcuugagucagggaaguugaggcugcagugagccuagaucaugccacugcacuccagccuaggcaacagagcaagacccugucucaaaaaaaaaaaaaaaaaaaaguggguuggcuucuuuaguacaucugccacauccgaggugagacaggcugcuagaccacagacuucuaugcuggagaacgccuguguucuugcaccugcuguuguaagcauuuccccuagaguaggacacucucuguuccucucuagucuucugacugccaagaacucuugacuuuguuuccaagcuagacccagucugggagagcuagcacaugguacauuccagaacauuccagcgguuccuagggacaugcauuaacugcauaucugaacuuaaacccaaugggcaaaacucaggaccucugccugcugcgaucuggcagccaaaacccaggcauuuaauuacacugcugcagagaacacuccggugagaugcguccaacgcagacaauuauuuuaggaaaaccauggaggccuucucucugcaccacuuaaaucuugcuucucuuuuacaauucaauauuuccucugucgagagaaaauggcuuauuugcuucaacggacacgcuaggcaauguaggaagauguuaauuacguugaaccggcggcuuugucucugcacaaaagauauuccuuggggguuucuauccaaauugcuuggggacuagagccaggggaggaggggcagggaugcuugggcuccuguuugauguuuuucuuuguuuuuuuuuuuuuuuuuuaagaaugagauuuaucaagaagggagggccgggcacgguggcucaugccuguaaucccagcauuuugggaggccaaggcggguggaucauuugaggucaggaguucaagaccagccuggccaacauggcgaaacccugucucuacuaaaaauacaaaaauuagccaggcgugguggugcaugccuguaaucccagcuacuugggaggcugaggcaggagaauugcuugaaccugggaggcagaggcugcagugagccgagaucccgccauugcacuccagccugggcgacagagcaagacucccucucaaaaaaaaaaaaaaaaaaaaaaaagaaaaaacagagagguaacagugacucaugccuuguaaucccagugcuuugggaggcugaggcaggaggaucgcuugagcccaggaguuugagaccauacuggacaauauagcaagacucccaucucuacaaaaaaauuuaaaaauuaguaggugcgauggugagacuaaaggccuuuagucucagcuacucgggaggcugaagugggaggaaucacuauuuaagcccaggagguugaggcugccaaaagcccugauaguaccacugcacaccagccugggugaccaagugagacuccaucuccaaaaaaaaaaaaagaggagaagaagaagaagggaggugggagaguaguucuggauccucccagaaccaaaggggcaggcuuucuugggguauuccucuuguacugggccauccuuguugucuuaggucaggcucuuucagggaggauuuaagugcagguauccaccuaagauaccccaggaagaaccagugggggagcagugaagugagagaggaggugaaggaaacccgugccgggagacuuaaugaguacgccaggcgcaguggcucacaccuguaauaccagcacuuugagaggccgaggcagguggaucgcuugagcccaggaguucaagaccagccugggcagcaaagcaagacuaucucuacaaaaggaaaaaaaaaaaaaaaaaaaagcuggguguguugguaccugccuguaggcccagcuacucaggaggcagaugugggaggggauggcuuaaacccaggaguucgaggcugcaguaagcuaggauugcaccacugcacuccaguggugggugacagcaagacccagaccugagcgacagcaagaccccaucuuaaaaaaauaaauaaaugugccaggcgcaauggcucucgccugcaaucccagcacuucgggaggccaagguggacggaucacuugaggccaggaguucgagaccagccugaccaacauagugaaacccuaucucuacuaaaaauacaaaaauuagccaggcauggaggugggugauuguaauccuagcuacucgggaggcugaggcaugaaaaucgcuugaacccaggagguggagguugcagugagccaagaucgcaccacugcccuccagccugggagacacagcgagagucugucucaaaaaugaaaaauaauaaaauaaacgaauaaauaaaagagaaguaaugagcagguugcugcuguggacaacugagguguaaaucuaauggguugcccuggaagauuucaugaacauacaccuucgaguucuuucccacuggagaggcaagaggggugguauuaaucacgaaugccuguaggucaucucugaggauugcuggguguauuuucugcuggccccaugcaagggcagggugggauaugaccaccagagaaagcucuuggcuguggccaauccugggcacaccugcagugaauguuagcuccacccagcuccuaccugaguacaaggaaggcggagaaagugaguuacugugcuccgcugccagggcugaggaugugcaacuuacaaagaggggguuccccccauuuaggaaggguguacaaaggcucgaagaaugacugacuguaauaguuucagcuggcguuuaugaaugguuuguuuuccuuauagauuagugggggagucaagcucaucuguauaauuuguacaauuauaucauuugcucauauuccaauaagccuuaaaaaaaaaaagacucgauugagugggagagaaaaaggugggcuaauaguuggaguccccgggaucgcucauaauucacagcuugguuuaucugugcugcagcucacggcaccgauucugcugggagaucuaguaauggcugugcaaaugaucaaugauuguggugcuuuguuucucuguaaaacacugggguuuuuuuaaucagaauuucuuccaugccugucagaaugcauccuggaauaggaccagaaucuuccauuuaccgccucuauggccaccacccaucaucaccugucuggaucugugcagucaccccugcccuggccucccucccucguucccuagagcagccagaggucacugugaacacccaaguaaggucacgucucgccucugcacagaacccuccauggcucccaccuuccucagggcagaacccagagcccucacugcuucccacaaggccuugccccaucaccucccuucucucaucugccuccacuuaccccuuacucaaucugcuccagccacaugggccuccuccuuguuucacaaacacaccaggcaugguccugccucagccuuucuacuugcuguucucucugccuggaaccccuuccccagacauccaaauggcuccucccucacuuccuucaggucuugaacaaagacuucagguuuugaacaaacgacgccuacgugugcaagcccaagccagucaccccacaacccucacguccccccacauccuuuuuuuuuuuuuugagacagaguuucacucuuuugcccaggcuggaguaaaguggugugaucucggcucacugcaaccucggcucgcugcccccaccccgccagguucaagcgauucuccugccucaggcucccaaguagcugggauuauaggcgcacaucaccaugcccggcuaauuuuuguauuuuuaguagagacgggguuuuaccauguuggcuaagcuggucuggaacuccugaccucaggugauccaccugccuccacuucccaaagugcuaggauuacaggugugagccaccgcgucuggccuguuuuuuuuaagagauggggucucacucugucacccaggcuggagugcaguggcacagccauagcucauugcagccucaacuuccuguacccaagcaauccuccugccucagccuugugaguagcugggaccacaggugcaugccacuacauccagcuaauuuuuuuuuuuuuuuaauuuuuaguauagaugaggucuuguuauguugcccaggguggccuuaaacuccugaccuucagugauccgcccccuucagccucuugaaauucugggauuacaggcgugagccaccauuccugggucccuccagacauugaucaggauuuguaaugauagaaauguccccugccuucuccuuuucuucugucucacucgucccucaaguucaucucaagagcccauucucuuggauaccuccucagagacccucagccugagggaagacccccuguuacucccugcacuacuucuucaaagcacucacugcagcaugugguucuagaaguaucacuggcauuaagugguugauguccgucucuccuaguagcuccauggacaaccaccagauguuuucuucauuccuucucuuccuugauccuaucccagacccuaugccugggacagaagagacucucauggauaucuucuuuuuuuuuuuuuuuuuuuuucuuugagacggagucuugcucugucgcccaggcuggagcgcaguggcgcagucucagcucacugcaaccuccgccucccaaguucaagccauucuccugccucagccucccauguagcugagauuacaggugcccgccaccauacuuggcuaauuuuuguauuuuuaguagagauggggcuuugccauguuggccaggcuguucucaaaacuccugaccucaggugauccaccugccucaggggugucuucuaaucaguuuggaaguuuaugauuugugucuagaguucccugguacuuauuugcauuucuaagccucugauaaguccugcaguaacaaaacuuguuucacccagugacacacauuuauuugaccacagagcauccuuuucccagcacaccugguaagauuaccaguguuggaaggaguauggcuugggaaacaaagccauaauuggucacuggauuaucugagcauuuugucugccaucacuuugccuggguggcuccaggugaggugggggcacagcaggguugcacuuaacauuugguggcccugauggccgggcacgguggcucacgccuguaaugccagcacuuugggaggcugagacggguggaucaccugaggugagauccuuuuuuuuuugugagacagggucucacucuguuacccaggcuggaguggaggccagguguuggagacaggcggagguugcagugagcccagaucgcgccacugcucuccagccugggugacagggcaagacugugucucaaaaacaaacaacaacaaaaaacaaaccaaaaaaaaaaaaaaacauuaaguggcccugagauagcuccagagccgauaugucacugugggcuggggaagcagagaggagguccagguuuggggguuauuugaguggaucucuguucuaauggcagucacagagacaguguugugugcgugcaaaucugugugagagaaugaauucuggucuuggagaagauuugaguccuccaauuccuugccguguuccuuaagcccuccgcaccucagucuugccauccgugaaaugaggcuccuuaaggagggccugagaucacacacaacaggcacuggcauaugcccggagcccagcaaagggcaucugugguuuccuugggcccccuuccugucccagugagggcgaggcgagacccucacugggauuccggucucugacccccaccucuuugcagacucucuuccagaacccagaagagggcuggcagcuguacaccucagcccaggccccugacgggaaaugcaucugcacggccgugaucccagcgcagaguaccugcucucgagauggcaggagucgggagcugcggcaacugauggagaaggugagaaccuuccagguacccugggggcagcugggaaaaucucccaguucucaccccgcccuccagccccauccaggucagccaguggccauauccagcuaugcaaauuauucagagcuggcugauaauccagcuccucuccaggcagguccuuuuuuuuuuuuuuuccuuuuaacacagggucucacucuguuacccaggcuggaaugcagugacaugaucagcucacugcagccucaaacuccuagguucaagcaauccccacuccucagccucugaguagcugggacuacagacaugcaccaccaugcccuaauuuuuauauuuuuuguggagacggggucucccuauguugcccaggcuggucucaaucuccugggcucaagugauccuccugccucagccucccaaaguguugggauuacaggugugagccaccaugcccagauggauacuuuauccaauaucuguucaauguauuuuuuuuuuuuuucuccuugagacagucucacucugucgcccaggcuggagugcaggugcaguggcgcgaucucagcucaccgcaaccuccaccucccagguucaagcaauucuccugccucagccucccgaguagcugggauuacaggcgugugccaccacgcccagcuaauuuuuuuauuuuuagcagagaugggguuucaccauauuagucaugcuggucuugaacuccugacugcaggugauuugccugucuuggccucccaaagugcggggauuacaggcgugagccacugcgcccugccuguucaaugcuuuuuugggagagaagccaagcacuuacugggauugggguggggggaaggaaggaagacuggaggggcagcaucugagucuccugugugugagcucugguccaccaggcaugucccacccagcuuugcaguucaccagacucaccuacuaagaaggaguucugugccccuuggggagggucuaacccuccaccucaagaggcuccuauaaaaguuuccuucuaccucugaucauggucaagagaaaauaguccccugggccgggcgugguagcucacgccuguaaucccagcacuuugggaggcugaggcauguguaucacuugaggucaggaguuugagaucagccucuaccaaaaauacaaaaauuagccgggcgugguggugugugccuguagucccaccuacucgggaggcugaggcaggagaacugcuugaacccgggagguggagguugcagugagcugagauggcaccacugcacuccagccugggcaagacagagcaagacuccaucucaaauaaauaaauaaauaaauaaauaaaacuuacaaauuguugauuucuggaauuucccacuuaauauuuuuggacugugguuggccucagguagcugaaacgugaaacuguggagaagggaagaguauguaaaaauguuuuguggcguucaggguggguauuaggcugcugaguuucugggaguuuccaagugucaugugaauaauuguacaggaaagucuguauuucaacaagcauccagugguaacucugacugaguuuaccuuagccaggcagaguccacuuuagucaggugaagcuggugggaaucuaccuuagccaggugagagucuaccuuagccagguaaaggucuaccuuagccaggugagggucuaccuuagccaggugagggucuaccuuagccagguguucaucuuagccaagugagagucuaccuuaacaaggugggagucuaccuuagccagguguucaccuuagccagcuggagucuaccuuagccaggugagagucuacuuaagccagagauggaguucaccuuaacaagguggcuaccuuagccagauguucaccuuagucagaugggagucuaccuuagccagggggaguucaacuuaucuagguggaguucaccguagccagguggaggugggagcugggugcucucagguugggucaggagaggccagggcaagggaaguuuauuuuacucauucagccaaaaaauacuuauugggccucuacuccaggccagugcugggcacuggagguuaagcuguggacaagcuagacgcagccucugccucugagggucccaccugaaggaggcagauggauaagaauguucuacauagucacagcugggaaggaaaugaccaggcaagaggagagugagugagcggcuaccggacaggguggucagggaaggaugcuuugagugggggacgcuggagcugaacccugaaggaugagaaggagccagccaugggaacuugggggaacagcacuccagguagagagaccagcaagugcaaagacccugcagaaggaaggagcuuagagucugugagaacaaagagagaggaaguggguugggcggggggggugggcaggaccagccagcacaggaucuguggaggaggaaggugaucuaaucucuguuuugaaaguuccuucugucugcuguguagagaauugacuacaggggaugaagguggaacugggagacuagggaggaggugagagguggugguagguggaccagaugggagccaguggguaguagggagggagcgauggauggauggauugggcacgcaauugggaggcugcugguaagcucaggggaggagaagguggccucgucggugugguguuuguacagccucuguuccugccagcucuugucuguggcaucucuggguugggauuuggggaaggaggucuggucccuucaguuguccccauuccuagguccagaacgucucccaguccauggagguccuugaguugcggacguaucgcgaccuccaguauguacgcggcauggagacccucaugcggagccuggaugcgcggcuccgggcagcugaugggucccucucggccaagagcuuccagguggguccuccuguguccagaccagaggucaaacaaaugacugggauuugguauccauuaguuccuacaauggagucaugucugggaagaaucuaggguccaauaugagccacaugucaagggccaggugugcaucaaagacaaagggugaaguuaugagucagagguuggagucaugucugggucaaaggccaggggucaggcuuggccaugguuccaucuugaugcacaggagcugaaggacaggaugacggaacuguugccccugagcucgguccuggagcaguacaaggcagacacgcggaccauuguacgcuugcgggaggaggugaggaaucucuccggcagucuggcggccauucaggaggagaugggugccuacggguaugaggaccugcagcaacgggugauggcccuggaggcccggcuccacgccugcgcccagaagcuggguaugccuuggcccuugacccugaccccugaucucugacugccacacccaacuccaguaucaccuguuugugccuagaagcuggacacaguuuugaccucuaacuuuuaaaccucaacccuugaccuuccuaccuaaggcuacacuugaguccagaagcuggaaauggcccugacccuuggccucuaaccccucacucacaacugaacaacauauugggaccagauuuuugagucuucccucaucccuggucccagcuuucccaacuugaucacagcacuucaucuuugccuggccucucuugggcuguucauuuccccauccucauucccccuguuccugccucccaggcugugggaagcugaccggggucaguaaccccaucaccguucgggccauggggucccgcuucggcuccuggaugacugacacgauggcccccagugcggauagccgggugagugacugcgcccaccccuggggucagggccugggagggacagagccuuugacugcccauaggugccuagggaguccacacuggugacugucuuguagcccaaaguguccuggaucccccagggccauuggaccucccuguccaguaacccccaagugaccaagggcuuugcagccuugugaaucccacucuguugaccuccagugucuguauaguggcuaaugguuacugaguucuacugaccaguucucagggacuacugacguccaaguaacuacccaaugaccaaugcccucccaaggacaagagaccucuuccaccaagcacugcucagugaccuucggacuucuaguagcuuccauggucaugacugcccaucacuuagacacacaagaaccauccaugaggcugggcaugguggcucaugccuguaaucccagcacuuugggaggcugaggugggcggaucaccugaggucgggaguucgagaccagccugaccaacauggagaaacccugucucuacuaaaaauacaaaauuagccggacaugguggugcaugccuguaaucccagcuacucgggaggcugaggcaggagaaucacuugaacccuggaggcagagguugcagugagccaagaucgcaccauugcacugcagccugggcaacacgagugaaacucugucucaaaacaaaacaaaacaaaaacaacaacaaaugcuaguuaacaugaugacaacaaugauguugaugacacgccuggucaccucauggugacagggguuaguuaaccauggcagugaauucaagugaugucuuaucauucaauggcuguccagugaccacuaaccacccaauauucaaugaccagggaauuccugggcccagugacuccccaggggcugcaguucccuggguccuuugggauggagcauuguccacuuagggucuguuuuaagaucaauaguggccaggugcaguggcucacgccuguaaucccagcacuuuaggaggccgaggcaggcagaucacuugagcucaggaguuugagacuagccugggcaacauugcgagaccuugucucuacuaaagauacaauaaauaagcugggcguggugacuugugccuguagucccugcuauuccggggggcugaggugagaggauugcuugagccugggaggucgaggcugcagugagccgugauugugccacugcccgccagccugggaaaaacagugagacuuuguuucaaaagaaaaaaaaaggccaggcgugguggcucaugccuguaaucccagcacuuugggaggcugagacaguggaucacaaggucgggaguuugagaccagccugaccaacauggugaaaccccaucucuacuaaaaauacaaaaauuagccggguguggugggaugcgccuguaaucccagcuacucaggaggcugaggcaggagaaucacuugaaccugggaggcggagguugcagugagcugagaucacgccacuguacuccagccugggcaacagagagggacuccaucucaaaaaaaaaaaaaaaaauuacuuaaaaaaaaaaaagaccaauagcacucacugggauuuggguccuacuggggccaugcaguuccccaagaaacugcagccccuggggacucacugggcccaggaauucccuggucauuggauauugggugguuaguggucacuggacagccauugagugauaagacgucacuugaauucacugcccaugguuaaugcugucaccaggagaugaucauggucacacuagggccauaauugguaaugaauggucaacagaguucccaugacuaaugaccacuuagugacuguugaacucuaauggcuguagcuggugcugggacccuugggucguugguggugguuccccccagugaccagcggcugcuaccauaggucugguacauggauggcuauuacaaaggccgccggguccuggaguuccguacccugggagacuucaucaaaggccagaacuuuauccagcaccugcugccccagccgugggcgggcacgggccacgugguguacaacggcucccuguucuauaacaaguaccagagcaacgugguggucaaauaccacuuccgcucgcgcucugugcuggugcagaggagccucccgggcgccgguuacaacaacaccuuccccuacuccuggggcggcuucuccgacauggacuucaugguggacgagagcgggcucugggcuguguacaccaccaaccagaacgcgggcaacaucguggucagccggcuggacccgcacacccucgaggucaugcgguccugggacaccggcuaccccaagcgcagcgcuggcgaggccuucaugaucugcggugugcucuacgugaccaacucccaccuggcuggggccaaggucuacuucgccuauuuuaccaacacguccaguuacgaguacacggacgugcccuuccacaaccaguauucccacaucucgaugcuggauuacaacccccgggagcgcgcccucuauaccuggaacaacggccaccaggugcucuacaaugucacccuguuucacgucaucagcaccucuggggaccccugagccaaugcuguggcucgggcugcugccuggggggccucugggggcugggggcccuuuucauucugccugugucccucaagggugaucucucugucucugucacgcccuuucuccccgccuuuuugcugggcuuuuguucucugccuauguauuucugucuauuuuuucaauuuccccucuucuccuuuauugaucucugcuuuuaauacaccacuucuuucuuucugccuuuuuauggaugucuuuuucuuuuuauggcucugguucuccaguucuuuccgucucugccucucucugucucucucucucuguccuuccaccccucccuccuugcuucccacccauuccucaucccucacucccacccccacccccacccccaggaguugagugcauggaucuguuucuuuuuuuauuuacacuuuuucuuuccgguuugccggaauaaacaggaccuuugacauuuga

SEQ ID NO: 192019 - RNA, 50911 nt, Homo sapiens
cacaguucaucaguuuauucucagauuugagaugcaaauuaugcccuauggccuggcgguggggggccaggcuugggcuggaaucucucaucauaucccagccuucccuaaggaggaagcagaugaaaucuacaacaggggggacuuucccuuuuaauacagacccagguauaaauagggcagcaccauuaggauccugauucacccccccaacaucuugguccccaaaccaccuggcauggcaaggugagccuggggagguggggggcagggggaggggauuugcagagcugggcugaggcaggaaaagaaacacaacccagucaagggaagucccucuucccucuguaguccgaccucaguccuuucaccguggaaguagaaaggaucaaaggggguggggguaggggucccagccugggaucaggagacauccagugcuuaacucuggggagggguagcaccaaaaggugugaagggcagcgacggaggagugaggaggcaggcauugggggugggggggcuuuuguucaucagcucugaguuagaagcucauugcauggggguucaagggguggggaggugaggcuuggguggggagggaggggagaaagagccagacugcaguaugccaccuggaauggggugagaggaggcuggacccuugggccagggaaccccagcccccagcacccuggaaaggagaaggaaugacuguccgugaugagcgaagucacaucccauuggcuccauagucacagguaacgaaaaauacgguggcuucaaagccucagcaccaaaugcaccccauucuggggcucccucauggucccucccaccccggacacucucagcugcugaagcagacggggcccaguucaaacccaaacuuuugguucgucuggccaaagucaguggccgccacaucccacaggggcagaaaucccgcucgagaagagcugaauucgaaaagggucuucgucuguccuuuccggagcuguccccagagaagacagagacggugaguuaccgggaagguggccgacaucuugccuccccucucuagcuggccacugccccacccucuuacccggcagccauccugggggacgcugacaguggcugcugucgucugguugaaagacagcuccucuccauuggugccaaggaagcgggcggaguggcuguagucacccguggcuucguccagccaggcagcugcauucuggcaggaguaggugaaguucuggcgagcuguggcacucagcaguuucaggaaguucagcugcacgacauucacuggggacccgucggcguccacguaggagaacuggugagaggagggcaaggcagaggaugaggggcuccaugagccucuuucugcagaagccacccccuggaaucuccauccacuggcagacaagccaccccccccaugucaccaucucugaggaggucccaccagccaccuagagaucccuggcagaaucccaagagucaccugaacauccacucuguccaccucuccauccaguaggccuccaugcccacuccaucugaccucccaaauucugauugcuucauccaccaauccaggguuuuaacacacucauccccacccagaagacacaacucugccuccacucuugugagucgcuggaucuacagagcucacugucccugauaccagauuucugcccuguccaauauggcagccacaugucuaauagccacguggcuuuugagcacuugaaauguggcugauuugaaggagggauuuuuuuuuacuuuauuuaauuuuuuuuccuuuuuugggggguaaggguugggaucuugcucuuucgcgcaaguuggggugcacuggcacaauccuggcucauuccagccuccaucuccugagcucaagucauccucccaucucagccucccaaguagcugggacuauaggugcacaccaccaugccuggcugggacuuuuuuuuuuuuuaacuucauuuaauuuuuuuuuuuuuuuuugagacggagucuugcucugucgcccaggcuggagugcaguggcauggucucagcucacugcaagcuccgccucccggguucacgccuuucuccugccucagccucccaaguaacugggacuacgggcgccugccaccacgcccggcuaauuuuuuguauuuuuaguagagacgggguuucaccauguuagccaggauggucucgaucuccugaccucgugauccgcccaccuuggccucccaaagugcugggauuacaggcgugagccacugugccuggcccugaauucuuuuacuuaaaaaaauucacaacuaaugacugagcuucaauccaguuaucagaaagcuuaugcuuggaacaacuugagucugaaucuacuuuuugaacuguuguucaaugguuuuaugaaaucuaaauauagagcaaauauucccaauaaaauuuagcauucaaauugugauguacuauaaauguaaaaucuccaucagauuuugaagagcuaaucugaaaaaaauacaaaauaucuuaauaaugcuuuuuuuuuuuuugagacggaaucucgcucuguugcccaggcuggagugcaguggcacgguuuuggcucacugcaaccucuuccuccagggcucaagugauuuuccugccucagccuccugaguagcugggauuacaggcacacaucaccaugucuggcuaauuuuuuguauuuuuagcagagaugggguuuuacaauguuggccaggcuggucuugaacuccugaccucaggugauccgccuaccuuggccucccaaagugcuggaauuacaggccacuguacccagccauguggcuuuuucuucuucaaauucaccagacccugucuugacugagccuuugcauaugccuuucccucucccuggaacacuuguccuuguccuuccuagcuugcuaacacagugcauucuuuaggcuucagaugagcugugaucucuacuaggaagccuucuggucuuuccaacacugccucuaaauuuccaccaugcccugugcuuccccuauccuggcaccaucauucuguauggcaauugacugccuguuacacaucugaugcugcugccaccccaccuccagcuugcgaucccuaggaagguagaggaaagccuauccucuucaucucaccucucagaacccaccccucaaaccccccugcugguucccaucaauuuucaugucacuccccaucucggccucggugacucaccuucuucccucgacggaaugugcuauaccagccuccaggcuuuuccuuggaccaggaggccaauuucaccuggaagagaaaagggagggucacuguagcugacgcccuuggugccaucuagaucucaucugcauuucccuccucacacaguaggcuguugugacuaugucaggauguucucuggcuucugggauggacgagcucugccagugcacaaugggggaaggagguucaugccccugaggcagcccucacccaaugacuaaugggaguugguggauaaauaccccagcucccucaccuccaagggggauaacucucaggugccugugcuacacagucucccagggcuccccagugggauugagcucugggucuccaauggcaccauuuuauuuuaauuaauuaauuaauuaauuuuugagacaggaucucacucugucacccaggcugaagugcagugacauaaucauaguucacugcagccucaaacuccugggcucaagcaauccucccacugcagccucccaaguagcuagaacuacaggcauguacccccaugcccagcuuuuuuaaauuuuuauuuuuugagacagagucuuguucugucacagggucuuggagugcaguggugugaucacuggcucacugcagccucgacuuccaaaguucaagcaauccucugaccucagccuccuaaguagcugggauaauaggagugugccaccaugccuguuuuuuuugggggggggggcggguggagggggucuuucuauguugcccaggcuggucuugaacuccugggcucaagcgauccucccaccucagccucagccucccaaagugcugggauuacagguaugagccacugugcccagccucagccucucccuuuaggcuaagcaggugagugaagaggagguccucagauguuaguaauuguuuagggaucaagucuugcacuccgggcccagugggaaguccaagcuugucuaaauucccauccacugggcaucugagcucccacuaaaccaggagaaaauaaaccaguuaaaaauaacaacauggggccaggcgcgguggcucaaaccuguaaucucagcacuuugggaggccgagauggguggaucacucgaggccaugaguuugagaccagccuggccaacauggugaaaccccgucucugcuaaaaauacaauacaaaaugagccagguguggugacaggcaccuguaaucucagcuacucgggaggcuaaggcaggagaauugcuugaacuggggagguggaaguugcagugaaccaagaucacgccacugcacuccagccugggcaacagagugagacuaugucucaaaagaacaaaacaauauggggcugggcacaguggcuuucucccacugcuuaaucccagugcuuuagguuacagugagcuaugaugaugccacugcacuccagccugggugauagagaaagacccugucuauaaaaauuagaauagaccggguguggugguuuaugccuauaaucacaauaccuugggaggccaaugcaggaggaucucuugaggccaggaguucaagaccagccugggcaacauagugagacccucaucucuauaagaaauuuaaaaaauuagccaggcauggugaugcacaccugugugaugcacagcuacucaagaggcugagacaggaggaucauugaacccaggagguuaaggcugcagugagcugugaucccaccacugugcucuagccugggugacagagugagacccugucugaaaaacagacaaaaauaacaauaacaauaaauauuauuucacacuuauaccggccagguucuugcuaagugcuuuaccugcagauagagguauuagcccagcacuacauguagucaggguuuaguaaauguucccugcaggccaggugcgguggcucaugccuguaaucccagcacuuugggaggccaaggugggcagaucaccugaggucaagaccagccuaaccaacguagugaaaccccaucucuacuaaaaaaaaaaaaaaaaaaaaaaaaaaaaaaaaaaaaaaaaaaaaaucagcugggcaugguggcgcaugccuguaauuacagcuccuggggaggcugaggcaggagaaacacuugaaccugggaggcagagguugcagugagcugagaucacgccacugcauuccaggcugggagacagagacagacucugucucacacacacacaaaaacaaaacaguucacugauauuuguuuuugcaucaguaucugaauugcacagccacucuaugaaguagauacuuucuuuuuuucuuuucuuuuucuuuuuuuuuuuuuuuugagauggagucucgcucugucgcccaggcugaaguucagugacacgaucucggcucacugcaagcuccgccuucuggguucacgccauccuccugccucagccucccgaguagcugggacuacaggcgccugccaccaugccuggcuaauuuuuugcauuuuuuuaguagagacaggguuucaccauguuagcuaggauggucucgaucuccugaccuugugauccacccgccucggccucccaaagugcugggauuacaggagugagccaccgcgcccggccuucuuuuuuuuuuuucuaggcggagucucacucugucacccaggcuggagugccauggugcaaucuuggcucauugcaaccuccgucucccaaguucaagugauucugcugcuucagcccccgaguagcugggauuacaggcgcccgccaucacgcucagcugauuuuuuuauuuuuaguagagacgggguuucaccauguuggucagccuugucucgaacuccugaccucaggugaucugcccccgcuuggccucccaaagugcugggauuacaggcgugagcuaccacauccagccuauugauuucuuuuggaguuuuccuugucugucuucccauggaagguaugaguuccauaaaagcagagauaguuuguuuucuuuccuuucuuuuuucugagaaggagacuugcucugucucccaggcuggagugcaguggcacaaucucggcucacacuaaccucugccucuagggcucaaaggauccucccgccucagucuccagaguagcugggacuacaggcucgcaccaccaugcccgccaguuuuuuaauucuuguagaaaugggguuuugcuauguugcucaggcuggucucgaacuccugaccucaagcgauccucccgccucagccucccaaaaugcugagauuauaggcaugugccaccaggcuggccugauuuuuuuucuuuuugauccucugcuguagucccagcucuugaggcaggacuuggcauacaguaagugcucaauaaaugccgguugaaggaaggauaacgucccagacaaggugguuguggguguggggagcaggggacagcacuuccugggggaggcgaugagagguuuggguuacucacgaucucaaacuucuugucgggauagaggcaggucucuccucccgccgugaaguugcaaaaaacccugaacgagucccgcgcgcagcccugguuggggucaauccaguauuccccugccgcagagccaggcagggugggugaguccggaugggacccgacggaccccaaccccccccacacccccacuccgcccauccaaguggcggggggaccggaccucaccaucaggcaggugcgggugguugcggugcagcucguggcacacgaggcccgggcgcuccgcagugccgggaggacgccgcagcugcuccagcuccaagcucagcgaugugagcgaggccagcaccuccuccaggccgcccuccacgacuggaagcgggacugggacgaagcgccggcgccugcgcagcccaugcagcucggcaggggcacccugggcguaggggauggggacggagaagagaggggagaugggggagggagagagagggagaaagagagacaggcagagaugaagaggcagacagacacaaaugagaaagaggagggagagagauaaacaaggggcagagauagagaaaggagagauaagcagacagggagagacacacaggaaagagagagacagauucagagauggggagaagccaaguuguaagaggacaaaagagaaagcgcaagaauagcagagacagggagagagagcagggagagagacagaagaugaaauaguggcgccaguauagacagagacagauaagggagauggacagagacagggagggagagaugggguccaagagacaagacccaggucagagcccccauggguguccccccaaguccccccucccaggccagaccuuccuugggguuuuacagggaacuacccucuucaccuacauccucugaacaccuagugugugccuggcccagugcugcgcacggaaggacccucuggggacacccagacauaguccuugcucuccccccagguuuugguguccauucccccgccccccggggaacucaccggggggccuggugggccugcagguccagugucuccacgggggcccauggaccccuguagggagaagucacuuggagaaugaacccugucuauggagacccuucccaccaacauacacacaaacacacacacacacucacacacacacucacacacacacagucucacacacucacauacacacucacucacacacucacacacacacauacagccuuggggaagagacaugcaguuuucagcauuaggcaucagacacaaauuuucuuuucauguuuuaaugucucugaaaucagcuucuuaacaucuuuggcaagucauaguuuacuuggcagaacuguuuucuuuccuagcaguuuguaaaauaaugguacaucuuauaauugauggcauuuuggaucugaugaaauacaaccguagguguugaauaaauauuugucgaacgcacgauugcaugaauaaauaaauaaaugaaggcagagacguggaggguucuggugcagugaaggggguggggagcugggauguguaagcccacggaagcaggguguacucaccggagacccuuuugagccuuucuguccuagagggcccuguaggguacagacagggagagcugagguccuggccuggaccaccacagugaccucaucccacaaaagauucccugcauacucaccgccacaccugggggcccaggguggcccagagagccaaugggaccagggggacccuaggaaaaggacaucgggucaguauuggugggguacacccuauugcccugacacaucccccagacaagccuucaauccuaccaaaggaagaccccgaacccuagacaagccuccaguucccccacagagagaccccaaaccccagacgcagccuccaacuugccaguucccagauacaucccccuauuuuccccacacacacccucauuaauccagacccacguuucccagaccccacacccacagucucucaaccgacccccuccuucaaaugcauucuucccgcucaggucaggacacucacagggucucccuugggaccagggggucccugcacgccuggcaaccccugaucuccuuucucaccagcuucucccggggggccaaugagaccgaucaauccaauguggcccugaaggacaaaagaggcacagacaggggaggacgugggaggauucagggagguuuuucuccuagagccuuagggugaugaguuugggagcagaggaugcaccaaucucccagccccccagccagggagggagggaaagaggggaggagauggggaagagaauaauggaaugauguccuuaccuuuucccccuuggggccagugucucccuucagcccugggaggccagagggccccugggagaagagcaagggucaguuagggauucucaaaugugaacucgaggucugugugggugguuaggggauggucaaaugggaaauuaugcagauuucaaaugggaauuaccagggaugaggucaagggauggucagaguaggccaccaaggugggaugaugagagcuaaugagggguugacuggaggauggacaacgugaguggucaguggccaaggucagcgugggugaucaguguagaccauuaagauggagagucagugcaggcaucaagaugaagggucaguguggucaguguagaccaucaagguggaguauuagagcagaggguuauagagaugggcaguguagaccaucaagguggaaggucagagcaggggguuauagagaugggcaguguagaucaucaagguggaguguuagagcagaggguuauagagaugggcaguguagaccaucaggguggaaggucagagcagaugguuaguagagacaggcaguauggacacucagauggauggucagugagggcuagccugcaccaaugcucacuagguggucacuaggugcccagagugguccucagagccagaaccucaaggaugaacaagucucuuaccagggggccaggagggcccaucuguccaggggcucccaggaggccugguucacccugagaauggaacagaacauggggugggcugcacccugucagaacacaguguggacccccccccgaccaugcaccaggggcagccccuccaaacggugaugggaucacaagcugggagcagacagagaggagcuggauccacccugucccaccccugccccgcuccacucaccacagggccagggaucccucgaagacccucaggccccacacguccagggggcccucuagcccccauuggacccguccucccugggggcccaucaggaccuggcucccccugaaauggacacaggcaagggaggggccagagucagaggguuccugccuccugaccccugccaagaagcaucugggaucgggagggaguaggugcacagaguggucauagguccacccucuccugauggccccacuguuggccuagaguagugcagggacccuuccccuugccagggggacucaccuuggcaccuuucuccccuucucugccuucucgacccauguggccugaaggacccuuggaagggaaagacagugaggggggucuaggggcugacugagggucagaggggugaguggggucugggugacugggggguuauggaugaguggggucuguaaggugaguggggucuguggggugaaugaggucugggugagugggggcugugggugagugggggcuguggcugaguggaggcugugggugaguggaggcugugggugaguggaggcugugggugaguggggucuguggggugaguggggucugugggugaguggggucugugggugagugggggcugugggugagugggggcuguggggugaguggggucuuuggggugaggugggguguguggaugaguggggucugugguugacugaggucuguggggugaguggaaucugugggugaguggggucugugggugaguguguucuguggcugaguggggucugugggguaagcgggggcuguggggugaguggggucuguggggugagugggggcuguaaggugaguggggucugugggugaguggggucuguggguguguggggucuguggggugagugggggcuguggagugaguggggucuguggguguguggggucuguggggugaguugagggcugugggaugagugaggucuguaaggugagugggggcuguagauaagcugaggacccaggagguggcuuaucacuuacccucuugccggggggcccgggggcgccgggcuccccagaagcuccaggcggacccuggaggagacaaggacaccagcuguggucucagcuaacauuguuugagccugacuguuuuaggacgccuuggaccagaggacacccuuccccaagccucaccccagcaccggguacucccaccucccaccuacucccucaagcugcucacauuccuggggguccccagagaggugaagcgggagcaucugcaggggccuuggguaccccacuagcccacuccccugcccccccaauucacucacucauuagcuccccaacccccgccucagcaccacacccucuguuuucccacucaccggucccccaacaucaccagggucucccuucuccccuggggaaccaucuaugcccugcauggggggaagacagaguugggaggggugaugaggguacgugagaauuugggauggggcugggaggcaaaagaacguuuuugguuccacugucagugcccaggucuguggggguagggagauggggacagaauuaggaaauaugccaggauuggggagggggucacacucacugaaacuccagggucuccugggggcccuagaucuccgggcagccccguggggcccuggaacacagaaugauuaauaaucacaucucugaauuguggagcaaucaugcauuuauggaacagaucaacuguauccaggaacaguuugguuucuggggacacauuagugaacaaaacauaaaaucccuggcuugguagagcgaacauucucguguuucaugggugcagacgcugagcuaagaaugccgcacgcauggucucacugcagcguccucacagccucucagcucgggacucacagagaaaacuggccauucauuugucuauucauucauugauucgucuauucauucauucacucauucauucauucauucauccauccauccauucauucauacacucagagaagggacacgccaaacaaugccauucaagucgaggucccacagaugcuaaagccccuuccugaccuccacccgccccaaccucuacuguggugacagaagggccucaaccuucaccucaaagccaaaucccacauccaccccaaaucugacccaauucaaccuuaaucuuugcaacaguguuagaaugaucugccgugaaaucaacuuucuugccauucaaugauguauaaccacugcacguuuauguuucauucacacauuuacucacuaauucaaguguuagaaugaucugccaugaaaucaacuuucuugccauucaaugauguauaaccacugcacguuuauguuucauucacacauuuacucacuaauucacucauccauccauccauucguuuauucacucaucucuucagucauuuuguucacuugcgccucuguccauucauucaugcauccauucacucauucacucacucauuuguccauucggccacucauucauucauccauucauucauauucaugcauccauuaauuuacuuauucauccauuaauuuacucauucauccauucauucacucauuuauucgugcacauuuauucauucacauauucauauauccacugauuuauucauuuuuccauuaauucacucauucacccauucauucccucguucauccauucauucacucguucauccauucacucacucguucauccauucacucauuuauucauccauuuauucauucacguauucauccauccacugaguuauucacuuguccauucauuaauucacucauucauacauucauccacucauucauuaauccauccauccacccauucauucauucauccguguucuggggguuacucaugagaucaguaaauuagaggaugcaaucccuggcuagaagucugggagaguuuuggccgagcgcgguggcucaugccuguaaucccagcacuuugggaggcugaggcaugcugaucacgaggucaggagaucgagaccauccuggccaacauagugaacacccaucucuacuaaaaauacaaaaauuagcugggugugguggcgcgugccuguaguccuggcuacuugggaggcugaggcagaagaaucgcuugaacccggaagacggagguugcagugagcugagaucgugccacugcacuccagccuggugacagagcaagacuccaucucaaaaaaaaaaaaaaguuugggagagcuucaaguacauucaagugcccccucccaugucugcccccacuuccccccaggacucaccacgcucccuuuggcuccauccucuccagggggaccuuucuugccuggggguccagcagcuccagaugggccugagucccccuuuucaccaaugucucccuugggccccuuuacagaaagaggucagaggucagaguggccuggacucuccagggaucaaggauuagcauacuuggauucaggcauugggguggucugggacuuuucuggggucaggguucagaguagccuagguuguccaagggucaaaggucagaaggagcuaggacuuaagacagugaaaggucuggauggucuaggugcccauuggucaugugcaagguuggccuagcccaugugcugcccuugagugaauuagaagaggggccccaucugggcaacucauccucaggucaggacucaugacucagauuugagcccucaccuauccccugggucauguagucuuguguagugugcaaccugcagaacuguacauagcagcccuaucugagaacuuccagguguccuuccucaagguaaucagggacggccacaggacaggggugaguggaugaucuugcacuguccagaggucaaaguggcccaagaugcccaggggucagggguucccugaguugggugcagggaccacaucacacagucacucaccgggaugccuggggcuccuggaggcccugggucuccagcguccccucgcucacccugcaggaggcaaagugagaguggggagaggucccauccuagcagacagggaggggcuccccagaaugucccugcccaauaggacuagauuuaucucuuccccccgugcagccccugccuucccucacucaccuucucacccacggcgccuggcugaccaacuccuccaggcagcccuggagugcccuggagagacagcaagggguaagagugggacuguggaaucccaacauccucuucuuaggaaaugguuguccccaucucugagccuuccuggccccccaagaguucucaccucugauccaguggggccuuggggaccccgaggaccuggagcuccauggggacccuguggaaggucagaauuaguacccagugaccccaggccccucuccccaaaaggccacauugaccacagauaccacugucaaugcuggugacccucagggcccuuaaaaugacaaugucccucaaaugaaucuaaugccugccgccaaccuauaaccccaccauccucccccucccaccuuccucugggagugcauaccauggacccgacgucuccgaccuccccuuucucucccggagggccuggcagccccuguggaacaaagaagcaagauuggggcaccagguagggagaaucagaagugccacccccaaacccagacacccaccugcaguccaggagggccaaucacccccacaaagccucugacuccgucaucuccuuucugcccaaagaggccuggggguccccggcgccccugagccccgucugcucccuggaagaacacaaacaggggcacauuuaaggucugggucagugauuagggcagagugaggcucaagggucaagacugagguuaaggguuggagucaggguucagauuaaguuuagagagggucaguguugaguuggaguuggggucuagguuaaggaacagggcuugggaaugaagucaaggguugagucaaaguguuaaacagugagucggauuugcaguugagguucaguucuugggcaggguucaacugggguugagauggaauuuaggguuggguuugagguugggcccagggucauauucaaaguuugaguucaggucuggggucagcauuggaagaguugggucagaguugggguuaaggauagggccguauguuccuauuguaugguaauaaacaaaaaaggacaggucugggucagggcuugguuaagagauuugaagauaaggcuuuuguuuguuuguuuguuuuuguuuguuuguuuuuguuuuuuguuuuguuuugagaaggagucucacucugucacccaggcuggagugcaguggcgcaaucucugcucacugcaaccucugccucccugguucaagcaauucuccugcuucagucuccugaauagcugggauuacaagugugugccacugugccuggcuuuuuuuuuuuuuuuuucuuuucccucuuuugagacggagucucccucuaucgcacaggcuggagugcaguggugcuaucuuggcucacugcaaccucugccuccuggguucaagcaauucuccuggcacagccucccaaguagcugggauuacaggggcccgccaccaugcccagcaaauuuuuuuuuuguauuuuuaguagagaugggguuucaccauuuuggccaggcugauauugaacuccugaccucaggugauccacccgccuuggccucccaaaguacuaggauuacaggcaugagccaccgcaccuggcuggagauaagguuugaguagaacugagguuaaggucaugaguagaguugagacuggggcugaaguggggguucagagcuggguuuagguuggaauuuagucugauuuuaagguugaguguauauuggacaucgauauagaggggcagaucaaaguugagcaugagguugagauugaaccagauucugggguugaguccauauuggauguuggcauugaggggaagacaugguuggaguugagauugagccaaauucugggggugaguucauauuggauuuugguauugagggaaagacaugguuggguugggacugggcaggauucuggaguugaguucacauugggugcugguauugagggggaacacaugguuggguugggauugaaucagauucugggguugaguucacauugggugucagcauugaggggaagacaugguuggauugggauugagacaaauucuaggguugaguucauauugggugucgguauugagggaaauacaugguuggguugggauugggccagauucugggguugaguucccauuggguguuggcauugaggggaagacacgguugggucgggauugaaucagauucugggggugaguucauauugggugucgguauugaggggaagacaugguuggguugggauugaaucagauucugggguugaguucacauugggugucagcauugaggggaagacaugguucgacugggauugagccaaauucugggguugaguucacauuggguguuggcauugaggggaagacauaguuggguugagauugggccaaauucugggguugaguucacauuggauguugguauugagaagaagacaugauuggguugggguugacuccgaauuugggauuggguucauacuggguguuuguacugaggggaagacaugguuggguugggauugaaucagauucugagggugaguucauauugagugucgguauugaggggacaacaugguuggguugggauugacuccgauucuuggauugaguucacauugggugucaguacugagggaagaucaggguuggguuugagguuuggauuaagucagugugcuuccacugucguuugcucccacuaucccucccuucaaggacccagagaaggacugaaaagaugggggcacucaccgggggaccuggguguccugcaggaccccguaucccugguuguccaggugggcccugggagaacaggaaacagaaucaaaaauucccucagguuuaagauuagagagggcacuggagcuaucaaucacugccucccacacccccuuuaugagaacaacuuccccuaccaggcagcaacagcuacauccccccaaauccugucuucucagccaccaacagaugggaucagacagacgucuguccuaagcccagcccuggccacaaguuccaccaagacccagggacgaagcuggcucaaugaugcaagccacuggagcugacauucgggguggggggaaguuggguaucagaugcuucagugccugccacgcagagucacaggcagagggaaggaugugucacuaacaauggagaagguuacccgcaccccagugccuuuccaguucuuugggagccccagcugucccuauccugucugcaguuggguucuguggacccaucgcuccaggcagcucaaguaccuucuguugcauguaauugucaagaugguacccgagaaggcagaaaacuccauggccucuccuaccccauggagaaugaucucuacaucccuggccuccucuuucuuccgcuacccaccccacccugccccacuggggaccuucacucaccgcgucuccuuuaucgccuuuacuccccuuguguccgggggcacccacaucccccugcagaggaaaugggaugaaggacccagcuuccauucacccccauccuccccuggacccuuccucucugugaaccccucaccuuguccccuuccucgccagaaggcccagcagcuccagggggucccagaggccccaggggcccugggaucccaucuuugccaguggggccaggggggccacguucucccuguuguggggaauggaaagggggaugucagggcaggaauguccugcaggagccauguccugggauguggcagggccagacccugaggaggcccuaggaaugggaugggcaagucacuuacccgggaccccuucuugccugcagggccaacggggccuucgcugccacuuuggccaggaaguccaaugccuccugcugggcccaaaggaccgcgcucaccaggggagcccugagaacaggggugaugaaucagguauaauaccaguaguagcuguccuuuauggaggguuuuuaagccaccaggcacugaguucugagguuaccaggauuguaucuaaccuguuccccuccugcagcagccagagggugccugugagcaccugaggggcagggcauauucuucuccugcucaagaacacuccauggcucccaucucacuuagaacaaaagccauaguccuccuggcagccuauacauauauauauauauauauauauauauauauauauauauuuguagagacaggaccuggcuauguugcccaggcuggucucaaacuccugggcucaagcgauucuccagccucagccucccaaagagcugggauuauaggcaugagcaacuacaccuggcccaagaaaagggguuuuuauauguugauggccaaugcacagguaaguauuuacuggauaaaugaucucaaugagguuugugaucauacaugagauaaggcuucccaucauggcuauuuuacagacaaggaaacugaggcuugccaaggaauacaacggcccagccagugagcaacagaacugaccuuggcucauugcaaccuccaccucccagguucaagcgauucuccugccucagccucuagaguagcugggauuacaggcaucugccuccaugccuggcuaauuuuuguauuuuuaguagagacgggguuccaccauguuggccaggcugaucuugaacuccugaccucaagugaucugccugccucagccuccaucauggguuuuaucaugacaaugucaagcuuccaagacaccuugaguccccuccacccugcccccacccagcacaugggguuauacuuacauuggcccccacgggcccuggggggcccuuaucacccuuuaagccaguaggucccugaaggaggagauaauucacaguuaagagacucccaaagguguccccagguccugucuuccucuguggggagcucacaguccccaccucucuccugggacuggacacugagcuuugaggggucugccuuccccaguucccuccaccauuuuuuuugcuuucaucauuucccgcaccccaaaugcuauuccccaucccuccccugacccccccauccuuuccuucucuaagggacaugcaggagggucuccaaagauacucaccggguccccagggcccccuuuggggccgggaaagccccugaguccagcuggcccuucuuucccaagggguccugguggucccaguucccccuacaggagugcaaaggagggaagucaagcuccagggaggggaugucucccuccaaucugugacucagggcccccucccccaugagacugauucugaguccuugguugaucuuggauguucaaccaagaucuccaguggacagugucucaccuuggcccccucucugccuuccaggccaggaagaccuuguucaccaggagguccaggggggccuggaggcccccuuucaccuagaggucccacuucuccugucuuucccuggugaggaagaaggcuccuguugaguggggguggccuaggggagucgcucaggaguccagcuuuccccuaaauaucccccaacugguacaaaacaagggagguuuauggaguccacucugaccugagggccuaagacaccagcugguccaggcgggccugucugaccuuggaagcccuagagagaaaaauuaaaugugggggcgguguuacauggggaagggauggaggagcaggagacagggaaggccugauaggaucaggaaucuggccgguccgguggcucacgccuguaaucccagcacuuugggaggcagaggcaggugggucacuugaagccaggaguuugagagcagccuggucaacaugaugaagccccgucucuacuaaaaauacaaaaauuagccgggcgugguggcacgcgccuguagugccacucgggaggcugaggcaggagaauugcuugaaccugggaggcaaagguugcagugagccgagauugccccacugcacucuagcccaggugacagagugagacucugucucaaaaagaaaaaaaaaaaaaaggaucaggaaucaaagguugagggguuacucaccaguucuccucucuguccagggugcccuggucgcccaucuuuaccuuggugacccugggggaugaggugggaaaaaguuggggcacagauacagggcuuccucccuucccacauccuccacccacccaacccccaaugagggugaccucacucacaggggggcccuuuggcccagggaauccuggagggccuugcagaccagggaggcccugaaauggaaacagaaaucaugaucucauccccccugccucccugcccacucccugagccccacauaaugacaacaggaucgagcacauauugagugcuuacugcaugccaggcaugggcagggcauucuccacaagucagucauuuuauucaccacuguagcccuuuggguuggagacugagguuacucccauuuuacagaggagaaaacuaaggcacagagugguuaagugacuugcccaaggucacacaguaggugaguggcagagccaggacuugaacucauggcucucugacuucacaggcugugcuccuucuuuuuuucuuuucuuaaagauggagucuugcucugucacccaagcuggagugcaguggugugauuagcucacuucagcuuccaacuccugggcucaagcaauucucucaucucagcuuccagcauaggugggacuacaggcgugcaccaccacacccaauuaagcugugcucuuaccacugcauuauaaugucucuucaucucuuggguuuguccuccacucagaaucucucucucucacacacacacacauucacacacacacacacacacacacacucaccuuuucuccagggaucccaggggcuccauccuggcccacaucgcccuaggacagagugaaugagacucaggccccagaacaaacucaacugggaagaauuuggagggacuggcugagccuggggcauggggggccuugauugcccacccaucccauaccuuggggccugguugcccuguggcacccgguugcccccucucuccacgggaacccugaacaaaaaaaaaaggcaaagaucagauaugagggggugggggagccugggagaugagaccaagucuuccagguccccuccccuugugacucccucuccugcccgaccagggacauugauauaacccaaacccuuucccugcccacagaugaccucuccacuaccuuuccuucccagcccuguccccaagucccagcaggguagggggcacugucuauuuucuuacuggugguccccgcucuccuuccaggccuggcugcccugucuuucccugaaaaugaauuguaagagagaaagcagaagagaguuagggugcaaagguaugacgcaaacacaaaaagacacccagucacagacccagaaagcugucugccacauauuuauucacaagcuuuucagucauacacauacacacaaauacaacuuauacucaaaaccacacaaagaucucaaacacacaauuacaacuaugauugcaucuacagaguacaaacgugcaagcauguuugcccacaagacauauauugaucacagcugugcaguaugcauacaugauugcauguaaucauggcaugcauuuggcaauccacagccugaagaugacacagaacucaucaugcaauacaucucuugcacacauguauacccacuguaaacacaugaaggccuggauucagcugaggacuuugucuugguaagcacagcaguauacauacacucauguacguacauacaauguucauuaacacuguuacaauacacacauagcaacacaaauacaauacaugcauguauacccaucacucagugugcacagaaacacacacauguguauacacauguccuuucacgcauauguacaagcuucuugcacacauuuaugcccaccaucaugcaaagugcacgcagauucaugcccuuguucacccaggcacaggccugcaggcugcggcauucaaacccugucucaucgauauugaaagauacaugaaacacauauacaugugcuuacagucauauucaugauaauaccauguguaaucaccuacaugugucaugcauugcauauaauagcaugugugcacacaaauguuccaggcauagacacaaacacccaggguccacccaucaucagacacaaccacacaugcuguuccccucagacaaguucuccccucucccuuacccccggucaugacucaccgacuucccuuucucuccuaugggucccaggggaccgggaaauccaauagaucccugaguggagagaauuagaaagaagacaugagggugaggagugagugguggguggaauuggccccucauaccauccuuugaggcauuuccaggucacugauuccagaagcuuccuuggucucuacagccccagccuccuacaaggcagcccucuucucuccucuccccuccucuccucccuucucauuucacugcagcccuuugcacuggcugcugucuuuggcugaaaugcuugucuccuaggccuccacaaagucagccacuccugaccauuuagaucucauucagaugucaccuccuuagaaugccuuucuaccaccauccuggcuuccacauugcccaagucacccucugucugucacauuaugcuauuuuguuuucccaagaacacuugcguugaaaugacccuuauugacuuauuuauucaaugccuguuuucccccacugugacauagcucauuggucuuauuccccacugccuggcacacggugagugcuuuuuaauauuuguuaacugacuccaguccaugcuggaggaacccuuccuccaccugggggaagacaucacaggcucugauauccucucccacaccucacugugcagacugaguucagaucagaaaagacaguugcccaaguuacacagucugugguggcaucccgccucaaagcccauuucaggcucccucuacucucccuucccaucuggggguuccauggucucuauacucuuuuuuuguuuguuuuauuuuuaagagacagagucucacuuugucacccaggcuggagugcaguggugcaaucauagcucacugcagcuucaaccuuuugggcucaagugauccuccuaccucaaccuccugaauagcugggacuacagguucacgccaccauguccagcuaauuuuugaaauaaauuuuuaguagauauggggucucacuauguugcccaggcuggucuugaacucccggccucuagugauucuccuaccucagccucugaaagugcugagauuacaggugugagccaccaaccuggccccaacacucuucaaggauccugaacacaugcacacaaggacuuucuaaaaucuuagucuaugucagguacaguggcuuaugcuuguaaucccagcacuuugggaggccaagguaggagaaucacuugaagcugggaguuugagaucagccugggcagcauagcgagacccugucucuguaaaaaauuuaaaaauucaucagguggugcgcaccuguuguucccagcuacucaggaggcugaggcaggaggacugcuugaguccaagaauugggggcuguaauaagcuaugaucgcacuauugcacuccagccugaaugacagagugacacccugucugaaaggaaagcaagcaagcaagcaaaaagaaagaagaaagaaagaaagaaagaaagaaagaaagaaagaaagaaagaaagaaagaaagaaagaaagaaagaaagagaaagagagagagagagaaagaaagaaagaagagagagagagaaagaaagacagacagaaagaaagaaagaaaaaagaagaaagaaagaaggaaagaaagagaaaaaagaaggaaaagaaaagaaaaaagagggggacgcagugagggagggagggaagaaaggaaggaaggaagaaaggaggaaggaaggaaggagaauaaaguuguccaucaaaacuaagcuucaaaguuuuuuucucaaucguuaaaaagaaaaaaaaaucuaaguuaaaggaaaaggagucaauguaaagggaaaucacugaaaaaauaaaaaaaaaaaaccacugucaaauccaacguaggcaagauaacuaucagcucaacagcacaaaaaugugaaacucuaggaggauucugcacucaauuaucuucccaaaugucuauuuuuuuuuucuuuugagacagagucucacucuguugcccaggguggaguaaguggcacgaucucagcucacugcauccucugcuucccgggcucaagcaauucuccugccucagccuccauguaccugggauuacaggcacccgccacugcacccagcuaauucuuguauuuuuaguagagaugggguucugccauguuggccaggcugguggugaacucucgaccucaggugauccacucgccucggccucccaaagugcugggauuacagccaugagccacugcgcccagccccaaaugucuuuagguuccugcucuacucuagagaaacagaacucaucagugauauaauaugggaauaguuuaggcagaaaaaugaaucucaucaguguccucacccaucaaaacauuggcaaacaaauguuauguuuucauauaaguacguuuuugcauaaguacauuugacuauaaguuauaauuaauucaagauauguaagauguguauuuuaugauucuaugauucuccccuuuaacugacuuuguuggugaaugaaacuuaaucacaccaaauaaaaggauccuacaguuuuauaaucauugucaucaucagcauuaucaacauuauuauaaucaaauugaugagguggaaauuacugggaugucuguuucaccgcagagaaaacaggcucaagaaacuuucccaagaucacauagcggguaagagggcauuugaccccaagucugucugaugucaaagcucacuuuuuaaaaaaauuuuugagacagagucccccucugucacccacgcuggggugcaguggcucgaucauagcucacugcaggcucaaucuccuugggcucaggugauccucccaucucagccucccaaguagcugggaccacaucuggcuaauuuuuuuuuuuuuuuuuuuuuuuuugagauggaaucuugcuuugucaccaggcuggaguucaguggugagaucuuggcucacugcaaccucugccuccuggggucaaacaauucuccugucucagccucuuggguagcugggauuacaggugcaugcuacuaugcccagcuaauuuuuuuguauuuuugguagugacaggguuuuaccauguuggccaggcuggucucaaacuccugaccucaagugauccgccugccucugccucccaaagcguugggauuacaggugugagccacugcccccggccacaucuggcuaauuuuuuuuuuuuuuuuagauggaguuucguucuuguugcccaggcuggagugcaauggugcaaucucagcucaccacaaccucugccuccuggguucaagcgauucuccugccucagccucccgaguggcuaggaucacagguaugcaccaccacacccagcuaauuuuguauuuuuaguagagaugggguuucuccauguuggccaggcuggucucuaacuccugaccucaagugauccgccugcgucugccgcccaaaguguugggauuacagccaugagccacugcgcccagccacaucuggcuaauuuuuguauguuuucauagggaccacguuuugccacguugcccagucuggucucgaacuccugggcucaagcaauccucucaccucagccucucagggugcugggauuauagccaagagccacuaugccuggccaaagcccacauuuuacauucucucagugacccuuggggugggcagcucaucccccaagaccacagccuggacccccagauguuagucucugaauccugcccauauccaucuccaccccccacccccagcuuccuaccuuagguccagggcguccuggauaaccugggaggccuggcaccccaagcuugcccugcagaaagguuaugggacaaaggucagaaauugcaaccuggaggucagaggcggaaaggucaggcuggcuggggcauggugaaugggcuaaugggaugggaguuggggaaacgagguucaaguccuugcuccugccugcuaggggcauguccuugggcaggucauucagccauuccaagucucaguuuuccuugucuguaaaaugggaugaaaaugccuauugcauguggugguuauggauaugaacacauaaguugcaugcauuaaauugcucuguaaugcugagcugaggaauuaaagaugacaagguugguagcaaccuccugaggucgaagguauaauaaaagggcaaagggcagagggaaaagauuggggacaccuugacugugggaggcuagaggguggagagucauuuaccuucuccccagcugagccugggggccccuccucgccagccugccccgccugccccuucggccccucaggaccauccucuccccggggaccuggagcuccggguuuccccuggaagaaaaaggagaguauuuaauauccaucuuuuguccuuccugcucugucuagccccagcucauccccucccuaucuuccccgagcccccagacccacaccaccccucaucuggagcuggucuuaccugaucaccuuugagccccacaucgcccuugaagccugggaagccguccucucccugggugggagagacagaggccagaagugagggccucggggaagggacacaaccaggaccccaugauugggacucccucuccucugaugaguuccuucucuccucaccuucucgccuuucucccccuggaggccccgguugccugaagugcccuggaaaauaaaaaaaaaaagcucucaagccucuucccugcuuaagaagugacccagacucaguccccugcucuaaagcagccaggauagucccaagaggaggcuaggcagaagcugggaggggcagcuucagaagaaaugaucuuuccccagaggccccucccuccccacuggaggccucucaaggucaucugugcgggggugugcagggaaggccaaauuuccaaguaagcgauucccaucuccuggagacgcuuuguccacaguuccuucuggcaggagaaagaggaugaacauuccaggcccggaccucauuuuaaaggcaaaggaauguuccccauugugccagcuacaaggcgacucugugcuuggcaacaagaugaccucugugcuuggcuauggagagagcgcuuaguucaagucuggaugcugcucacaccaaacucugaaaacugcacuuggcuacaacaucucugagcucagcgggcuacaaugaaauugcgcuuggauacaauacagcccaugugguuagucuccagcuacagacaaauucacuugaucacaauguaacugagcuuggcuacaaguuguucucuagcuuuggcuacaauguaacuagacucaacuacaacauagggguuggcuacaauguaacuagacucaacuacaacauaggggucaguuaauguuucuaaaggcugggcaugguggcuuacaccuguaaucccaacauuuugggaggcagaggcuggaggauugcuugagcccaggaguuccagaccagccugggcaacacaggaaaaccucaucuauacaaaaaguacaaaaaaaaaagaaaaaagguagccggauguggugacgugcaccuauagucccagcuaccugggagggugaggugggaggauugauugagccugggagcucuaggcugcagugagugaacugugauggugguacugcacuccagcguggguaacagagugagacccugucucaagaauaauaauaauaauaaucaaaugaaaaaacugccaagccuggugggauacgccuauaguccuagcuauucaggaggcuaaagugaggggauuacuugagcacgggaguucaaggcugcagugagccaucauuaugcugcuauauuccagccugggcaacagagaagacccugucucuaaaaaauaaaacauuuagggccgggugugguggcucaugccuguaaucccagcacuuugagaggccgaggcggccggaucaccugaggucaggcguucaagaccagccugaccaacauggagaaauccugucucuauuaaaaauacaaaaauuagccagacgugguggcacaugccuguaauaccacuacucgagaggcugaggcgggagaaucgcuugaaccugggaggcagagguugcggugagcccagguggcaucauugcacucuagccugggcaacaagagcagaaccaggucucaaaaacaaaaacaaaaaaagauuaaaaauguaauuaugcuuggcuacaauguaacucugagggugaugcuugccagacucugugccugcuacaguauagccaauuccuugauuauagugugucuaagcuugucuaaugcacacauguucagguaaauuacaucuguauuuggcuacaaugucacuggacucagcuuccauauggauaugaacucuaaugccccugcaccucuauuuagccagguugcagcucuuggcuuaacccagcauacugugcuuaugugauucugagcuuggguuagaacacaacccucgggccaggcacaguggcucaugccuguaaucccagcacuuugggaagccaaggaggguggaucaccugaggucaggaguucgagaccagccuggccaacauggugaaacccugucucuaauaaaaauacaaaaauuacccaggagugguggugcaugccugcagucccagcuacucaggaagcugaggcaguagaaucgcuugaauccgggaggaggcagagguugcagugaguggagaucgcuccacugcacuccagccugggcgacaaagcgagacucugucucaaaaaaaaaaaaaaaaaaaaaaaaagaaaguaaagaaaagaaaaggaaaaaggaaaagagaaaagaaagaaauguguuuggccucuaaugggcuuagcuguucuaacaacaaggugacaaccacacuguaaggcuguccuuggcugugcagcuccaaaccccagucccacuacauuuggccuggccaacugauuccccucuccacacauccagaaguuucugauggagcugcaucgcaugccugaacccaaagcugguaaaucacucauaccugcaagcguaucaccuaccuucacuccccgagguccaggauagcccggagggccugccgacccugguggacccugggaggaaaauaaggucagugccauucuagacagucccuuccacauucuaagagcccucaucucucuccucuguggccccugacugcaggcccugccucccgacccucguccccaacccagccuaaccuccuggucacucaccugagccccuuucucucccguggggcccucauguccugggugacccuggggaagaaacauucucaguugucagagaccaaaacuugccauuccaauucccaaggcuccccuuucuccuuccuccuuuucccagcucaugguucucaccagagggccaucggauccugggaggccuggaauuccuggguuuccagggggacccugaaagaagaugaacagcaggggagagacagaggugcucagagcccuggagcaccacuaggaucuacgcagacaugcagccgccucaagguuaagaaauaagcagaccucacuggccaggaaaucuaucccagcucugcccaaacuugcugugugaccccaggcaagcccauuucccucucugauccucagaaauccacugccucugggaagguugcaaggaagaacauaaaaacaguacaagauugauagcacaacaggguaacuauagucaauuauaugucgcccagguuggagugcaguagcaugaucucagcucacugcaaccucuucccagguucaagugauucuccugccucagcuucuccaguagcugggacuacagcacccggcuaauuuuuguaauuuuauuagagauggaguuucacuaugcuggccaggcuggucucaaacuccugaccucaagugauccacccaccucggccucccaaagugcugagauuacaggcgugagccacugugcccgccuucccuggcagacacacuucugugugauaauuuacuuguacauuuaaaaauaacuaaaagaggccgggcgugguggcucauaccuguaaucccagcacuuuagaaggccgaggaggguggaucaccugaggucaggaguucaagaccagccuggccaacauagugaaaccccguuucuacugaaaauacaaaaauuagcugggcguaguggugggcaccuguaaucccagcuaccugggaggcugagguggcagaaucacuugaacccgggagguggagguugcagugagcugagaucaugccauugcacuccagccuggacaacaagagugaaauucugucaaaaaaaaaaaaaaaacuaaaauaguauaacuggauuguuuguaacacaaagaauaaauacuugaggggauggauacuacaugacaugauucuuaugcgcaugccuguaucaaaacaucucauguacuccauaaguauauaccuacuauguacccacaaagauaauaaauaaaauuaauuuuuuuuuugagguggagucucgcucugucgcccaggcuggagugcaguggcaagaucucggcucacugcaagcuccgccucccagguucaugccauucuccugacucagccucccgaguagcugggacuacaggcgcgcgccaccacgcccggcuaauuuuuugguauuuuuaguagagacaggguuucaccauguuagccaggauggucucgaucuccugaccucgugauccccccaucucagccucccaaagugcuaggauuacaggugugaaccaccgcaccugaccaauaaaauuaaauuaaaacagugcaagagacauguugaaauagaagcuucacagccacaccccuuucuuuaaaaaugcccagccgggcaugauggcucucgccuguaaucccagcauuuuggggggccaaggcagaugaacugcaugagcccaggaguucaagaccagccugggcaacacaggcagaccccaucucuacaaaaaaagaaaauaagaaaagaaaagaaaaauuagccaggcacaguggcaugcgcugauagucccagcuacucggguggaugaggugggagaaccaccucgccuggggaagucaaggcugcagugaggcauuauugagccacugcacuccagccugggcgacagagugagacccuguccacaccccccaaaaaaagauaugugcagaaagaagugugucugccagggaaggcggaagcagaugugccagggaacaaagaugagacccacagggccugugccucuugguaauaucuucugugacaggcuucugugggcucucuguauccugacaauaucccuuaugugagcuagccuugguggguuucuguuucuugcaaccaauccuuccccaacaaggacacuuuguaucuccgggcuggcuuagggaauguugcagucuaucacuauccagagcuaacagaggggucuuggugggaagauuuuccuggcaacagaguugaaggaagaagacuugaggaggucgcgguagguggagcugucacucaccuucuccccaggagugccaaugagucccuggggaccggggagucccuggagacagaaaaagaagaugagagaaggcauaagaaagaagcggugaguguggagguugggaagccuggucacggucuaaggucuuaacugaccacucccaugccccauuauugggaaagacaguucaaaccugggacccaugguuucccugcugucccggagggccugguucuccuggaggacccuggggagaaagugggguuucagugaagcuaagaggggucaugguguuggggcguuagugaaauugacuuggggggggucagucauggaagggaauagggauguggacaaucggggucagagugucagaagggucagaggucaaagggcacagggcacauaccacauugccuuuggcaccaggagcaccaucaauuccagucacacccuaggggaaaagaggaugugagaccaagacagagcaacaagcugggagccugagucugagacaccgagagaugcagguggaaaggugagcagggccgggcacuguggcucaugcuuguaaucccagcauuuugggaggcugaggcagguggaucaccugaggucgggaguuuaagaccagccuggccaacauugugaaaccccgucuuuacuaaaaacacaaaaauuagccaggcauguaaucucagcuacucaggaggcugaggcaggagaauagcuugaacguggaaggcggaguuugcagugagcagagaucgugccauugcacuccagccugggcaacaagagcaaaacucugucuaaaaaaaaaaagaaagaaagaaaugugagcaggcagagaagccagcaacagauauggacaugcagaaggcagaaaagcgagaaaaaaaagacagacaggggccaggaacaguggcucaggccuguaaucccagcacuuugggaggaccacuugaggccaggaguucgagaccaaccuaacuaacauggugaaacccugucucuacuaaaaauacaaaaauuagccaggugugcuggugggucccuguagucccagcuacucaggaggcugaagcaugagaaucaccugaacccaggagccggagguugcagagagcugagaucucgccaccgcacuccagccugggcgacagagcgagacccuaaucucaaaacaaacaaaaagacagacagggaugcagagagccagugacacucaccgggcgacccguggggccaggagagccucuggggccaagcaguccucguggacccugcaagggagcaggcgaauuauuuccacaucaccucuguguggccaugugagcucuagggguccuaugaguccuggggcccugggaguccugacucccuccccugcaccaagcaaggggcccagggaucccugauacucaccggcuccccagccuggccagugggcccuggaggucccucugcucccuguggaaaagcgucauuacuugggaacaggaagguacaacccucggagagccaccuccccucaucugggcagccccuuccagggggucucggaauuagaccaggaucccugggaaccugcagacuaaguucaugggauuccauucaggccccugacuccaauccuagaccugcaagucucaccuccucaccccacaauuugucccuagcucucaagcuggccacugagaccuccagaucuuccucucugauucucacucaggcuuccaaacuuacuuuccaaaccaggcccuaacucucuuccaaacuuacccucucaccauccucuccugggggaccggguugccccacauggccaaagucacccuggagagggaacagaggggaguucagaguggaagggugugggcggagagaccagcccccugggaaggcagauggggugugaggagggacacagggaucaugacucugauacugagggagaaguugggggggcuugaauauugggaggagggcuuagacuugggggagggaccucacacacucacccuuuggcccuucucaccaggcagcccagggaggccaucgaagccacgaucacccuguccagagacaccagugagccuugaccccauaagccugacagcucccaccaagucuuaucucagcccccaucaccuaccuuagguccaguguccccugggaggccccgagcuccaucugcuccagggcggcccuauggagaaaguaagcccaagagucaaggaugagccuucccuguaccccuccaccaaauuaggaacccaacuucaucaucaacaucaagauuuuuuuuuugacagggucuccuucugucacucagguuggagugcaguggcacguucucagcucacugcaaccucagccuccugaguagcugggaccacaggugcaugccaccaggccuggcuaauuuuuuauauuuuugguagagaugguggggguuucacccuguugcucaggcuagucucaaacuccugaaugcaagcgauccacccaccucagccucccaaacugcugggauuacaggcaugagccaccaugccaaggcuaagauauuauuuuuuuuaauuuauuuauguauuuuagagcugaggucuugcucucuugcccaggcuggagugcaguggcaugaucauggcucaaugcagcuucgaauuccuggcucaagcaauccucccaccucagccucccaaguagcugggacuacaagugcacaccaccacaccuggcuaauuuuuuauuuguauuuuguguagagaccggguuuugccauguugcacaagcuggucucaaacuccugggcucaagccauccuuucaccucagccucccaaagugcugggauuagagauaccaguugcuaugccauggcugauuuuauuuuauuuuauuuuuuugagauggcgucuugcucuguugcccaggcuggaguuacauauauguuuuacauauauauauauauauauauauauauauauauauauauauauauauauggucacaugucacugaacaacagggauacauucugagaaaugcaucagugggcaauuuugucauugugugaacaagauagaaugcacuuacacaacucuggaugguacaaccuaccaaacacccaggcuaugcgguauaaccuagugcucucagacuacaaaccugaacaaugugcgacuguacugaauaucacaggcaauuguaacacuauaguaaguauuuguaugucuaaacacauccaaacauagaaaugguacaguaaaaauacaguauuauaaucucaugggaccagcaucuuauuuauuuauuauuauuauuauuauuuuuugagacacaaucucacucugccacccaagcuggugugcacuggcucacugcaaccucugcuuccuggauucaagccauucucaugccucagccucccgaguagcugggauuacaggcgcacgcugccaugcccggcuaauuuuuguauuuuuaguagagacgggguuuccccauguuggccagguugaucucaaacuccugaccucaaaugauccaccugccucggccucccuaagugcugguauuauaggcaugagccacugcgcgcagccaaucaucuuauaagcaucauuauguggugcaugacucuaucugaaguugacuuguuugucauuuccuuccaugugacaggccucuuuuuugccgugcuguuucuuccacuuccccaucuguucaucugguucuauuucagaucucagggcaagcaucacuccugcaggcaaguccuuccugacucuacggccuggccggauuccuuugacacacacucaguggagcugccauucccugccuucagcacucuuuucccacuaacgacaccagcagaccccaaggucacaaagccaaggcucauguuggguguugagggauggauaagggguggucuggggaccuagcugucacucaccaucuugcccacucggccaggggguccaugaggucccugcaggccucggggacccuagaagaaagcaaaaaggaggaaggaaaggaaaauaagaagaaagagggacuuauucuauuguauuaaaaaaaauuagagauggggucuugcuguauugcccaggccagacaccugggcucaagcaauacucccuccucagccucccaaguagcugagacaagugugugccacuguacccagcuuggaaggacauauuuauuuauuguauagacagggccucccuauguugcccagacuggucuugaacuccuggccucaagcaauccucccaccucggccucccaaaguucugggauuccagaugugagccaccauucucuaggaaagucaucaauugcaaggguauccccagccccuuuggcacuuuccccauccagcacuguaucuugugguccugggggaaggcuauucccauccuauccugcccuaucuccacaagucucaccuguggcccuucugcucccuccucuccuuucagaccuggaugcccggggagacccuugggggaggagagauggaggaguguggguagaugauucuucacuaaugcaugcaccgcccccuccacgcagucgccuuacucaccacagggccugggcgcccagugagccccacuggaccaggggggccuuucauagagagcuggaaagacagaggagucagagcuuggggccucccacaagacccccaacauuccccacagaggcaucuucaggagaaaaauaacccccuucuccugcccagccccuccuuacgccgaggcucuaucacucucugggguuccucccacuauguccacaccucccacucaccugagucugcugcagaacugccugagccugggccugcuggaaugagacuggggggccuuuaaaggagccgccugcaaacuggaacugggaggaauuuaguggugagggaagcccccaggagaggcccccuccuggaucaggacuccacuccccaaggcugggccacuccaucuccuucuuaccggcaucaugaucacagugcccggugggccucggaucccaucaaugccggggauuccugggaggccagcagggcccugagagagggaugggggaagagagguggagacagggagagagggagagagagagcgaggacaggggaggcacagaaggaugagucagaaagagagagagagggagagauggagagagacacagaaucaaagagggaucauggcaaggaaagagagagaaguagagagaaguggaaaggaaaagacagagauggaacagagacaaagagaaggggagagagggauggagaaggaugggggcagauggagagacauacagagacagaaacagagagacagagagagauagacagagacagaaaagccagugaaagacagacagagauggagaaauagagagagaggcgaacauagagagauggacggagggagagggacagagaccaacagagagagacagaagagagacagagacagagucacaacaggagaaagacagagauaaaagacacucagaaacagagacaggcaaaagaagaaaagcaaagaguaggccccagcaacacaaggugaaccagagaaauaguucacagaugggagacagagaacagaagaggucagugccagccccgggaugguguucccgagugccacacccucauaucuauguucagacugucacgcucccagccccaaaccucacuccucugagaaguguacaccccagugggagucucuuaccgguggaccagggucgccagggaauccuggggggccgggagggccugaggggccaaccacccccuguuggggacagagaaacaggagucacaggaagugcaaaguuugagcuaggcugacuuucaaccuaccacugacucuaaccucaggcugaccucccuaccccacuacagagccacuccaacuccccuaaugcaauacugacccccacucacccccaacgcuacucucggaccccucuucuuuuuuuagagacggucucacucugucacccaugcuggagugcaguggcgugaucauagcucacugcagccuccaacuccuaggcucaagcaauccucccaccuuggccucccaaguaguugggacuacaguugggugccacuauuuuuuaaaaaaauauauggcuauuuuuaaagagauggggucuugcuauguugcccagucucuauauuguucauccucccuauuuugacucacccuuuaagccucaaauguccacuacccuccacuuggccaggcaacauuacaccccaacuccucacuccaggggauuaaacaccccucagcuggaagggaaagacuggaagaaggaaacacagccaugacuuacuugggguccuggggcuccuggaggucccucaaacugcugccccugaagggagaagugagugucggugaccgcugucaucaugaagccucucaacccccucacaauccagaccccucaccuuuucaaucacugcgggcucuccuuuugcuccuuucucuccagcacccugggguggggucaggggagauggagagaaaagagaugugaacuuggacauaagcccuucaguuaucugaucacacacacuugcacacacacacacacacacacacacggaguccacccucagagccccuucuccucuacuguaaccaauaugcacugagaagcucagccccccgcauccaccgggcaaugccaugccaaggugaaugaagagcgugaaauccagagacugcugcccaauacugauccugcaucugccucuuacuaacugagugaucuaacuaaguugggaaacuuagucaaccccuauggccacuuacagguaaccggucaaccuguaaagucaguggaugaaugacgccuguguauauaucaugcaaagaugaaugaauuaaaacaaugcuuggcacacaacaagcacuccagguaacaagguagcaagggcaaguuaguuacaacuaugugucuaugcgccuccccuguggaacaccuaggcuuuuccuuucucccuuucuuucuuuccuucuucuuuuucuuucuucuuuuuuuuuuuuuaaauggagucuugcucugucccccaggcuggagugcaguggugugaucucagcucacugcaccuucuaccuccuggguucuagcgauucuccugccucagccuccccaguagcugggacuacaggugcccgccaacacgccuggcuaauuuuuguauuuuuaguagagaccagguuucaccauguugguuaggcuggucucgaacuccugacuuaggugauccacccgccucauccucccaaagugcugggauuacaggcgugagccaccaugcuuggcuccuuccuuccuuccuuucuuucuuuucuuucuuucuuucuuucucuuucuuuuucuuucucuuucuuucucuuuuucuuucuucuuucuuuuuucuuuuuuuucagagucacucuauugcccaggcaggcuuuuccuuuuuucucucucuuuuuuccuuccuuccuuccuuccuuccuuccuuccuuccuucucuugcuugcuugcuuugcuuggcauuuuuuuuuugacacagggucacucuauugcccaggcuagaaugcagggguacaaucauggcucacugcaaccucgaucuccucagacucaggugauccucccuccucagccuccugaguagcugggaccacaggugcacacagcaccaugcccagcuauuuuuuauuuuauuuuuuuguagagacagggucuugcuauguugcccaggcugaacucaaacugggagccacugcaccuggccuuuuuucuuuucuuuuuuucuuuuuucuuuuuuuuuuuuuuuugagacagagucucccucucgcgcccaggcugaagugcaguggcguggucucggcuugcugcaagcuccgccucccggguucacgccauucugccucagccucccgagaagcugggacuacaggcgcccgccaccacgcccagcuaauuuuuuuguauuuuuuaguacagacagcguuucaccauguuagccaggauggucucaaucuccugaccucgugaucagcccuccucggccucccaaagugcugggauuacaggcgugagccaccgcgccuggcccaagccucuuuucuuuucucuagagaaaggucuugcucugccacccgggcugcagugcaguggugugaucauggcuuccugaagccuccaccuccugggcucaagcgauccuccugcuucagcugggaccagaggcacgaaccaccacguucgauuaauuuuuuguauauuuuguaaagauagggucucgcuauguuacccaggcuugucccaaacucuugggcucaggugaucuucccgccucaaccuaccaaauugcugagauuauaggugugagccaccauaccuggccucaguuaccucuugaucucuacccucuucucuucucccugcccuuaacauaaaaaaaaagccuaaaauuuguacugacuuaagauggugcuucggaacaacaguccaccaucuucuugguuugcugucucuuggaauaaaccugcuuuuccuuccaccaauucucgucucucuuguuuuccuuucaaacaucaagccaccgagcuuggguucgguuacaucgaaugcguauccaucuuucuccaagaccaaaauggagcaugucccaaagugguccacuucucugcgucccucccaucuuccuccaggucacgucccgacugcagauugcgggcuucccugcugccccucuggcucccccuacuguccaugugccauucagcagccagagagcucuuuuuuuuuuuuuuuuuuuuuuuuuuuuuuaagagaugggucucacuguugcccaggcuggccucaaacuccuggccucaagcgauccucccgccucagccgcccaaagcauugggauuacagccgugagccacugcccccggcccagggggagcuuuuaaagcuccaagucagaucauguuccuucacaagugcucaaguggcaucuccuggugcuuggaguaaaagccaagcgccucucucuagucacagagucaacuauuagcacagugccugacacaagcaggugcagaagucaaaagagagacuggccuuucguggcuccagguagaaaucccuucuaagaccucaagaugugagaaaaguaaguaaauaaaauaacacaggaacagaagaccauauaccacauguucucacuuauaagugggagcuaaaugagaacacauggacacauagaggggaacaacagacacugggaccuaucggaggguggagggugggaggagggagaggaucaggaaaaauaacuaauggguacuaggcuuaauaccugaguaaugaaauaaauaaucuguacaacaaaaccccaugacacaagcuuaccuauguaacaagccugcacuuguaccccugaacuuaagauaaaaguuuuuuuaaaaaaagaaaaaauuaaauuaaauaauuuuuuuaaauuguucgguuuuuuuuuucaagauggagucucacuuuguugcccaggcuggagugcaguggcacgaucuuggcucauugcagccucugccucccggguucaagcaauucuccugccucagccuucccaguggcugggaucacaggcgcgcgccaccgcucccagcuaauuuuuuguauuuuuaguagacaugggauuucaccacguuggucaggcuagucucaaucuccugaccucaaaugaucugcccaccuaggucucccaaaguguucggauuacaggcgggagccacugcgcccugccuaaauaaauaaauuuuaaaaaaauuuuaauaggaaucccacucucuugcaccuaaccccagccaccuagaaacucacaggaaagaucuggaacugaguccgagauggauauucugcugcccggaagucagggcccaugguggaaucaucuccuucuucauccucccuggcugccuuggucuccaggguccccagcucgguuccacugucaggguccaagcuccucugagaacguuaggaaagaccaaaguuuucccugaccuccuuauuuucugccacccccguaacccuuggggucuccccucuuccauccccauccaaccucuaggaucguggcauugaguccaguagucacaguggaggugacgaccaaaggcgugggggucggaggcagauuuggagcuggagucucugucuuggggaugucaguggaggucuggagcagggauggagggagccuugggucucgggugagggcaaucaagacaaaagggaggcacccucccacuguccccaggagcucccaguccggggacagggacagaggaggcuccccaaagagcaccagaggccaauggagacaaaagugugccagcuggaccagggcugccagcagagggagccaccguggauggaggaggugcugagucaggcuggcccugaagcccaguggucaaggucaagguccaacauucagggccaggcucccggaagccuagcccacauguccucucccaaggcagaguucagcggccagcaggccacagucagagagggaguggcggcuccuucuggccuggacagcugcagaggaacugggucaagguggggguugggggggugugggaagagggugguggggucccaggugaggggacaaggcugaggaaggggcugaagaggggcccacuacuccugguguuuguauucuuggccaagaagaucuggaacugagauguagugcaaccagugacucccccaccagccaaagaccccaagcaaugacccccaccaaggaccccccaacccagugacccaccaagaaugaccuacaucaacagaccccagugauucuagaaccagagacccacaaacaaccccucccacucccaucaauggccucaaccuguuacugcuccauucagugauuuuccuaaccagugaccucaaccagugacaucucuuggcuauuagcacuaacuagugacucuccaacuaauaacccccaucggugaccccuaaucaauuauuccucuaaccagugaugcuccaacagugaauacccauaaaugagcgcaacaaaagcguccuaaccaaugacccccaaauaguaauuccacccaucaaugacuuccuaacuaauaauucccucagggacucccaaaccaauuaccccaucugcgacccccugaaaaucacucuuccaacuuguggccccaaugagugaccccacuaugacuuccagucagugaccacccaccaacaaccccccagucauugaccccaaacuagggacaucaguaacaccaauaaugguuucuauccaugaccuuccacugugauccccagcuaggugcagcccaaacacugaccucaauuaauaucucccucaaugauuccccacuauccagcaaucccuaucagggaagccaaauaaugcccccaauuaaugacucucccaaugaauaacuguccccagugaccccaagcagggaaccccaaacaaugacacacuaacuaaugaacacgucauucaacccagccaaugauccccccuuaaacaguagcccucaucaagaacucccuuaaaaucaggaacuuaucugggucuguccccucccucuagugccccaggacuggagauugagggggucagagaugggagagaucauaagaugggacccacccccacccuguuaucagucacccugacagucaucagucagcugagagaagucagagcucauggauccgagaccagagaaaaagaucauagaugagggaccagagauuaguagagaugggagacuagaagucaagcaccaagaccagaagucagacagucaagaccggaagucagguggucaaaaccggaagugagaggucucagggcccuuaccugguucucugcggagucaggagguggacuugagguccaaauuuccuuguucuuuuuccugcccuuccccuugcgaccucgcccuuucuuccucccuuuucccuuccccuuccgccgaggacgagggguuucugguucacccuggggagccugggagaaggguuccagucaggucuagagcaucccaccagcagagaccccaucauucaggucaccuggggugaggcuggcucauggcccguggguccucacucagcccugugaccuggagucaacguuauucauguaaccuggggucaaggguggcucaggaauaugacuugaggucaaagucauucaugccugggauguguuggaggucacgggucacuuaaccccaugucugggggaugagaauucacucuuucuagggaucuggagccaggaaggacccagccuguguccugagauuaggagucauggagucccucacucaccacuguggcugccggugccagguugucacagucggggagguaccgcucacaagccuggaaggcagccugaggaucugggcuuaucagcagcuccugaaugucucccuggggguuggggguguaggagucaaggagggcagccauacagccauaggcuuacucugacccccuaacccccagcaguccugcccaccuccuggcaccagggugcaaugcucccccacccagagcaugcuaaguauaaggaagagaugaccccaucacagcccuagugaucucucuacccccuguaacuaagagaaggaaagauccuaucaggggcacacccgaucccaaccacaagccacaucccacacaucugccccacuagaggugcaucaguuccuucaccgguucaagugauucucagccucccaaguagcugagauuacaggcgugugccaccacgcccaguuaauuuuugaauuuuuaguaaagacaagguuuugccauguuggccaggcuggucccgaacuccuggccucaagugauccacccgccuuggccucccaaagugcugggauuacagguaugagccaccgcgcccggccaagaccauaaauugugacgaugccuacuuggcuuguugugggaagagcugguacuggggauaaggaggaacaugagauagaucaggucccuggccucccagaggugacacacaucacggucacacacagcuaacaaaggucuccacacccagaacacauaucacacaaccacacaacacagcugccugcuggcucccaaagucauaaccgcccccacacaaucacacacuaucacagcaaccagcaccaucucaggucacagucucagacacacgacaccaccagaucuuuccacaacaagccaaguaggcgcugucacaauuuauggucuuguggcucugcaaucucacagucaugcacugcaacggcacacacaagcaugcacuggcacaacuggaucuucccacaacaagccaaguaggcaucgucacaauuuauggucuuggccaggcgcgguggcucauaccuguaaucccagcacuuugggaggccaaggcggguggaucacuugaggccaggaguucaggaccagcuuggccaacgugucaaaaccuugucucuacuaaaaauucaaaaauuagcugggcgugguggcacacaccuguaaucucagcuacuugggaggcugagaaucgcuugaacccaugagguggagguugcagugagcugagaucaagccacugcacuccagccugggugacagagcaaggcuccaucucaaaaaaaaaaaaaaauuauugucuuguggcucugcaaucucacaaucacaggcugcaacggugcacgaaagcaugaacucgcuucccuuagcuuccuggggauagauugaagcuugacaucuuccuucuuuaauauccucuccagauucaggcuguagacaaaacaucccacccucugccucaguuucccccaucacugaacuccuaccucgaaagucuuuuccccaagguccuggguccccagcacagugaguccagcuaugcugaugaagcgggggccauggcccaaaacagggggcugagcuucacagucagcuaccagggucaccaucucaccaucuaugcugacggccacacggugccaccugcaaggggacggccucagugcgggugcuucucaccccaccccuuauccacggacccccgcccacucuccccaugcucaccugccaucugugagguugaccugcugggggagggggcggaaggggucaccuaggagacccagcgcuggccccagugccaggcccaacugccgggcaccccuuucaucauaaauggacagcaggacagacugauuggcuggcuguccccgcaaggugaucagcaaggagaaguucucaggaaaguggccuucugggugggcagagggaacaaggcagcucagagggcccagcagugccucccuccggggagguacccaggccuccuacuccaacucaccuggaaagaguucccacguggggaugccgagcgugcuggccuggccaauucugaaugcccggucacccucuggaguccucuggggacagaagccaggccccucggggaccccagccuggccucccugcacacccagggccuucaggacauccacaggaucugcagcagagagaagccgggggugucaggcagagguggggaacagcuagaauaagcccaggacuccaggauagaggcucaggguuuuuuuagggggcucagccucucccucccucccaccauguuuguggcucaggaagaaggagccggccugggcccccagcaccccccgccuccucaccaccccacagauguuccgaccucagcagcuuguugacucuguuuuuuuuuuuccccuugguuuuuggugagaaaaaaaguugaccuaguucugggaugaaucaaaacuuccuggccuaagccccagaguggaacggucccccucucccugcucucccgcgcaggcucccuagggcuauaucccaggccuggagcccccuugccaggggaaacccacguggagaggaggggcuuccaguguguuuucuucccccaccuccucccucucucuaaccuccuccuuugaccaccaucacccacaaccucuuccuuuugacuacagccauuuuggaucuccucccucugaccaucugccucugaccaugcccacuaacuucuuuuucugguuacccccucugaccuucugaucuucuucugccugaccccagccuauucccucugaucuccuuuuucugucugaucccaaacuccuccuucugaauuuccccuuugaccucuucccucugacuuucaccucuaaccucuucccucugacccuccucuaugaacuuccucucucagacuuugcccucugaccuccucccucugaaugucuccucugaucuccucuccugacuuuccccucugaccuccucccucugacuuuccccuuugaccucuuccuucugacuuuccccucuaaccuccucccucugacucuccccuaugaccuccucccucugagccuccccucugaucucuccucugacuuuccccucugaccuccucccucugacauuccccucugaccuccucccucugacauucccuucugaucaacucccucugaccuccucccucugacuacccccugaccuucucccacugccuauccugaucuccuccaucugacccaugaccuccucauuucaucucucugacuuccuccuucugaccagcugucuccgauaaccuccagaccuccccugucugacccucucccucuuucaucccagcuaaggaaaggacuugucuggcccaacaguuccuaaucuaggccaugcuaccagccccaccccagcaggcagcccagccagugcuaaguggaaccacauggcuugggcaggggcgggugggggcuuccccugggccccgagccccugucugauucccccaucccccaacccucagcaaacugucccacugacccccugccccagccucuuggcgggagcuggauucuccagaaucugccaugaccucaccccugggggcggcucugcugaucucaccacggggagcuggggcgggggggcuaagacguuggggaggcacgggcuuggaugaaggacccccauucccacucuuccuaggucagaacccucauuuuccagacuccucggaggccuguuucagccucuguuuccucuugccuccaaucuccuucucuccccaucccugcccgcccucucucugucccacuuucugugccgggucuuuccaggccuccaucuguguccaagucucuuucucucucucucucucuuucucucauucucucucucucuucucaaucucucucucucuccacccgccuuccccaacccaucaccccagcccccaucucuaauugccuguuuuguggcuaggcugucauuaagagaaaucuggguugcaguccccuggggcugagaucugggcucccaggcucugcugaccacaagagucacuuccccacggaacaaucaucccagcugccccaucucagccuggggcccagggcaggauugagaccgacgaccucacccagccuggaggcucuccccugacccgcacccuaaccucucugcagaggaaagagggucuucccucaacuaccacucauuuacauuaagaaaguccuucccggcauccaacucaaagcucuccugcuugaaacuuguguccccucuggaaugaccuuucagaaacugacugcccuuucuuuucacagcuggcauuaugacaaaaaggcacacaagcugcauugaguccugccuacaggggacaaggggugggggggucugucaggggcccagccugcccccugccacucuccccugugcuggucagggcccccacggggauguuggguggggucugggauguggagggacagaggcggggacugagucagggcauggcugggaaccccccaggugugcgaugugugugcaaauacguguaugugcaugagauuguacaagcgugggugagucugagugagacaggcagagaauagcugggcauaugucguuucuccaggugucaaugugugcaaauauuuggcuucuaauggagggauuagauacacuugcuugacguguggccaugcaacgcuugccgugagcuugcaggugugucugugacuuuaacaccucggacuucugaugggggagugccguucugugugagagugugacccagugggugagugggugauggguugugaauguugacaguguuuguucggaugucaggggcagcaugugugagaauuugagcacgugggagggucauaaaagcugggaccauuuggcggguggcugaaggggguugccuggacacgguguuucacauuccuggagucccaggggacuuauauucagaguggaugccuaagauuccaugaccauguggaugugugagcgugggaaugcggcauaguccaaucagggauuaaccauauggacaggcaccuuccuggacuccaaaguaagaagugugcugugguguguguguguguguguguguguguguguguguguguguguguugggagacugagcucaccuuagaaagggauuuccaggaggaccuagucuagggucucucagaucagggaagccccaucuccaacacuugagaagcuacgccauccccugacucccgaagcgccccccacucugaacccugaggggcgggacagggcgcccagccagaugcgcgcagcugggcgugcgucagcgcugacucacccauccggcggcccccgggaccccuugggggcuccugagaaauuccucgggaaaaacacccaaggcuccagcagcugggguggggagggggggagcaacuuccacuccugccccgcccugcgccccgccccgucucgccccucaccgcggcccuccccgaagcccuguccauggugcugaucgcggcucuggggaccgcggggugggggagggggcaacagggagggaggggaggagaugggcgcucgccaauuuggggcagaggaggaaaagggagaaugaggugaagccauuuaaagagacgcaaaggaaacuguggguucccgaagagcaccccccaauacuuguccccacccaccuucauccucaugggcaauuauuugcacccaaaaaucauaacuacaccccucauagcggcacucagagacacacaaucacacgcauaaccacucacacgguuacccucgaaaaucagcacauagacaagagcacaagugcauacucaccugucgcaauacacaccgucccagcacugcccugucacucacagucacacuaucaccaucaaccuccacacgcaagcacauacgcaacuucacuccaaaugcacacacaugcuacacacacauacacacaugcacacaccugcacauugcaugcauucccacgcgcucgccagaaaacgcacucacacauccccacccccaccccgagcugucacacccacaaaucacccagagucagauacucaugcgcccacaucacaccggggccgcacgcggcgcccacgcccuuccccuccacgccccuccaccccccuccaccccucgcucuuuuagagccucucugagucguggacccugggucccaucucuucccucccggcucaccggccugcguccccggcagaagcugcagcgcggccaggagcaggcagagaccggcccgcggcuggcccaggucccggcgguuccccaucccggcggggcccacgggcaaggcggggaaccagucggggcggcugcggggcgcggcgacuucucgggcucggugcagucacucgc

SEQ ID NO: 192020 - RNA, 50911 nt, Homo sapiens
gcgagugacugcaccgagcccgagaagucgccgcgccccgcagccgccccgacugguuccccgccuugcccgugggccccgccgggauggggaaccgccgggaccugggccagccgcgggccggucucugccugcuccuggccgcgcugcagcuucugccggggacgcaggccggugagccgggagggaagagaugggacccaggguccacgacucagagaggcucuaaaagagcgagggguggagggggguggaggggcguggaggggaagggcgugggcgccgcgugcggccccggugugaugugggcgcaugaguaucugacucugggugauuugugggugugacagcucgggguggggguggggaugugugagugcguuuucuggcgagcgcgugggaaugcaugcaaugugcaggugugugcauguguguauguguguguagcaugugugugcauuuggagugaaguugcguaugugcuugcguguggagguugauggugauagugugacugugagugacagggcagugcugggacgguguguauugcgacaggugaguaugcacuugugcucuugucuaugugcugauuuucgaggguaaccgugugagugguuaugcgugugauugugugucucugagugccgcuaugagggguguaguuaugauuuuugggugcaaauaauugcccaugaggaugaagguggguggggacaaguauuggggggugcucuucgggaacccacaguuuccuuugcgucucuuuaaauggcuucaccucauucucccuuuuccuccucugccccaaauuggcgagcgcccaucuccuccccucccucccuguugcccccucccccaccccgcgguccccagagccgcgaucagcaccauggacagggcuucggggagggccgcggugaggggcgagacggggcggggcgcagggcggggcaggaguggaaguugcucccccccuccccaccccagcugcuggagccuuggguguuuuucccgaggaauuucucaggagcccccaaggggucccgggggccgccggaugggugagucagcgcugacgcacgcccagcugcgcgcaucuggcugggcgcccugucccgccccucaggguucagaguggggggcgcuucgggagucaggggauggcguagcuucucaaguguuggagauggggcuucccugaucugagagacccuagacuagguccuccuggaaaucccuuucuaaggugagcucagucucccaacacacacacacacacacacacacacacacacacacacacacaccacagcacacuucuuacuuuggaguccaggaaggugccuguccauaugguuaaucccugauuggacuaugccgcauucccacgcucacacauccacauggucauggaaucuuaggcauccacucugaauauaaguccccugggacuccaggaaugugaaacaccguguccaggcaacccccuucagccacccgccaaauggucccagcuuuuaugacccucccacgugcucaaauucucacacaugcugccccugacauccgaacaaacacugucaacauucacaacccaucacccacucacccacugggucacacucucacacagaacggcacucccccaucagaaguccgagguguuaaagucacagacacaccugcaagcucacggcaagcguugcauggccacacgucaagcaaguguaucuaaucccuccauuagaagccaaauauuugcacacauugacaccuggagaaacgacauaugcccagcuauucucugccugucucacucagacucacccacgcuuguacaaucucaugcacauacacguauuugcacacacaucgcacaccugggggguucccagccaugcccugacucaguccccgccucugucccuccacaucccagaccccacccaacauccccgugggggcccugaccagcacaggggagaguggcagggggcaggcugggccccugacagacccccccaccccuuguccccuguaggcaggacucaaugcagcuugugugccuuuuugucauaaugccagcugugaaaagaaagggcagucaguuucugaaaggucauuccagaggggacacaaguuucaagcaggagagcuuugaguuggaugccgggaaggacuuucuuaauguaaaugagugguaguugagggaagacccucuuuccucugcagagagguuagggugcgggucaggggagagccuccaggcugggugaggucgucggucucaauccugcccugggccccaggcugagauggggcagcugggaugauuguuccguggggaagugacucuuguggucagcagagccugggagcccagaucucagccccaggggacugcaacccagauuucucuuaaugacagccuagccacaaaacaggcaauuagagaugggggcuggggugauggguuggggaaggcggguggagagagagagagauugagaagagagagagagaaugagagaaagagagagagagagagaaagagacuuggacacagauggaggccuggaaagacccggcacagaaagugggacagagagagggcgggcagggauggggagagaaggagauuggaggcaagaggaaacagaggcugaaacaggccuccgaggagucuggaaaaugaggguucugaccuaggaagagugggaauggggguccuucauccaagcccgugccuccccaacgucuuagcccccccgccccagcuccccguggugagaucagcagagccgcccccaggggugaggucauggcagauucuggagaauccagcucccgccaagaggcuggggcagggggucagugggacaguuugcugaggguugggggaugggggaaucagacaggggcucggggcccaggggaagcccccacccgccccugcccaagccaugugguuccacuuagcacuggcugggcugccugcugggguggggcugguagcauggccuagauuaggaacuguugggccagacaaguccuuuccuuagcugggaugaaagagggagagggucagacaggggaggucuggagguuaucggagacagcuggucagaaggaggaagucagagagaugaaaugaggaggucaugggucagauggaggagaucaggauaggcagugggagaaggucaggggguagucagagggaggaggucagagggaguugaucagaagggaaugucagagggaggaggucagaggggaaugucagagggaggaggucagaggggaaagucagaggagagaucagaggggaggcucagagggaggaggucauaggggagagucagagggaggagguuagaggggaaagucagaaggaagaggucaaaggggaaagucagagggaggaggucagaggggaaagucaggagaggagaucagaggagacauucagagggaggaggucagagggcaaagucugagagaggaaguucauagaggagggucagagggaagagguuagaggugaaagucagagggaagaggucaaaggggaaauucagaaggaggaguuugggaucagacagaaaaaggagaucagagggaauaggcuggggucaggcagaagaagaucagaaggucagaggggguaaccagaaaaagaaguuagugggcauggucagaggcagauggucagagggaggagauccaaaauggcuguagucaaaaggaagagguugugggugaugguggucaaaggaggagguuagagagagggaggaggugggggaagaaaacacacuggaagccccuccucuccacguggguuuccccuggcaagggggcuccaggccugggauauagcccuagggagccugcgcgggagagcagggagagggggaccguuccacucuggggcuuaggccaggaaguuuugauucaucccagaacuaggucaacuuuuuuucucaccaaaaaccaaggggaaaaaaaaaaacagagucaacaagcugcugaggucggaacaucugugggguggugaggaggcggggggugcugggggcccaggccggcuccuucuuccugagccacaaacauggugggagggagggagaggcugagcccccuaaaaaaacccugagccucuauccuggaguccugggcuuauucuagcuguuccccaccucugccugacacccccggcuucucucugcugcagauccuguggauguccugaaggcccugggugugcagggaggccaggcugggguccccgaggggccuggcuucuguccccagaggacuccagagggugaccgggcauucagaauuggccaggccagcacgcucggcauccccacgugggaacucuuuccaggugaguuggaguaggaggccuggguaccuccccggagggaggcacugcugggcccucugagcugccuuguucccucugcccacccagaaggccacuuuccugagaacuucuccuugcugaucaccuugcggggacagccagccaaucagucuguccugcuguccauuuaugaugaaaggggugcccggcaguugggccuggcacuggggccagcgcugggucuccuaggugaccccuuccgcccccucccccagcaggucaaccucacagauggcaggugagcauggggagagugggcggggguccguggauaagggguggggugagaagcacccgcacugaggccguccccuugcagguggcaccguguggccgucagcauagauggugagauggugacccugguagcugacugugaagcucagcccccuguuuugggccauggcccccgcuucaucagcauagcuggacucacugugcuggggacccaggaccuuggggaaaagacuuucgagguaggaguucagugaugggggaaacugaggcagagggugggauguuuugucuacagccugaaucuggagaggauauuaaagaaggaagaugucaagcuucaaucuauccccaggaagcuaagggaagcgaguucaugcuuucgugcaccguugcagccugugauugugagauugcagagccacaagacaauaauuuuuuuuuuuuuuugagauggagccuugcucugucacccaggcuggagugcaguggcuugaucucagcucacugcaaccuccaccucauggguucaagcgauucucagccucccaaguagcugagauuacaggugugugccaccacgcccagcuaauuuuugaauuuuuaguagagacaagguuuugacacguuggccaagcugguccugaacuccuggccucaagugauccacccgccuuggccucccaaagugcugggauuacagguaugagccaccgcgccuggccaagaccauaaauugugacgaugccuacuuggcuuguugugggaagauccaguugugccagugcaugcuugugugugccguugcagugcaugacugugagauugcagagccacaagaccauaaauugugacagcgccuacuuggcuuguuguggaaagaucugguggugucgugugucugagacugugaccugagauggugcugguugcugugauagugugugauugugugggggcgguuaugacuuugggagccagcaggcagcuguguugugugguugugugauauguguucuggguguggagaccuuuguuagcugugugugaccgugaugugugucaccucugggaggccagggaccugaucuaucucauguuccuccuuauccccaguaccagcucuucccacaacaagccaaguaggcaucgucacaauuuauggucuuggccgggcgcgguggcucauaccuguaaucccagcacuuugggaggccaaggcggguggaucacuugaggccaggaguucgggaccagccuggccaacauggcaaaaccuugucuuuacuaaaaauucaaaaauuaacugggcgugguggcacacgccuguaaucucagcuacuugggaggcugagaaucacuugaaccggugaaggaacugaugcaccucuaguggggcagaugugugggauguggcuugugguugggaucgggugugccccugauaggaucuuuccuucucuuaguuacaggggguagagagaucacuagggcugugauggggucaucucuuccuuauacuuagcaugcucugggugggggagcauugcacccuggugccaggaggugggcaggacugcuggggguuagggggucagaguaagccuauggcuguauggcugcccuccuugacuccuacacccccaacccccagggagacauucaggagcugcugauaagcccagauccucaggcugccuuccaggcuugugagcgguaccuccccgacugugacaaccuggcaccggcagccacaguggugagugagggacuccaugacuccuaaucucaggacacaggcuggguccuuccuggcuccagaucccuagaaagagugaauucucaucccccagacaugggguuaagugacccgugaccuccaacacaucccaggcaugaaugacuuugaccucaagucauauuccugagccacccuugaccccagguuacaugaauaacguugacuccaggucacagggcugagugaggacccacgggccaugagccagccucaccccaggugaccugaaugauggggucucugcuggugggaugcucuagaccugacuggaacccuucucccaggcuccccagggugaaccagaaaccccucguccucggcggaaggggaagggaaaagggaggaagaaagggcgaggucgcaaggggaagggcaggaaaaagaacaaggaaauuuggaccucaaguccaccuccugacuccgcagagaaccagguaagggcccugagaccucucacuuccgguuuugaccaccugacuuccggucuugacugucugacuucuggucuuggugcuugacuucuagucucccaucucuacuaaucucuggucccucaucuaugaucuuuuucucuggucucggauccaugagcucugacuucucucagcugacugaugacugucagggugacugauaacagggugggggugggucccaucuuaugaucucucccaucucugacccccucaaucuccaguccuggggcacuagagggaggggacagacccagauaaguuccugauuuuaagggaguucuugaugagggcuacuguuuaaggggggaucauuggcuggguugaaugacguguucauuaguuagugugucauuguuugggguucccugcuuggggucacuggggacaguuauucauugggagagucauuaauugggggcauuauuuggcuucccugauagggauugcuggauaguggggaaucauugagggagauauuaauugaggucaguguuugggcugcaccuagcuggggaucacaguggaaggucauggauagaaaccauuauugguguuacugaugucccuaguuuggggucaaugacugggggguuguugguggguggucacugacuggaagucauaguggggucacucauuggggccacaaguuggaagagugauuuucagggggucgcagaugggguaauugguuugggagucccugagggaauuauuaguuaggaagucauugauggguggaauuacuauuugggggucauugguuaggacgcuuuuguugcgcucauuuauggguauucacuguuggagcaucacugguuagaggaauaauugauuaggggucaccgauggggguuauuaguuggagagucacuaguuagugcuaauagccaagagaugucacugguugaggucacugguuaggaaaaucacugaauggagcaguaacagguugaggccauugaugggagugggagggguuguuugugggucucugguucuagaaucacuggggucuguugauguaggucauucuuggugggucacuggguugggggguccuuggugggggucauugcuuggggucuuuggcuggugggggagucacugguugcacuacaucucaguuccagaucuucuuggccaagaauacaaacaccaggaguagugggccccucuucagccccuuccucagccuuguccccucaccugggaccccaccacccucuucccacacccccccaacccccaccuugacccaguuccucugcagcuguccaggccagaaggagccgccacucccucucugacuguggccugcuggccgcugaacucugccuugggagaggacaugugggcuaggcuuccgggagccuggcccugaauguuggaccuugaccuugaccacugggcuucagggccagccugacucagcaccuccuccauccacgguggcucccucugcuggcagcccugguccagcuggcacacuuuugucuccauuggccucuggugcucuuuggggagccuccucugucccuguccccggacugggagcuccuggggacagugggagggugccucccuuuugucuugauugcccucacccgagacccaaggcucccuccaucccugcuccagaccuccacugacauccccaagacagagacuccagcuccaaaucugccuccgacccccacgccuuuggucgucaccuccacugugacuacuggacucaaugccacgauccuagagguuggauggggauggaagaggggagaccccaaggguuacggggguggcagaaaauaaggaggucagggaaaacuuuggucuuuccuaacguucucagaggagcuuggacccugacaguggaaccgagcuggggacccuggagaccaaggcagccagggaggaugaagaaggagaugauuccaccaugggcccugacuuccgggcagcagaauauccaucucggacucaguuccagaucuuuccugugaguuucuagguggcugggguuaggugcaagagagugggauuccuauuaaaauuuuuuuaaaauuuauuuauuuaggcagggcgcaguggcucccgccuguaauccgaacacuuugggagaccuaggugggcagaucauuugaggucaggagauugagacuagccugaccaacguggugaaaucccaugucuacuaaaaauacaaaaaauuagcugggagcgguggcgcgcgccugugaucccagccacugggaaggcugaggcaggagaauugcuugaacccgggaggcagaggcugcaaugagccaagaucgugccacugcacuccagccugggcaacaaagugagacuccaucuugaaaaaaaaaaccgaacaauuuaaaaaaauuauuuaauuuaauuuuuucuuuuuuuaaaaaaacuuuuaucuuaaguucagggguacaagugcaggcuuguuacauagguaagcuugugucaugggguuuuguuguacagauuauuuauuucauuacucagguauuaagccuaguacccauuaguuauuuuuccugauccucucccuccucccacccuccacccuccgauaggucccagugucuguuguuccccucuauguguccauguguucucauuuagcucccacuuauaagugagaacaugugguauauggucuucuguuccuguguuauuuuauuuacuuacuuuucucacaucuugaggucuuagaagggauuucuaccuggagccacgaaaggccagucucucuuuugacuucugcaccugcuugugucaggcacugugcuaauaguugacucugugacuagagagaggcgcuuggcuuuuacuccaagcaccaggagaugccacuugagcacuugugaaggaacaugaucugacuuggagcuuuaaaagcucccccugggccgggggcaguggcucacggcuguaaucccaaugcuuugggcggcugaggcgggaggaucgcuugaggccaggaguuugaggccagccugggcaacagugagacccaucucuuaaaaaaaaaaaaaaaaaaaaaaaaaaaaaagagcucucuggcugcugaauggcacauggacaguagggggagccagaggggcagcagggaagcccgcaaucugcagucgggacgugaccuggaggaagaugggagggacgcagagaaguggaccacuuugggacaugcuccauuuuggucuuggagaaagauggauacgcauucgauguaaccgaacccaagcucgguggcuugauguuugaaaggaaaacaagagagacgagaauugguggaaggaaaagcagguuuauuccaagagacagcaaaccaagaagaugguggacuguuguuccgaagcaccaucuuaagucaguacaaauuuuaggcuuuuuuuuuauguuaagggcagggagaagagaagaggguagagaucaagagguaacugaggccagguaugguggcucacaccuauaaucucagcaauuugguagguugaggcgggaagaucaccugagcccaagaguuugggacaagccuggguaacauagcgagacccuaucuuuacaaaauauacaaaaaauuaaucgaacguggugguucgugccucuggucccagcugaagcaggaggaucgcuugagcccaggagguggaggcuucaggaagccaugaucacaccacugcacugcagcccggguggcagagcaagaccuuucucuagagaaaagaaaagaggcuugggccaggcgcgguggcucacgccuguaaucccagcacuuugggaggccgaggagggcugaucacgaggucaggagauugagaccauccuggcuaacauggugaaacgcugucuguacuaaaaaauacaaaaaaauuagcugggcgugguggcgggcgccuguagucccagcuucucgggaggcugaggcagaauggcgugaacccgggaggcggagcuugcagcaagccgagaccacgccacugcacuucagccugggcgcgagagggagacucugucucaaaaaaaaaaaaaaaagaaaaaagaaaaaaagaaaagaaaaaaggccaggugcaguggcucccaguuugaguucagccugggcaacauagcaagacccugucucuacaaaaaaauaaaauaaaaaauagcugggcauggugcugugugcaccuguggucccagcuacucaggaggcugaggagggaggaucaccugagucugaggagaucgagguugcagugagccaugauuguaccccugcauucuagccugggcaauagagugacccugugucaaaaaaaaaaugccaagcaaagcaagcaagcaagagaaggaaggaaggaaggaaggaaggaaggaaggaaggaaaaaagagagagaaaaaaggaaaagccugccugggcaauagagugacucugaaaaaaaagaaaaaagaaagaagaaagaaaaagagaaagaaagagaaagaaaaagaaagagaaagaaagaaagaaagaaaagaaagaaaggaaggaaggaaggagccaagcaugguggcucacgccuguaaucccagcacuuugggaggaugaggcggguggaucaccuaagucaggaguucgagaccagccuaaccaacauggugaaaccuggucucuacuaaaaauacaaaaauuagccaggcguguuggcgggcaccuguagucccagcuacuggggaggcugaggcaggagaaucgcuagaacccaggagguagaaggugcagugagcugagaucacaccacugcacuccagccugggggacagagcaagacuccauuuaaaaaaaaaaaaagaagaaagaaaaagaagaaggaaagaaagaaagggagaaaggaaaagccuagguguuccacaggggaggcgcauagacacauaguuguaacuaacuugcccuugcuaccuuguuaccuggagugcuuguugugugccaagcauuguuuuaauucauucaucuuugcaugauauauacacaggcgucauucauccacugacuuuacagguugaccgguuaccuguaaguggccauagggguugacuaaguuucccaacuuaguuagaucacucaguuaguaagaggcagaugcaggaucaguauugggcagcagucucuggauuucacgcucuucauucaccuuggcauggcauugcccgguggaugcggggggcugagcuucucagugcauauugguuacaguagaggagaaggggcucugaggguggacuccgugugugugugugugugugugugugcaagugugugugaucagauaacugaagggcuuauguccaaguucacaucucuuuucucuccaucuccccugaccccaccccagggugcuggagagaaaggagcaaaaggagagcccgcagugauugaaaaggugaggggucuggauugugaggggguugagaggcuucaugaugacagcggucaccgacacucacuucucccuucaggggcagcaguuugagggaccuccaggagccccaggaccccaaguaagucauggcuguguuuccuucuuccagucuuucccuuccagcugagggguguuuaauccccuggagugaggaguugggguguaauguugccuggccaaguggaggguaguggacauuugaggcuuaaagggugagucaaaauagggaggaugaacaauauagagacugggcaacauagcaagaccccaucucuuuaaaaauagccauauauuuuuuuaaaaaauaguggcacccaacuguagucccaacuacuugggaggccaaggugggaggauugcuugagccuaggaguuggaggcugcagugagcuaugaucacgccacugcacuccagcaugggugacagagugagaccgucucuaaaaaaagaagagggguccgagaguagcguugggggugagugggggucaguauugcauuaggggaguuggaguggcucuguagugggguagggaggucagccugagguuagagucagugguagguugaaagucagccuagcucaaacuuugcacuuccugugacuccuguuucucuguccccaacagggggugguuggccccucaggcccucccggccccccaggauucccuggcgacccugguccaccgguaagagacucccacugggguguacacuucucagaggagugagguuuggggcugggagcgugacagucugaacauagauaugaggguguggcacucgggaacaccaucccggggcuggcacugaccucuucuguucucugucucccaucugugaacuauuucucugguucaccuuguguugcuggggccuacucuuugcuuuucuucuuuugccugucucuguuucugagugucuuuuaucucugucuuucuccuguugugacucugucucugucucucuucugucucucucuguuggucucugucccucucccuccguccaucucucuauguucgccucucucucuauuucuccaucucugucugucuuucacuggcuuuucugucucugucuaucucucucugucucucuguuucugucucuguaugucucuccaucugcccccauccuucuccaucccucucuccccuucucuuugucucuguuccaucucugucuuuuccuuuccacuucucucuacuucucucucuuuccuugccaugaucccucuuugauucugugucucucuccaucucucccucucucucucuuucugacucauccuucugugccuccccuguccucgcucucucucucccucucucccugucuccaccucucuucccccaucccucucucagggcccugcuggccucccaggaauccccggcauugaugggauccgaggcccaccgggcacugugaucaugaugccgguaagaaggagauggaguggcccagccuuggggaguggaguccugauccaggagggggccucuccugggggcuucccucaccacuaaauuccucccaguuccaguuugcaggcggcuccuuuaaaggccccccagucucauuccagcaggcccaggcucaggcaguucugcagcagacucaggugagugggagguguggacauagugggaggaaccccagagagugauagagccucggcguaaggaggggcugggcaggagaaggggguuauuuuucuccugaagaugccucuguggggaauguugggggucuugugggaggccccaagcucugacuccucugucuuuccagcucucuaugaaaggccccccugguccaguggggcucacugggcgcccaggcccuguggugaguaaggcgacugcguggagggggcggugcaugcauuagugaagaaucaucuacccacacuccuccaucucuccucccccaagggucuccccgggcauccaggucugaaaggagaggagggagcagaagggccacaggugagacuuguggagauagggcaggauaggaugggaauagccuucccccaggaccacaagauacagugcuggauggggaaagugccaaaggggcuggggauacccuugcaauugaugacuuuccuagagaaugguggcucacaucuggaaucccagaacuuugggaggccgaggugggaggauugcuugaggccaggaguucaagaccagucugggcaacauagggaggcccugucuauacaauaaauaaauauguccuuccaagcuggguacaguggcacacacuugucucagcuacuugggaggcugaggagggaguauugcuugagcccaggugucuggccugggcaauacagcaagaccccaucucuaauuuuuuuuaauacaauagaauaagucccucuuucuucuuauuuuccuuuccuuccuccuuuuugcuuucuucuaggguccccgaggccugcagggaccucauggacccccuggccgagugggcaagauggugagugacagcuagguccccagaccaccccuuauccaucccucaacacccaacaugagccuuggcuuugugaccuuggggucugcuggugucguuagugggaaaagagugcugaaggcagggaauggcagcuccacugagugugugucaaaggaauccggccaggccguagagucaggaaggacuugccugcaggagugaugcuugcccugagaucugaaauagaaccagaugaacagauggggaaguggaagaaacagcacggcaaaaaagaggccugucacauggaaggaaaugacaaacaagucaacuucagauagagucaugcaccacauaaugaugcuuauaagaugauuggcugcgcgcaguggcucaugccuauaauaccagcacuuagggaggccgaggcagguggaucauuugaggucaggaguuugagaucaaccuggccaacauggggaaaccccgucucuacuaaaaauacaaaaauuagccgggcauggcagcgugcgccuguaaucccagcuacucgggaggcugaggcaugagaauggcuugaauccaggaagcagagguugcagugagccagugcacaccagcuuggguggcagagugagauugugucucaaaaaauaauaauaauaauaauaaauaaauaagaugcuggucccaugagauuauaauacuguauuuuuacuguaccauuucuauguuuggauguguuuagacauacaaauacuuacuauaguguuacaauugccugugauauucaguacagucgcacauuguucagguuuguagucugagagcacuagguuauaccgcauagccuggguguuugguagguuguaccauccagaguuguguaagugcauucuaucuuguucacacaaugacaaaauugcccacugaugcauuucucagaauguaucccuguuguucagugacaugugaccauauauauauauauauauauauauauauauauauauauauauauauauguaaaacauauauguaacuccagccugggcaacagagcaagacgccaucucaaaaaaauaaaauaaaauaaaaucagccauggcauagcaacugguaucucuaaucccagcacuuugggaggcugaggugaaaggauggcuugagcccaggaguuugagaccagcuugugcaacauggcaaaacccggucucuacacaaaauacaaauaaaaaauuagccaggugugguggugugcacuuguagucccagcuacuugggaggcugaggugggaggauugcuugagccaggaauucgaagcugcauugagccaugaucaugccacugcacuccagccugggcaagagagcaagaccucagcucuaaaauacauaaauaaauuaaaaaaaauaauaucuuagccuuggcaugguggcucaugccuguaaucccagcaguuugggaggcugagguggguggaucgcuugcauucaggaguuugagacuagccugagcaacagggugaaacccccaccaucucuaccaaaaauauaaaaaauuagccaggccugguggcaugcaccuguggucccagcuacucaggaggcugagguugcagugagcugagaacgugccacugcacuccaaccugagugacagaaggagacccugucaaaaaaaaaaucuugauguugaugaugaaguuggguuccuaauuugguggagggguacagggaaggcucauccuugacucuugggcuuacuuucuccauagggccgcccuggagcagauggagcucggggccucccaggggacacuggaccuaagguaggugaugggggcugagauaagacuuggugggagcugucaggcuuauggggucaaggcucacuggugucucuggacagggugaucguggcuucgauggccucccugggcugccuggugagaagggccaaagggugagugugugaggucccucccccaagucuaagcccuccucccaauauucaagcccccccaacuucucccucaguaucagagucaugaucccugugucccuccucacaccccaucugccuucccagggggcuggucucuccgcccacacccuuccacucugaacuccccucuguucccucuccagggugacuuuggccauguggggcaacccggucccccaggagaggauggugagaggguaaguuuggaagagaguuagggccugguuuggaaaguaaguuuggaagccugagugagaaucagagaggaagaucuggaggucucaguggccagcuugagagcuagggacaaauuguggggugaggaggugagacuugcaggucuaggauuggagucaggggccugaauggaaucccaugaacuuagucugcagguucccagggauccuggucuaauuccgagacccccuggaaggggcugcccagaugaggggagguggcucuccgaggguuguaccuuccuguucccaaguaaugacgcuuuuccacagggagcagagggaccuccagggcccacuggccaggcuggggagccggugaguaucagggaucccugggccccuugcuuggugcaggggagggagucaggacucccagggccccaggacucauaggaccccuagagcucacauggccacacagaggugauguggaaauaauucgccugcucccuugcaggguccacgaggacugcuuggccccagaggcucuccuggccccacgggucgcccggugagugucacuggcucucugcaucccugucugucuuuuuguuuguuuugagauuagggucucgcucugucgcccaggcuggagugcgguggcgagaucucagcucucugcaaccuccggcuccuggguucaggugauucucaugcuucagccuccugaguagcugggacuacagggacccaccagcacaccuggcuaauuuuuguauuuuuaguagagacaggguuucaccauguuaguuagguuggucucgaacuccuggccucaagugguccucccaaagugcugggauuacaggccugagccacuguuccuggccccugucugucuuuuuuuucucgcuuuucugccuucugcauguccauaucuguugcuggcuucucugccugcucacauuucuuucuuucuuuuuuuuuuuagacagaguuuugcucuuguugcccaggcuggagugcaauggcacgaucucugcucacugcaaacuccgccuuccacguucaagcuauucuccugccucagccuccugaguagcugagauuacaugccuggcuaauuuuuguguuuuuaguaaagacgggguuucacaauguuggccaggcuggucuuaaacucccgaccucaggugauccaccugccucagccucccaaaaugcugggauuacaagcaugagccacagugcccggcccugcucaccuuuccaccugcaucucucggugucucagacucaggcucccagcuuguugcucugucuuggucucacauccucuuuuccccuagggugugacuggaauugauggugcuccuggugccaaaggcaaugugguaugugcccugugcccuuugaccucugacccuucugacacucugaccccgauuguccacaucccuauucccuuccaugacugaccccccccaagucaauuucacuaacgccccaacaccaugaccccucuuagcuucacugaaaccccacuuucuccccaggguccuccaggagaaccaggcccuccgggacagcagggaaaccaugggucccagguuugaacugucuuucccaauaauggggcaugggaguggucaguuaagaccuuagaccgugaccaggcuucccaaccuccacacucaccgcuucuuucuuaugccuucucucaucuucuuuuucugucuccagggacuccccgguccccagggacucauuggcacuccuggggagaaggugagugacagcuccaccuaccgcgaccuccucaagucuucuuccuucaacucuguugccaggaaaaucuucccaccaagaccccucuguuagcucuggauagugauagacugcaacauucccuaagccagcccggagauacaaaguguccuuguuggggaaggauugguugcaagaaacagaaacccaccaaggcuagcucacauaagggauauugucaggauacagagagcccacagaagccugucacagaagauauuaccaagaggcacaggcccugugggucucaucuuuguucccuggcacaucugcuuccgccuucccuggcagacacacuucuuucugcacauaucuuuuuuugggggguguggacagggucucacucugucgcccaggcuggagugcaguggcucaauaaugccucacugcagccuugacuuccccaggcgaggugguucucccaccucauccacccgaguagcugggacuaucagcgcaugccacugugccuggcuaauuuuucuuuucuuuucuuauuuucuuuuuuuguagagauggggucugccuguguugcccaggcuggucuugaacuccugggcucaugcaguucaucugccuuggccccccaaaaugcugggauuacaggcgagagccaucaugcccggcugggcauuuuuaaagaaagggguguggcugugaagcuucuauuucaacaugucucuugcacuguuuuaauuuaauuuuauuggucaggugcggugguucacaccuguaauccuagcacuuugggaggcugagauggggggaucacgaggucaggagaucgagaccauccuggcuaacauggugaaacccugucucuacuaaaaauaccaaaaaauuagccgggcgugguggcgcgcgccuguagucccagcuacucgggaggcugagucaggagaauggcaugaaccugggaggcggagcuugcagugagccgagaucuugccacugcacuccagccugggcgacagagcgagacuccaccucaaaaaaaaaauuaauuuuauuuauuaucuuuguggguacauaguagguauauacuuauggaguacaugagauguuuugauacaggcaugcgcauaagaaucaugucauguaguauccauccccucaaguauuuauucuuuguguuacaaacaauccaguuauacuauuuuaguuuuuuuuuuuuuuuugacagaauuucacucuuguuguccaggcuggagugcaauggcaugaucucagcucacugcaaccuccaccucccggguucaagugauucugccaccucagccucccagguagcugggauuacaggugcccaccacuacgcccagcuaauuuuuguauuuucaguagaaacgggguuucacuauguuggccaggcuggucuugaacuccugaccucaggugauccacccuccucggccuucuaaagugcugggauuacagguaugagccaccacgcccggccucuuuuaguuauuuuuaaauguacaaguaaauuaucacacagaagugugucugccagggaaggcgggcacaguggcucacgccuguaaucucagcacuuugggaggccgagguggguggaucacuugaggucaggaguuugagaccagccuggccagcauagugaaacuccaucucuaauaaaauuacaaaaauuagccgggugcuguagucccagcuacuggagaagcugaggcaggagaaucacuugaaccugggaagagguugcagugagcugagaucaugcuacugcacuccaaccugggcgacauauaauugacuauaguuacccuguugugcuaucaaucuuguacuguuuuuauguucuuccuugcaaccuucccagaggcaguggauuucugaggaucagagagggaaaugggcuugccuggggucacacagcaaguuugggcagagcugggauagauuuccuggccagugaggucugcuuauuucuuaaccuugaggcggcugcaugucugcguagauccuaguggugcuccagggcucugagcaccucugucucuccccugcuguucaucuucuuucagggucccccuggaaacccaggaauuccaggccucccaggauccgauggcccucuggugagaaccaugagcugggaaaaggaggaaggagaaaggggagccuugggaauuggaauggcaaguuuuggucucugacaacugagaauguuucuuccccagggucacccaggacaugagggccccacgggagagaaaggggcucaggugagugaccaggagguuaggcuggguuggggacgagggucgggaggcagggccugcagucaggggccacagaggagagagaugagggcucuuagaauguggaagggacugucuagaauggcacugaccuuauuuuccucccaggguccaccagggucggcaggcccuccgggcuauccuggaccucggggagugaagguaggugauacgcuugcagguaugagugauuuaccagcuuuggguucaggcaugcgaugcagcuccaucagaaacuucuggauguguggagaggggaaucaguuggccaggccaaauguagugggacugggguuuggagcugcacagccaaggacagccuuacagugugguugucaccuuguuguuagaacagcuaagcccauuagaggccaaacacauuucuuucuuuucucuuuuccuuuuuccuuuucuuuucuuuacuuucuuuuuuuuuuuuuuuuuuuuuuuuugagacagagucucgcuuugucgcccaggcuggagugcaguggagcgaucuccacucacugcaaccucugccuccucccggauucaagcgauucuacugccucagcuuccugaguagcugggacugcaggcaugcaccaccacuccuggguaauuuuuguauuuuuauuagagacaggguuucaccauguuggccaggcuggucucgaacuccugaccucaggugauccacccuccuuggcuucccaaagugcugggauuacaggcaugagccacugugccuggcccgaggguuguguucuaacccaagcucagaaucacauaagcacaguaugcuggguuaagccaagagcugcaaccuggcuaaauagaggugcaggggcauuagaguucauauccauauggaagcugaguccagugacauuguagccaaauacagauguaauuuaccugaacaugugugcauuagacaagcuuagacacacuauaaucaaggaauuggcuauacuguagcaggcacagagucuggcaagcaucacccucagaguuacauuguagccaagcauaauuacauuuuuaaucuuuuuuuguuuuuguuuuugagaccugguucugcucuuguugcccaggcuagagugcaaugaugccaccugggcucaccgcaaccucugccucccagguucaagcgauucucccgccucagccucucgaguagugguauuacaggcaugugccaccacgucuggcuaauuuuuguauuuuuaauagagacaggauuucuccauguuggucaggcuggucuugaacgccugaccucaggugauccggccgccucggccucucaaagugcugggauuacaggcaugagccaccacacccggcccuaaauguuuuauuuuuuagagacagggucuucucuguugcccaggcuggaauauagcagcauaaugauggcucacugcagccuugaacucccgugcucaaguaauccccucacuuuagccuccugaauagcuaggacuauaggcguaucccaccaggcuuggcaguuuuuucauuugauuauuauuauuauuauucuugagacagggucucacucuguuacccacgcuggagugcaguaccaccaucacaguucacucacugcagccuagagcucccaggcucaaucaauccucccaccucacccucccagguagcugggacuauaggugcacgucaccacauccggcuaccuuuuuucuuuuuuuuuuguacuuuuuguauagaugagguuuuccuguguugcccaggcuggucuggaacuccugggcucaagcaauccuccagccucugccucccaaaauguugggauuacagguguaagccaccaugcccagccuuuagaaacauuaacugaccccuauguuguaguugagucuaguuacauuguagccaaccccuauguuguaguugagucuaguuacauuguagccaaagcuagagaacaacuuguagccaagcucaguuacauugugaucaagugaauuugucuguagcuggagacuaaccacaugggcuguauuguauccaagcgcaauuucauuguagcccgcugagcucagagauguuguagccaagugcaguuuucagaguuuggugugagcagcauccagacuugaacuaagcgcucucuccauagccaagcacagaggucaucuuguugccaagcacagagucgccuuguagcuggcacaauggggaacauuccuuugccuuuaaaaugagguccgggccuggaauguucauccucuuucuccugccagaaggaacuguggacaaagcgucuccaggagaugggaaucgcuuacuuggaaauuuggccuucccugcacacccccgcacagaugaccuugagaggccuccaguggggagggaggggccucuggggaaagaucauuucuucugaagcugccccucccagcuucugccuagccuccucuugggacuauccuggcugcuuuagagcaggggacugagucugggucacuucuuaagcagggaagaggcuugagagcuuuuuuuuuuuauuuuccagggcacuucaggcaaccggggccuccagggggagaaaggcgagaaggugaggagagaaggaacucaucagaggagagggagucccaaucaugggguccugguugugucccuuccccgaggcccucacuucuggccucugucucucccacccagggagaggacggcuucccaggcuucaagggcgauguggggcucaaaggugaucagguaagaccagcuccagaugagggguggugugggucugggggcucggggaagauagggaggggaugagcuggggcuagacagagcaggaaggacaaaagauggauauuaaauacucuccuuuuucuuccaggggaaacccggagcuccagguccccggggagaggaugguccugaggggccgaaggggcaggcggggcaggcuggcgaggaggggcccccaggcucagcuggggagaagguaaaugacucuccacccucuagccucccacagucaagguguccccaaucuuuucccucugcccuuugcccuuuuauuauaccuucgaccucaggagguugcuaccaaccuugucaucuuuaauuccucagcucagcauuacagagcaauuuaaugcaugcaacuuauguguucauauccauaaccaccacaugcaauaggcauuuucaucccauuuuacagacaaggaaaacugagacuuggaauggcugaaugaccugcccaaggacaugccccuagcaggcaggagcaaggacuugaaccucguuuccccaacucccaucccauuagcccauucaccaugccccagccagccugaccuuuccgccucugaccuccagguugcaauuucugaccuuugucccauaaccuuucugcagggcaagcuuggggugccaggccucccagguuauccaggacgcccuggaccuaagguaggaagcugggggugggggguggagauggauaugggcaggauucagagacuaacaucuggggguccaggcuguggucuugggggaugagcugcccaccccaagggucacugagagaauguaaaaugugggcuuuggccaggcauaguggcucuuggcuauaaucccagcacccugagaggcugaggugagaggauugcuugagcccaggaguucgagaccagacugggcaacguggcaaaacguggucccuaugaaaacauacaaaaauuagccagauguggcugggcgcaguggcucauggcuguaaucccaacacuuugggcggcagacgcaggcggaucacuugaggucaggaguuagagaccagccuggccaacauggagaaaccccaucucuacuaaaaauacaaaauuagcugggugugguggugcauaccugugauccuagccacucgggaggcugaggcaggagaaucgcuugaacccaggaggcagagguuguggugagcugagauugcaccauugcacuccagccugggcaacaagaacgaaacuccaucuaaaaaaaaaaaaaaaauuagccagauguggccgggggcaguggcucacaccuguaaucccaacgcuuugggaggcagaggcaggcggaucacuugaggucaggaguuugagaccagccuggccaacaugguaaaacccugucacuaccaaaaauacaaaaaaauuagcugggcauaguagcaugcaccuguaaucccagcuacccaagaggcugagacaggagaauuguuugaccccaggaggcagagguugcagugagccaagaucucaccacugaacuccagccuggugacaaagcaagauuccaucucaaaaaaaaaaaaaaaaaaaaaaaaauuagccagauguggucccagcuacuugggaggcugagaugggaggaucaccugagcccaaggagauugagccugcagugagcuaugaucgagccacugcaccccagcgugggugacagagggggacucugucucaaaaauuuuuuuaaaaagugagcuuugacaucagacagacuuggggucaaaugcccucuuacccgcuaugugaucuugggaaaguuucuugagccuguuuucucugcggugaaacagacaucccaguaauuuccaccucaucaauuugauuauaauaauguugauaaugcugaugaugacaaugauuauaaaacuguaggauccuuuuauuuggugugauuaaguuucauucaccaacaaagucaguuaaaggggagaaucauagaaucauaaaauacacaucuuacauaucuugaauuaauuauaacuuauagucaaauguacuuaugcaaaaacguacuuauaugaaaacauaacauuuguuugccaauguuuugaugggugaggacacugaugagauucauuuuucugccuaaacuauucccauauuauaucacugaugaguucuguuucucuagaguagagcaggaaccuaaagacauuuggggcugggcgcaguggcucauggcuguaaucccagcacuuugggaggccgaggcgaguggaucaccugaggucgagaguucaccaccagccuggccaacauggcagaaccccaucucuacuaaaaauacaagaauuagcugggugcaguggcgggugccuguaaucccagguacauggaggcugaggcaggagaauugcuugagcccgggaagcagaggaugcagugagcugagaucgugccacuuacuccacccugggcaacagagugagacucugucucaaaagaaaaaaaaaauagacauuugggaagauaauugagugcagaauccuccuagaguuucacauuuuugugcuguugagcugauaguuaucuugccuacguuggauuugacagugguuuuuuuuuuuuauuuuuucagugauuucccuuuacauugacuccuuuuccuuuaacuuagauuuuuuuuucuuuuuaacgauugagaaaaaaacuuugaagcuuaguuuugauggacaacuuuauucuccuuccuuccuuccuccuuucuuccuuccuuccuuucuucccucccucccucacugcgucccccucuuuuuucuuuucuuuuccuucuuuuuucucuuucuuuccuucuuucuuucuucuuuuuucuuucuuucuuucugucugucuuucuuucucucucucucuucuuucuuucuuucucucucucucucuuucucuuucuuucuuucuuucuuucuuucuuucuuucuuucuuucuuucuuucuuucuuucuuucuuucuuucuucuuucuuuuugcuugcuugcuugcuuuccuuucagacagggugucacucugucauucaggcuggagugcaauagugcgaucauagcuuauuacagcccccaauucuuggacucaagcaguccuccugccucagccuccugaguagcugggaacaacaggugcgcaccaccugaugaauuuuuaaauuuuuuacagagacagggucucgcuaugcugcccaggcugaucucaaacucccagcuucaagugauucuccuaccuuggccucccaaagugcugggauuacaagcauaagccacuguaccugacauagacuaagauuuuagaaaguccuugugugcauguguucaggauccuugaagaguguuggggccagguugguggcucacaccuguaaucucagcacuuucagaggcugagguaggagaaucacuagaggccgggaguucaagaccagccugggcaacauagugagaccccauaucuacuaaaaauuuauuucaaaaauuagcuggacaugguggcgugaaccuguagucccagcuauucaggagguugagguaggaggaucacuugagcccaaaagguugaagcugcagugagcuaugauugcaccacugcacuccagccugggugacaaagugagacucugucucuuaaaaauaaaacaaacaaaaaaagaguauagagaccauggaacccccagaugggaagggagaguagagggagccugaaaugggcuuugaggcgggaugccaccacagacuguguaacuugggcaacugucuuuucugaucugaacucagucugcacagugaggugugggagaggauaucagagccugugaugucuucccccagguggaggaaggguuccuccagcauggacuggagucaguuaacaaauauuaaaaagcacucaccgugugccaggcaguggggaauaagaccaaugagcuaugucacagugggggaaaacaggcauugaauaaauaagucaauaagggucauuucaacgcaaguguucuugggaaaacaaaauagcauaaugugacagacagagggugacuugggcaauguggaagccaggauggugguagaaaggcauucuaaggaggugacaucugaaugagaucuaaauggucaggaguggcugacuuuguggaggccuaggagacaagcauuucagccaaagacagcagccagugcaaagggcugcagugaaaugagaagggaggagaggaggggagaggagagaagagggcugccuuguaggaggcuggggcuguagagaccaaggaagcuucuggaaucagugaccuggaaaugccucaaaggaugguaugaggggccaauuccacccaccacucacuccucacccucaugucuucuuucuaauucucuccacucagggaucuauuggauuucccgguccccugggacccauaggagagaaagggaagucggugagucaugaccggggguaagggagaggggagaacuugucugaggggaacagcaugugugguugugucugaugauggguggacccuggguguuugugucuaugccuggaacauuugugugcacacaugcuauuauaugcaaugcaugacacauguaggugauuacacaugguauuaucaugaauaugacuguaagcacauguauauguguuucauguaucuuucaauaucgaugagacaggguuugaaugccgcagccugcaggccugugccugggugaacaagggcaugaaucugcgugcacuuugcaugauggugggcauaaaugugugcaagaagcuuguacauaugcgugaaaggacauguguauacacauguguguguuucugugcacacugagugauggguauacaugcauguauuguauuuguguugcuauguguguauuguaacaguguuaaugaacauuguauguacguacaugaguguauguauacugcugugcuuaccaagacaaaguccucagcugaauccaggccuucauguguuuacaguggguauacaugugugcaagagauguauugcaugaugaguucugugucaucuucaggcuguggauugccaaaugcaugccaugauuacaugcaaucauguaugcauacugcacagcugugaucaauauaugucuugugggcaaacaugcuugcacguuuguacucuguagaugcaaucauaguuguaauuguguguuugagaucuuugugugguuuugaguauaaguuguauuuguguguauguguaugacugaaaagcuugugaauaaauauguggcagacagcuuucugggucugugacugggugucuuuuuguguuugcgucauaccuuugcacccuaacucucuucugcuuucucucuuacaauucauuuucagggaaagacagggcagccaggccuggaaggagagcggggaccaccaguaagaaaauagacagugcccccuacccugcugggacuuggggacagggcugggaaggaaagguaguggagaggucaucugugggcagggaaaggguuuggguuauaucaaugucccuggucgggcaggagagggagucacaaggggaggggaccuggaagacuuggucucaucucccaggcucccccacccccucauaucugaucuuugccuuuuuuuuuuguucaggguucccguggagagagggggcaaccgggugccacagggcaaccaggccccaagguaugggaugggugggcaaucaaggccccccaugccccaggcucagccagucccuccaaauucuucccaguugaguuuguucuggggccugagucucauucacucuguccuagggcgaugugggccaggauggagccccugggaucccuggagaaaaggugagugugugugugugugugugugugugaaugugugugugugugagagagagagauucugaguggaggacaaacccaagagaugaagagacauuauaaugcagugguaagagcacagcuuaauugggugugguggugcacgccuguagucccaccuaugcuggaagcugagaugagagaauugcuugagcccaggaguuggaagcugaagugagcuaaucacaccacugcacuccagcuugggugacagagcaagacuccaucuuuaagaaaagaaaaaaagaaggagcacagccugugaagucagagagccaugaguucaaguccuggcucugccacucaccuacugugugaccuugggcaagucacuuaaccacucugugccuuaguuuucuccucuguaaaaugggaguaaccucagucuccaacccaaagggcuacaguggugaauaaaaugacugacuuguggagaaugcccugcccaugccuggcaugcaguaagcacucaauaugugcucgauccuguugucauuauguggggcucagggagugggcagggaggcaggggggaugagaucaugauuucuguuuccauuucagggccucccuggucugcaaggcccuccaggauucccugggccaaagggccccccugugagugaggucacccucauuggggguuggguggguggaggaugugggaagggaggaagcccuguaucugugccccaacuuuuucccaccucaucccccagggucaccaagguaaagaugggcgaccagggcacccuggacagagaggagaacuggugaguaaccccucaaccuuugauuccugauccuuuuuuuuuuuuuucuuuuugagacagagucucacucugucaccugggcuagagugcaguggggcaaucucggcucacugcaaccuuugccucccagguucaagcaauucuccugccucagccucccgaguggcacuacaggcgcgugccaccacgcccggcuaauuuuuguauuuuuaguagagacggggcuucaucauguugaccaggcugcucucaaacuccuggcuucaagugacccaccugccucugccucccaaagugcugggauuacaggcgugagccaccggaccggccagauuccugauccuaucaggccuucccugucuccugcuccuccaucccuuccccauguaacaccgcccccacauuuaauuuuucucucuagggcuuccaaggucagacaggcccgccuggaccagcuggugucuuaggcccucaggucagaguggacuccauaaaccucccuuguuuuguaccaguugggggauauuuaggggaaagcuggacuccugagcgacuccccuaggccacccccacucaacaggagccuucuuccucaccagggaaagacaggagaagugggaccucuaggugaaagggggccuccaggccccccuggaccuccuggugaacaaggucuuccuggccuggaaggcagagagggggccaaggugagacacuguccacuggagaucuugguugaacauccaagaucaaccaaggacucagaaucagucucaugggggagggggcccugagucacagauuggagggagacauccccucccuggagcuugacuucccuccuuugcacuccuguagggggaacugggaccaccaggaccccuugggaaagaagggccagcuggacucaggggcuuucccggccccaaagggggcccuggggacccggugaguaucuuuggagacccuccugcaugucccuuagagaaggaaaggaugggggggucaggggagggauggggaauagcauuuggggugcgggaaaugaugaaagcaaaaaaaaugguggagggaacuggggaaggcagaccccucaaagcucaguguccagucccaggagagagguggggacugugagcuccccacagaggaagacaggaccuggggacaccuuugggagucucuuaacugugaauuaucuccuccuucagggaccuacuggcuuaaagggugauaagggccccccagggcccgugggggccaauguaaguauaaccccaugugcugggugggggcaggguggaggggacucaaggugucuuggaagcuugacauugucaugauaaaacccaugauggaggcugaggcaggcagaucacuugaggucaggaguucaagaucagccuggccaacaugguggaaccccgucucuacuaaaaauacaaaaauuagccaggcauggaggcagaugccuguaaucccagcuacucuagaggcugaggcaggagaaucgcuugaaccugggagguggagguugcaaugagccaaggucaguucuguugcucacuggcugggccguuguauuccuuggcaagccucaguuuccuugucuguaaaauagccaugaugggaagccuuaucucauguaugaucacaaaccucauugagaucauuuauccaguaaauacuuaccugugcauuggccaucaacauauaaaaaccccuuuucuugggccagguguaguugcucaugccuauaaucccagcucuuugggaggcugaggcuggagaaucgcuugagcccaggaguuugagaccagccugggcaacauagccagguccugucucuacaaauauauauauauauauauauauauauauauauauauauguauaggcugccaggaggacuauggcuuuuguucuaagugagaugggagccauggaguguucuugagcaggagaagaauaugcccugccccucaggugcucacaggcacccucuggcugcugcaggaggggaacagguuagauacaauccugguaaccucagaacucagugccugguggcuuaaaaacccuccauaaaggacagcuacuacugguauuauaccugauucaucaccccuguucucagggcuccccuggugagcgcgguccuuugggcccagcaggaggcauuggacuuccuggccaaaguggcagcgaaggccccguuggcccugcaggcaagaaggggucccggguaagugacuugcccaucccauuccuagggccuccucagggucuggcccugccacaucccaggacauggcuccugcaggacauuccugcccugacaucccccuuuccauuccccacaacagggagaacguggccccccuggccccacuggcaaagaugggaucccagggccccuggggccucugggacccccuggagcugcugggccuucuggcgaggaaggggacaaggugagggguucacagagaggaaggguccaggggaggaugggggugaauggaagcuggguccuucaucccauuuccucugcagggggaugugggugcccccggacacaaggggaguaaaggcgauaaaggagacgcggugagugaagguccccaguggggcagggugggguggguagcggaagaaagaggaggccagggauguagagaucauucuccaugggguaggagaggccauggaguuuucugccuucucggguaccaucuugacaauuacaugcaacagaagguacuugagcugccuggagcgauggguccacagaacccaacugcagacaggauagggacagcuggggcucccaaagaacuggaaaggcacuggggugcggguaaccuucuccauuguuagugacacauccuucccucugccugugacucugcguggcaggcacugaagcaucugauacccaacuuccccccaccccgaaugucagcuccaguggcuugcaucauugagccagcuucgucccugggucuugguggaacuuguggccagggcugggcuuaggacagacgucugucugaucccaucuguugguggcugagaagacaggauuuggggggauguagcuguugcugccugguaggggaaguuguucucauaaagggggugugggaggcagugauugauagcuccagugcccucucuaaucuuaaaccugagggaauuuuugauucuguuuccuguucucccagggcccaccuggacaaccagggauacgggguccugcaggacacccaggucccccggugagugcccccaucuuuucaguccuucucuggguccuugaagggagggauagugggagcaaacgacaguggaagcacacugacuuaauccaaaccucaaacccaacccugaucuucccucaguacugacacccaaugugaacucaauccaagaaucggagucaaucccaacccaaccauguuguccccucaauaccgacacucaauaugaacucacccucagaaucugauucaaucccaacccaaccaugucuuccccucaguacaaacacccaguaugaacccaaucccaaauucggagucaaccccaacccaaucaugucuucuucucaauaccaacauccaaugugaacucaaccccagaauuuggcccaaucucaacccaacuaugucuuccccucaaugccaacacccaaugugaacucaaccccagaauuuggcucaaucccagucgaaccaugucuuccccucaaugcugacacccaaugugaacucaaccccagaaucugauucaaucccaacccaaccaugucuuccccucaauaccgacacccaauaugaacucacccccagaaucugauucaaucccgacccaaccgugucuuccccucaaugccaacacccaaugggaacucaaccccagaaucuggcccaaucccaacccaaccauguauuucccucaauaccgacacccaauaugaacucaacccuagaauuugucucaaucccaauccaaccaugucuuccccucaaugcugacacccaaugugaacucaaccccagaaucugauucaaucccaacccaaccauguguucccccucaauaccagcacccaaugugaacucaacuccagaauccugcccagucccaacccaaccaugucuuucccucaauaccaaaauccaauaugaacucacccccagaauuuggcucaaucucaacuccaaccaugucuuccccucaaugccaacauccaauauggacucaaccccagaaucugguucaaucucaaccucaugcucaacuuugaucugccccucuauaucgauguccaauauacacucaaccuuaaaaucagacuaaauuccaaccuaaacccagcucugaacccccacuucagccccagucucaacucuacucaugaccuuaaccucaguucuacucaaaccuuaucuccagccaggugcgguggcucaugccuguaauccuaguacuuugggaggccaaggcggguggaucaccugaggucaggaguucaauaucagccuggccaaaauggugaaaccccaucucuacuaaaaauacaaaaaaaaaauuugcugggcaugguggcgggccccuguaaucccagcuacuugggaggcugugccaggagaauugcuugaacccaggaggcagagguugcagugagccaagauagcaccacugcacuccagccugugcgauagagggagacuccgucucaaaagagggaaaagaaaaaaaaaaaaaaaaagccaggcacaguggcacacacuuguaaucccagcuauucaggagacugaagcaggagaauugcuugaaccagggaggcagagguugcagugagcagagauugcgccacugcacuccagccugggugacagagugagacuccuucucaaaacaaaacaaaaaacaaaaacaaacaaacaaaaacaaacaaacaaacaaaagccuuaucuucaaaucucuuaaccaagcccugacccagaccuguccuuuuuuguuuauuaccauacaauaggaacauacggcccuauccuuaaccccaacucugacccaacucuuccaaugcugaccccagaccugaacucaaacuuugaauaugacccugggcccaaccucaaacccaacccuaaauuccaucucaaccccaguugaacccugcccaagaacugaaccucaacugcaaauccgacucacuguuuaacacuuugacucaacccuugacuucauucccaagcccuguuccuuaaccuagaccccaacuccaacucaacacugacccucucuaaacuuaaucugaacccugacuccaacccuuaaccucagucuugacccuugagccucacucugcccuaaucacugacccagaccuuaaaugugccccuguuuguguucuuccagggagcagacggggcucaggggcgccggggacccccaggccucuuugggcagaaaggagaugacggagucagaggcuuugugggggugauuggcccuccuggacugcaggugggugucuggguuuggggguggcacuucugauucucccuaccuggugccccaaucuugcuucuuuguuccacaggggcugccaggcccuccgggagagaaaggggaggucggagacgucggguccaugguaugcacucccagaggaaggugggagggggaggauggugggguuauagguuggcggcaggcauuagauucauuugagggacauugucauuuuaagggcccugagggucaccagcauugacagugguaucuguggucaauguggccuuuuggggagaggggccuggggucacuggguacuaauucugaccuuccacaggguccccauggagcuccagguccucgggguccccaaggccccacuggaucagaggugagaacucuuggggggccaggaaggcucagagauggggacaaccauuuccuaagaagaggauguugggauuccacagucccacucuuaccccuugcugucucuccagggcacuccagggcugccuggaggaguuggucagccaggcgccgugggugagaaggugagugagggaaggcaggggcugcacggggggaagagauaaaucuaguccuauugggcagggacauucuggggagccccucccugucugcuaggaugggaccucuccccacucucacuuugccuccugcagggugagcgaggggacgcuggagacccagggccuccaggagccccaggcaucccggugagugacugugugauguggucccugcacccaacucagggaaccccugaccccugggcaucuugggccacuuugaccucuggacagugcaagaucauccacucaccccuguccuguggccgucccugauuaccuugaggaaggacaccuggaaguucucagauagggcugcuauguacaguucugcagguugcacacuacacaagacuacaugacccaggggauaggugagggcucaaaucugagucaugaguccugaccugaggaugaguugcccagauggggccccucuucuaauucacucaagggcagcacaugggcuaggccaaccuugcacaugaccaaugggcaccuagaccauccagaccuuucacugucuuaaguccuagcuccuucugaccuuugacccuuggacaaccuaggcuacucugaacccugaccccagaaaagucccagaccaccccaaugccugaauccaaguaugcuaauccuugaucccuggagaguccaggccacucugaccucugaccucuuucuguaaaggggcccaagggagacauuggugaaaagggggacucaggcccaucuggagcugcuggacccccaggcaagaaaggucccccuggagaggauggagccaaagggagcguggugaguccuggggggaagugggggcagacaugggagggggcacuugaauguacuugaagcucucccaaacuuuuuuuuuuuuuugagauggagucuugcucugucaccaggcuggagugcaguggcacgaucucagcucacugcaaccuccgucuuccggguucaagcgauucuucugccucagccucccaaguagccaggacuacaggcacgcgccaccacacccagcuaauuuuuguauuuuuaguagagauggguguucacuauguuggccaggauggucucgaucuccugaccucgugaucagcaugccucagccucccaaagugcugggauuacaggcaugagccaccgcgcucggccaaaacucucccagacuucuagccagggauugcauccucuaauuuacugaucucaugaguaacccccagaacacggaugaaugaaugaauggguggauggauggauuaaugaaugaguggaugaauguaugaaugagugaauuaaugaauggacaagugaauaacucaguggauggaugaauacgugaaugaauaaauggaugaauaaaugagugaauggaugaacgagugagugaauggaugaacgagugaaugaauggaugaacgagggaaugaaugggugaaugagugaauuaauggaaaaaugaauaaaucaguggauauaugaauaugugaaugaauaaaugugcacgaauaaaugagugaaugaauggaugaaugaguaaauuaauggaugaauaaguaaauuaauggaugcaugaauaugaaugaauggaugaaugaaugaguggccgaauggacaaaugagugagugaaugagugaauggaugcaugaaugaauggacagaggcgcaagugaacaaaaugacugaagagaugagugaauaaacgaauggauggauggaugagugaauuagugaguaaaugugugaaugaaacauaaacgugcagugguuauacaucauugaauggcaagaaaguugauuucauggcagaucauucuaacacuugaauuagugaguaaaugugugaaugaaacauaaacgugcagugguuauacaucauugaauggcaagaaaguugauuucacggcagaucauucuaacacuguugcaaagauuaagguugaauugggucagauuugggguggaugugggauuuggcuuugaggugaagguugaggcccuucugucaccacaguagagguuggggcggguggaggucaggaaggggcuuuagcaucugugggaccucgacuugaauggcauuguuuggcgugucccuucucugaguguaugaaugaauggauggauggaugaaugaaugaaugaaugagugaaugaaugaauagacgaaucaaugaaugaauagacaaaugaauggccaguuuucucugugagucccgagcugagaggcugugaggacgcugcagugagaccaugcgugcggcauucuuagcucagcgucugcacccaugaaacacgagaauguucgcucuaccaagccagggauuuuauguuuuguucacuaauguguccccagaaaccaaacuguuccuggauacaguugaucuguuccauaaaugcaugauugcuccacaauucagagaugugauuauuaaucauucuguguuccagggccccacggggcugcccggagaucuagggcccccaggagacccuggaguuucagugagugugacccccuccccaauccuggcauauuuccuaauucuguccccaucucccuacccccacagaccugggcacugacaguggaaccaaaaacguucuuuugccucccagccccaucccaaauucucacguacccucaucaccccucccaacucugucuuccccccaugcagggcauagaugguuccccaggggagaagggagacccuggugauguugggggaccggugagugggaaaacagaggguguggugcugaggcggggguuggggagcuaaugagugagugaauugggggggcaggggagugggcuagugggguacccaaggccccugcagaugcucccgcuucaccucucuggggacccccaggaaugugagcagcuugagggaguaggugggaggugggaguacccggugcuggggugaggcuuggggaaggguguccucugguccaaggcguccuaaaacagucaggcucaaacaauguuagcugagaccacagcugguguccuugucuccuccaggguccgccuggagcuucuggggagcccggcgcccccgggccccccggcaagaggguaagugauaagccaccuccuggguccucagcuuaucuacagcccccacucaccuuacagaccucacucaucccacagcccucaacucaccccacagaccccacacacccacagaccccacucacuccacagcccccacucaccccacagaccccacacacccacagaccccacucacccacagaccccacucaccuuacagcccccacucaccccacagaccccacucaccccacagcccccgcuuaccccacagaccccacucagccacagaacacacucacccacagaccccacucacccacagauuccacucaccccacagaccucagucaaccacagaccccacucauccacacaccccaccucaccccaaagaccccacucaccccacagcccccacucacccacagcccccacucacccacagaccccacucacccacagaccccacucaccccacagaccccacucacccacagccuccacucacccacagccuccacucacccacagccuccacucagccacagcccccacucacccacagcccccacucacccagaccucauucaccccacagaccccacucaccuuacagaccccacucauccauaaccccccagucacccagaccccacucaccccucugacccucagucagccccuagaccccccucacugucuuucccuuccaaggguccuucaggccacaugggucgagaaggcagagaaggggagaaaggugccaaggugagucccccuggcaaggggaagggucccugcacuacucuaggccaacaguggggccaucaggagaggguggaccuaugaccacucugugcaccuacucccucccgaucccagaugcuucuuggcaggggucaggaggcaggaacccucugacucuggccccucccuugccuguguccauuucagggggagccagguccugaugggcccccagggaggacggguccaaugggggcuagagggcccccuggacguguggggccugagggucuucgagggaucccuggcccuguggugaguggagcggggcaggggugggacaggguggauccagcuccucucugucugcucccagcuugugaucccaucaccguuuggaggggcugccccuggugcauggucggggggggguccacacuguguucugacagggugcagcccaccccauguucuguuccauucucagggugaaccaggccuccugggagccccuggacagaugggcccuccuggcccccugguaagagacuuguucauccuugagguucuggcucugaggaccacucugggcaccuagugaccaccuagugagcauuggugcaggcuagcccucacugaccauccaucugaguguccauacugccugucucuacuaaccaucugcucugaccuuccacccugauggucuacacugcccaucucuauaacccucugcucuaacacuccaccuugaugaucuacacugcccaucucuauaacccccugcucugaccuuccaccuugauggucuacacugcccaucucuauaacccucugcucuaauacuccaccuugauggucuacacugaccacacugacccuucaucuugaugccugcacugacucuccaucuuaauggucuacacugaucacccacgcugaccuuggccacugaccacucacguuguccauccuccagucaaccccucauuagcucucaucaucccaccuugguggccuacucugaccaucccuugaccucaucccugguaauucccauuugaaaucugcauaauuucccauuugaccauccccuaaccacccacacagaccucgaguucacauuugagaaucccuaacugacccuugcucuucucccaggggcccucuggccucccagggcugaagggagacacuggccccaagggggaaaagguaaggacaucauuccauuauucucuuccccaucuccuccccucuuucccucccucccuggcuggggggcugggagauuggugcauccucugcucccaaacucaucacccuaaggcucuaggagaaaaaccucccugaauccucccacguccuccccugucugugccucuuuuguccuucagggccacauuggauugaucggucucauuggccccccgggagaagcuggugagaaaggagaucagggguugccaggcgugcagggacccccuggucccaagggagacccugugaguguccugaccugagcgggaagaaugcauuugaaggagggggucgguugagagacuguggguguggggucugggaaacgugggucuggauuaaugaggguguguguggggaaaauagggggauguaucugggaacuggcaaguuggaggcugcgucugggguuuggggucucucugugggggaacuggaggcuugucuaggguucggggucuuccuuugguaggauugaaggcuugucugggggaugugucagggcaauaggguguaccccaccaauacugacccgauguccuuuuccuagggucccccuggucccauuggcucucugggccacccugggcccccagguguggcggugaguaugcagggaaucuuuugugggaugaggucacuguggugguccaggccaggaccucagcucucccugucuguacccuacagggcccucuaggacagaaaggcucaaaagggucuccggugaguacacccugcuuccgugggcuuacacaucccagcuccccacccccuucacugcaccagaacccuccacgucucugccuucauuuauuuauuuauucaugcaaucgugcguucgacaaauauuuauucaacaccuacgguuguauuucaucagauccaaaaugccaucaauuauaagauguaccauuauuuuacaaacugcuaggaaagaaaacaguucugccaaguaaacuaugacuugccaaagauguuaagaagcugauuucagagacauuaaaacaugaaaagaaaauuugugucugaugccuaaugcugaaaacugcaugucucuuccccaaggcuguaugugugugugugagugugugagugaguguguaugugagugugugagacugugugugugugagugugugugugaguguguguguguguuuguguguauguuggugggaagggucuccauagacaggguucauucuccaagugacuucucccuacagggguccaugggcccccguggagacacuggaccugcaggcccaccaggccccccggugaguuccccggggggcgggggaauggacaccaaaaccuggggggagagcaaggacuaugucuggguguccccagaggguccuuccgugcgcagcacugggccaggcacacacuagguguucagaggauguaggugaagaggguaguucccuguaaaaccccaaggaaggucuggccugggaggggggacuuggggggacacccaugggggcucugaccugggucuugucucuuggaccccaucucucccucccugucucuguccaucucccuuaucugucucugucuauacuggcgccacuauuucaucuucugucucucucccugcucucucucccugucucugcuauucuugcgcuuucucuuuuguccucuuacaacuuggcuucuccccaucucugaaucugucucucucuuuccugugugucucucccugucugcuuaucucuccuuucucuaucucugccccuuguuuaucucucucccuccucuuucucauuugugucugucugccucuucaucucugccugucucucuuucucccucucucucccucccccaucuccccucucuucuccguccccauccccuacgcccagggugccccugccgagcugcaugggcugcgcaggcgccggcgcuucgucccagucccgcuuccagucguggagggcggccuggaggaggugcuggccucgcucacaucgcugagcuuggagcuggagcagcugcggcguccucccggcacugcggagcgcccgggccucgugugccacgagcugcaccgcaaccacccgcaccugccugauggugagguccgguccccccgccacuuggaugggcggagugggggugugggggggguugggguccgucgggucccauccggacucacccacccugccuggcucugcggcaggggaauacuggauugaccccaaccagggcugcgcgcgggacucguucaggguuuuuugcaacuucacggcgggaggagagaccugccucuaucccgacaagaaguuugagaucgugaguaacccaaaccucucaucgccucccccaggaagugcuguccccugcuccccacacccacaaccaccuugucugggacguuauccuuccuucaaccggcauuuauugagcacuuacuguaugccaaguccugccucaagagcugggacuacagcagaggaucaaaaagaaaaaaaaucaggccagccugguggcacaugccuauaaucucagcauuuugggaggcugaggcgggaggaucgcuugaggucaggaguucgagaccagccugagcaacauagcaaaaccccauuucuacaagaauuaaaaaacuggcgggcaugguggugcgagccuguagucccagcuacucuggagacugaggcgggaggauccuuugagcccuagaggcagagguuagugugagccgagauugugccacugcacuccagccugggagacagagcaagucuccuucucagaaaaaagaaaggaaagaaaacaaacuaucucugcuuuuauggaacucauaccuuccaugggaagacagacaaggaaaacuccaaaagaaaucaauaggcuggaugugguagcucacgccuguaaucccagcacuuugggaggccaagcgggggcagaucaccugaggucaggaguucgagacaaggcugaccaacauggugaaaccccgucucuacuaaaaauaaaaaaaucagcugagcgugauggcgggcgccuguaaucccagcuacucgggggcugaagcagcagaaucacuugaacuugggagacggagguugcaaugagccaagauugcaccauggcacuccagccugggugacagagugagacuccgccuagaaaaaaaaaaaagaaggccgggcgcgguggcucacuccuguaaucccagcacuuugggaggccgaggcggguggaucacaaggucaggagaucgagaccauccuagcuaacauggugaaacccugucucuacuaaaaaaaugcaaaaaauuagccaggcaugguggcaggcgccuguagucccagcuacucgggaggcugaggcaggaggauggcgugaacccagaaggcggagcuugcagugagccgagaucgugucacugaacuucagccugggcgacagagcgagacuccaucucaaaaaaaaaaaaaaaagaaaaagaaaagaaaaaaagaaaguaucuacuucauagaguggcugugcaauucagauacugaugcaaaaacaaauaucagugaacuguuuuguuuuugugugugugugagacagagucugucucugucucccagccuggaaugcaguggcgugaucucagcucacugcaaccucugccucccagguucaaguguuucuccugccucagccuccccaggagcuguaauuacaggcaugcgccaccaugcccagcugauuuuuuuuuuuuuuuuuuuuuuuuuuuuuuuuuuuuuuuuuuuuuaguagagaugggguuucacuacguugguuaggcuggucuugaccucaggugaucugcccaccuuggccucccaaagugcugggauuacaggcaugagccaccgcaccuggccugcagggaacauuuacuaaacccugacuacauguagugcugggcuaauaccucuaucugcagguaaagcacuuagcaagaaccuggccgguauaagugugaaauaauauuuauuguuauuguuauuuuugucuguuuuucagacagggucucacucugucacccaggcuagagcacaguggugggaucacagcucacugcagccuuaaccuccuggguucaaugauccuccugucucagccucuugaguagcugugcaucacacaggugugcaucaccaugccuggcuaauuuuuuaaauuucuuauagagaugagggucucacuauguugcccaggcuggucuugaacuccuggccucaagagauccuccugcauuggccucccaagguauugugauuauaggcauaaaccaccacacccggucuauucuaauuuuuauagacagggucuuucucuaucacccaggcuggagugcaguggcaucaucauagcucacuguaaccuaaagcacugggauuaagcagugggagaaagccacugugcccagccccauauuguuuuguucuuuugagacauagucucacucuguugcccaggcuggagugcaguggcgugaucuugguucacugcaacuuccaccuccccaguucaagcaauucuccugccuuagccucccgaguagcugagauuacaggugccugucaccacaccuggcucauuuuguauuguauuuuuagcagagacgggguuucaccauguuggccaggcuggucucaaacucauggccucgagugauccacccaucucggccucccaaagugcugagauuacagguuugagccaccgcgccuggccccauguuguuauuuuuaacugguuuauuuucuccugguuuagugggagcucagaugcccaguggaugggaauuuagacaagcuuggacuucccacugggcccggagugcaagacuugaucccuaaacaauuacuaacaucugaggaccuccucuucacucaccugcuuagccuaaagggagaggcugaggcugggcacaguggcucauaccuguaaucccagcacuuugggaggcugaggcugaggugggaggaucgcuugagcccaggaguucaagaccagccugggcaacauagaaagacccccuccacccgcccccccccccaaaaaaaacaggcaugguggcacacuccuauuaucccagcuacuuaggaggcugaggucagaggauugcuugaacuuuggaagucgaggcugcagugagccagugaucacaccacugcacuccaagacccugugacagaacaagacucugucucaaaaaauaaaaauuuaaaaaagcugggcauggggguacaugccuguaguucuagcuacuugggaggcugcagugggaggauugcuugagcccaggaguuugaggcugcagugaacuaugauuaugucacugcacuucagccugggugacagagugagauccugucucaaaaauuaauuaauuaauuaauuaaaauaaaauggugccauuggagacccagagcucaaucccacuggggagcccugggagacuguguagcacaggcaccugagaguuaucccccuuggaggugagggagcugggguauuuauccaccaacucccauuagucauugggugagggcugccucaggggcaugaaccuccuucccccauugugcacuggcagagcucguccaucccagaagccagagaacauccugacauagucacaacagccuacugugugaggagggaaaugcagaugagaucuagauggcaccaagggcgucagcuacagugacccucccuuuucucuuccaggugaaauuggccuccugguccaaggaaaagccuggaggcugguauagcacauuccgucgagggaagaaggugagucaccgaggccgagauggggagugacaugaaaauugaugggaaccagcagggggguuugagggguggguucugagaggugagaugaagaggauaggcuuuccucuaccuuccuagggaucgcaagcuggaggugggguggcagcagcaucagauguguaacaggcagucaauugccauacagaaugauggugccaggauaggggaagcacagggcaugguggaaauuuagaggcaguguuggaaagaccagaaggcuuccuaguagagaucacagcucaucugaagccuaaagaaugcacuguguuagcaagcuaggaaggacaaggacaaguguuccagggagagggaaaggcauaugcaaaggcucagucaagacagggucuggugaauuugaagaagaaaaagccacauggcuggguacaguggccuguaauuccagcacuuugggaggccaagguaggcggaucaccugaggucaggaguucaagaccagccuggccaacauuguaaaaccccaucucugcuaaaaauacaaaaaauuagccagacauggugaugugugccuguaaucccagcuacucaggaggcugaggcaggaaaaucacuugagcccuggaggaagagguugcagugagccaaaaccgugccacugcacuccagccugggcaacagagcgagauuccgucucaaaaaaaaaaaaagcauuauuaagauauuuuguauuuuuuucagauuagcucuucaaaaucugauggagauuuuacauuuauaguacaucacaauuugaaugcuaaauuuuauugggaauauuugcucuauauuuagauuucauaaaaccauugaacaacaguucaaaaaguagauucagacucaaguuguuccaagcauaagcuuucugauaacuggauugaagcucagucauuaguugugaauuuuuuuaaguaaaagaauucagggccaggcacaguggcucacgccuguaaucccagcacuuugggaggccaaggugggcggaucacgaggucaggagaucgagaccauccuggcuaacauggugaaaccccgucucuacuaaaaauacaaaaaauuagccgggcgugguggcaggcgcccguagucccaguuacuugggaggcugaggcaggagaaaggcgugaacccgggaggcggagcuugcagugagcugagaccaugccacugcacuccagccugggcgacagagcaagacuccgucucaaaaaaaaaaaaaaaaauuaaaugaaguuaaaaaaaaaaaaagucccagccaggcaugguggugugcaccuauagucccagcuacuugggaggcugagaugggaggaugacuugagcucaggagauggaggcuggaaugagccaggauugugccagugcaccccaacuugcgcgaaagagcaagaucccaacccuuaccccccaaaaaaggaaaaaaaauuaaauaaaguaaaaaaaaaucccuccuucaaaucagccacauuucaagugcucaaaagccacguggcuauuagacauguggcugccauauuggacagggcagaaaucugguaucagggacagugagcucuguagauccagcgacucacaagaguggaggcagaguugugucuucuggguggggaugaguguguuaaaacccuggauugguggaugaagcaaucagaauuugggaggucagauggagugggcauggaggccuacuggauggagagguggacagaguggauguucaggugacucuugggauucugccagggaucucuagguggcuggugggaccuccucagagauggugacaugggggggguggcuugucugccaguggauggagauuccaggggguggcuucugcagaaagaggcucauggagccccucauccucugccuugcccuccucucaccaguucuccuacguggacgccgacggguccccagugaaugucgugcagcugaacuuccugaaacugcugagugccacagcucgccagaacuucaccuacuccugccagaaugcagcugccuggcuggacgaagccacgggugacuacagccacuccgcccgcuuccuuggcaccaauggagaggagcugucuuucaaccagacgacagcagccacugucagcgucccccaggauggcugccggguaagaggguggggcaguggccagcuagagaggggaggcaagaugucggccaccuucccgguaacucaccgucucugucuucucuggggacagcuccggaaaggacagacgaagacccuuuucgaauucagcucuucucgagcgggauuucugccccugugggauguggcggccacugacuuuggccagacgaaccaaaaguuuggguuugaacugggccccgucugcuucagcagcugagaguguccggggugggagggaccaugagggagccccagaauggggugcauuuggugcugaggcuuugaagccaccguauuuuucguuaccugugacuauggagccaaugggaugugacuucgcucaucacggacagucauuccuucuccuuuccagggugcugggggcugggguucccuggcccaaggguccagccuccucucaccccauuccagguggcauacugcagucuggcucuuucuccccucccuccccacccaagccucaccuccccaccccuugaacccccaugcaaugagcuucuaacucagagcugaugaacaaaagcccccccacccccaaugccugccuccucacuccuccgucgcugcccuucacaccuuuuggugcuaccccuccccagaguuaagcacuggaugucuccugaucccaggcugggaccccuacccccacccccuuugauccuuucuacuuccacggugaaaggacugaggucggacuacagagggaagagggacuucccuugacuggguuguguuucuuuuccugccucagcccagcucugcaaauccccucccccugccccccaccuccccaggcucaccuugccaugccaggugguuuggggaccaagauguugggggggugaaucaggauccuaauggugcugcccuauuuauaccugggucuguauuaaaagggaaaguccccccuguuguagauuucaucugcuuccuccuuagggaaggcugggauaugaugagagauuccagcccaagccuggccccccaccgccaggccauagggcauaauuugcaucucaaaucugagaauaaacugaugaacugug

SEQ ID NO: 192021 - RNA, 61734 nt, Homo sapiens
ggcuccguuccauccuucugcacaggguaucgccucucuccguuugguacauccccuccucccccacgcccggacuggggugguagacgccgccuccgcucaucgccccuccccaucgguuuccgcgcgaaaagccggggcgccugcgcugccgccgccgcgucugcugaagccuccgagaugccggcgcguaccgccccagcccgggugcccacacuggccgucccggccaucucgcugcccgacgauguccgcaggcgguagguaccaugggggggaacacggacucagggggacaggcagggcgcuggguggggggucgcuuccccucgggguggccgguggccgcugcugacagacgggcgcgcaugcgugggguggugcggcgcgcagcggcaguuggcgcgggcaggguggcacuuccggucgcgcgugcccgggcuguuuggcgccaaaauggaccguggauucccccguagcucccugguggcuagaaacuaggcgggguggggguucucuuuugauccccaaauacagcaagcuuuggguucguuuccgggguccccuucuucaagcagcggugggccgggcucuugacuccagcuuggucgcacaggaagugggcagcccgcggccaacggacaccccucgggcaccggcacuucggccuccacuuccgguguccggcccgguccccgggggcgcuucugugguggggggucccucagugccuuucccccaaagcugugcaucucgauggcggccuccagagacggaugucacccgucggggccugggcugggcuggcucauguucgagagcccagccuuccgugggguacucauucugucaguugggacugugugguucuugcuccuugggaaaguccauguuuuggcaggaacuuuaaccgugcauugcagcgcagggcccgggaagcgugaaggcugcaugguuggucuuuuccuguaaaucugugccugugagccgugggcaucagggaagucuugcuaaugagaacuggcuacacuuucguguguguuuguguguguucauggguguguucuuuagugugugucuaauguuggaggcccuggcuuuagcaguucaugccucuguccaacuuccgugcacaaggaucagugggagcacuggucccagccccuuguucaugaacgccaucaguucauuccugaaaacuuguucaagugaggugugcgugagucagaggaacccucaccaggcguggacacuuccagcuggauuugugaaagcacucuuugccauuuuucuauuuccuuaggcuuguuaacugaccugguugggccaguccgguucugauuugggucuuuggggagggauggauauuugguucaacccccgcuuuuuuucuuuucuuuuuuuuuuuuuuuuugaaggcugggugcuguggcuuaugccuguaaucccagcaauuugggaggcaguggcggacgaaucucuugagccaggaguuugagaccagccugggcaacaaggcaaaaccccaugucuacuaaaaauacaaaaauuagccuggaguagugccgugcgccuguggucccaacuacucaacagacuaaggugggaguaucacuugagccccagagguugaggcuguguguagcgagcugagaucgcgcuauugcacuccagccugggugacagagugagacccugucucaaaaaaagaaacacuuuuuauuuuuagagaugggucucacucuguuguccaggcuggagugcccuggcacaauuauaacucacuguagccuugaacuccugggcuuaagggauccucagccuccugaguagcugggaccacaggcgcccaccaccaugcccagaugacuuucuuaguuuuuguuucuguauacgugagguuucaccauauugcccaggcuggucuuaaaccccugcccucaagcaguccuccugccuuugugucccaaagguuaggauuacaaguaugagccaucaugccuuaacuacuacuuuuuuuuguuuguuuguuugagauggagucucauucuuucacccaggcuggaaugcgguggcgugaucucggcucacugcaaccuccacuuucaggguucaagugauucuccugccucagccuccgaaguagcugggauuacaggugcacaccaccacgccuggcuaauuuuuguguuuucaguggagucgggguuucuccauguuggucaggcuggucucgaacuccugaccucgugauccaccugccucagccucccaaagugcugggauuauagucaaaccacuucuuaaccaguuaguggguauauaucuucuugaaucaucugugccaguauucucccaaaauaaaacuugauuuaaaauggaauggaagugaaauuaugaaagugccuggcuucaugauguuacacccaauucagagaaguuugggcccggccuuccuuuuuuauuccuuuuuuuuauuuuguagagauggggucuugccauguugcucaggcuggucuucgauuccuggccucaagcgauccuccugccucagcuucccaaaguguugggauuacgggugugagccaccaugcccagccugcccagccuucuugaaaacaugaccuccacuggcucaaugaccuuaaacaagcguaugccaccucuauauccauagucuaggaauaaugacauggguuuucagcugguauuggguuaaaugagaauaugcauggcacauaaagguucacaugcuaguggcuaacuuagcuuguuuuuuucaguuuuuuuuuaagagacaggaucucacugugucacccaggcuggaaugcaguggcacagucauggcuuacugcagccuugaaccccugagcucaagcaauccuccugccuuagccuccugaguggcuggcacaugccaccaugcccaaguuaauccuuaaaaaauuuuuuagaaggcugggcgcgguggcucacgucuguaaucccagcacuuugggaggcugagaugggcagaucaccugaggucaggaguuugagaccagccuggccaacguggcgaaaccccaucucuacuaaaaauacaaaaaaauuagccagguaugguggcaggugccuguaaucgcagcuacucgggaggcugaggcaggauaaucgcuugaacccaggagccgagauugcaccguugcacuccagccugggcaacaggagcgaaacucugucucagaaaaaaaaaaaauuuuuuuuuuuagagaugagggucuugcuuuguugcccaggcuggucuugaacuccuggacugaagcaauccucugcguuggccucccaaagggcugagauuacaggcgugagccacagggcccggccauuauuccucaagaguucuuaaaaguggaugcugcaggaguuaacugccaggaagcaggaauuccugcuaaggucugcugcuugccaaagccuuucccuucaacagggguugccaguaggccacuggcucaggggcucuguuggcccugugcaaauauuuuguuuggcugaauuggaauaccauuaggugagccuuacaauccaccacugacccuggguuccacauuucuuuacacucagauugcuucacuguaggcauuggaguuuuggaggacugcuuuugaccaugugguagacauugaaauuguaguuuauaugacucacuccacagacuuuuuuuuuuuuuuuuacauuuugaaaauauuucauuaaaugaaaaauaaacaugguauccaacaguacuugaaacuuagauuuuuuuuuuuuuuuaauugaggcagggucuugcucuguggcccaggcuagagugcaauggugugaucucagcucacugcagccuccgcuucccggguuuaagcaauucuccugucucagcuucccaaguagcugggauuacaggugugcaccaccacgcccagcuaauuuuucuuuuucccccucgaggcugagccuugcucugucgcccaggcuggagugcaguggccgugaucucggcucacugcaaccuccaccucccgaguucaagcaauucuccuacuucagugucccaaguagcugggauuacaggcgcccgccaccaagcccagguaauuuuuguauuuuuauuagagacuggguuuugccauguugaccaggcugguuucaaacucuugaucucaagugauccacuuaucuuagccucccaaaaugcugggauuacagguaugaugguguccagccgguucauuguuuuuauuuuauuuuauuuuauuuuauuuuauuuuauuuuauuuuauuuuauuuuauuuuugagacagagucuugugcugucgcccaggcuggagugcaguggugcgaacuuggcucacugcaaccucccccucccggguucaagugauucuccugccuuagccuccugaguagcugggauuacaggcaugugccaccacgcccggcuaacuuuuucuuauuuuuaguagaaaccgggguuuaccguguuggccaggcugguguugaacuccuggacucaagugauucgccugccucagccccgcaaaguguugggauuacaggcaugagccaccgugccuggccuuuuaauucauucuuaagccugcucucagacagcuaggcuugcuucuccacaauaaagaguguugaauuuugucgguguaucccgcauggugccauuauaacacugaaauuagugauuauuucagggucuguuaccagagcgugucugccguauucacuguaucugcagcuuggagcacaguagacucaaaugcuugcaugccagcucuuccccuguacagccuggauuaacacugaugcuagcagacuccuuugcacaacugauuagcuuucguaacuaccacagcuuucuuacugcuagucauucugugaugggauuaagcuaggucuugaacuccuuaacuccaguuccuuggcuacuacugaguacauacugaauaaggcaaaauugacuuaccucuuuuguuuugcuccccugugguagaauucuagggguacagacugcuggguuucaaaugccgcccuacuugccagccguauggcuaaguuauugaacuucuuggugccuugguguuucaucuauaaaaaggggguggggcugccugcucgacagggguguuaggaagacugagcuuaucaguacagauauguugagagcagcaccuguccaaagcccuucaucacugguuauuacgugguacuguguguacaguggggaugcuguggguuugguuccagaccacugcaguaaagugaaucuagcaagaaagugagucacacacacauuuugguuuccuaguauguguaaaaguuauuagacuaggccgugugcaguggcucaugccuguaaucccagcaguuugggaggccaaggcaggaggaucgcuugagccaaggaguucaagacuagucugggcaacauaggaagaccccccccaucucaaaaaaaaaaauaaagccaaaagugguggcaugcaccuggggucccagcuacucgggaggcagaggugggaggaucacuugaacccaugaggucgaggcugcaguuugccaugauugugccacugcacuccagccugggugaaggagugagacucugucucaaaaaaaaaaaaaaaucagcugggcgugguggcucacgccuguaaucccagcacuuugggaggccaaggugggcagaucacgaggucaggagaucgagaccauccuggcuaacacggugaaaccccgucucuacuaaaaauacaaaaaaaauuagccaggcaugguggcacacgccuauagucccagcuccaugggaggcugaggcaggaaaauugcuugaacuugggaggcggagguugcagugagccgagaucaugccacugaacuccagccugggcaacagagcgagacuccgucucaaaaaaaaaaaaaaaaucaucugagucuucagcgauucauaaucuuuuugcagguggagggucuugccucaaacuugccggcuuaaaggacauacauuuauuaccuuaugcaggucagaaaucugauguggguuucaccggaugaaaaucaagguguaagcaggcugcauuccuuucugggggcuccaggggagaaucuguuuccuauuuugggguguuggcagaaggugguaguuguaagacucaggucccauuuucuucacugguucuaaacugagggucguugcccgcuucuggaggcggucucaucccucggcucaugcccccuuccucuaccuuuaaagucagcauuugcggguugcaucucucucugacccguccuccaacguugcccgcucucugcagcuagaaagguucuguguucuuaagggcugaagugauuagauugggcccaccccagauaauccaggauaaucuccccaucucaaggucuguauucuuaguuacaucugcaaaaucgcuuuggccacguaaaguaauauauucacagguuccagggauuagggcaugaacauuuuucgguggguccacucuuuuugagauggagucucgcucugucacccaggcuggagugcaguggcaugaucucggcucacugcaacuucugcuuccuggguucaaaugauucuugugccucagccucuugaguagcugggauuacaggcgugagccaccaagcccgguuaauuuuuguauuuuuaguagagaugggguuuugccauguuucccaggcuggucuugaacuccugagcucaggugaucuacccgcuucagccucccaaagugcugggauuacaggcaugagccacugugcccagugggucuacucuuuugccuacugcggaugccuucuugggcagcccugcuccagcugccaugcagccggccugaagaagcugguuugacagagacuuguaacuugucuugcaugguccacuauauuuuauuuuuagagacaaggucuugcugugucacccaggcuggaaugcagcggcacaauuauagcucacugggcucuagugauccuccugccucagucuccugaguagcuaggaccacaggugcaugcugccacaccaagcuaauuacuauuuuuuguuuaggcagggucucugcuguguugcccaggcuggucuugaauuccugagcucuauugauccucccgcuuuggcuucccgaguagcuaggccuauaggcacaugcuagcacacccagcuaauuacuaauuacuauuuuuuguagagacagggucucgcuguguugcucaggcuggucuugaauuccugggcucuagugauccucccgccucagccuccugaguagcuaagacuauaggugcaugccaccacacccagcuaauuacuauuuuuuguagagacagguucucgcuguguugcccaggcuggucucaaauuccugggcucuagugauccuuccgccucggccuccugagcagcuaggaguacaggugcgugcugucauacccagcuaauuacuguuuucucguagagacagggucucacuguauugcccaggcuggucacaaauuccugagcucuagugauccucccgccucugccucccgaguagcuaagacuauaggugcaugcuaccacagccagcuaauuauucuuucuuguagagacagggucucgcucuguugcccaggcuagucucgaauuccugggcucaagugaucuuccuguccuggcuucccgaguguagagauuacaggcaugagccacugcgcccagccauggucugcuguauuucagacgagcauuucuggcguagagguguuagaguaaucuaacauuuuauaauuucuuccuauccaaucuauacuagauaccucugcuggguuaguuuucuuaacacggcucugaugucauugguucuacuuccccuugacugcuuugguguuuguuaacuauggaacaagauggauaagugugaugcuuuugcccucccuccgacuguccccagccaccucucuggaggugccuuucccucccuguauguggccagucucacguuuguuucuuguguguuuccagaaccagccacuucucaauggugccccuguuugagcagcuuccugugcccgguucacacagagcugucaacuucuuccugaggcuguuauacccuuucucuugggaaucccgcaggcgugagcuguauuugccuuauuccucugugguuguuuauauauaucuuuuuuuuuuuuuuuuuuuuugagacggaguuucacucuuguuguccaggcuggagugcaaugacgugaccuuggcucaccgcagccuccaccucccggguucaagcgauucuccugccucagccuccugaguagcugggauuauaggcaugugccaccaugccuggcugauucuggauuuuuaguaaagacgaaguuucuucauguuggucaggcuggucucgaacuccugaccucaggugauccgcccgccucggccucccaaagugcugggauuacaggcaugagccaccgugccuggccagcuguuuauauauaucuuaucuccccucugcagaggguucaucucugagggaagcacuaggaaggaaucauagggucucaggcugggcacuaagccggcauucugaguccucugcuccguccuucacggcugucugcgacccuccuggcuucagcaggugugaucggugucaucacaguuuuaccagggaagggaugucgcuaaaguuacccucccgccagcuccucacugccugccugggaucccaccugccacucuggggccaggcagguuaaauccaguuucuacuggaugaaacauucuagggguuuugaagguuucucuauucucuuugccaggcuaaauaucccaguucauaugagggguugaaagaaagcagacccauucugcaaggacaccuuggucuccgcaaucaguugaaccuuguccuucacaccccaggcaaccucgggaucaggggacuggcuggcuuggucgagguagaagccauguccuuccaguuuucucagcggcgugacugagaagucaaguguaacgcuauuaccacagcgugugugccucuggcuggaaguaccaguuucuguagcccuccugacuuaaggcucuccuuggaccccaguugcuacaaggguagaaugacuuuugccuggaagagguuccuugugcuccuggaaauccugaugucaaagcaucuuuuuuuuuuuuuuuuuuucuuuugagacagggucuuguucuguugcccaggcugaacaggcuggauugcagugguaccaucauaacucacugcagccucaaccucccaggcucaagcgauccucccaccucagccucccaaguagcugguaccacaggugcacacuaaccacacccagcuaauuuuuacauuuuuuuuguagagaugggaucucucaguguagcccaggcuggucucaaacuccugaccucaagugauccuccugccuuggccucccaaggugcugggauuacaggcaugagccacugcgucuugccuggccuuguagcaccuugaguccaagugauacaguauauauaauauacagucuauauuaccacuguguuuguagggugcuaagugucucuucuacagagcagucuuuuuuuuuuuuuuuugagacagaguuuugcucuguugcccaggcuggagugcaguggcaugaucuuggcucacugcaagcuucaccucccggguucacgccauucuucugccucagccuccugaguagcugggacuacaggcgcccaccaccacgccuggcuaauuuuuuguauuuuuaguagaggcgggguuucacuguguuagccaggauggucuccaucuccugaccucaugauccgcccaccucagccuuccaaagugcugggauuacaggcgugagccaccgugcccggcccuacagaauggucuuuccuaaccacacagcaagucaggaagucccugccuagugacaccuacaucuaaucacuuagcucuuugccuggagcagggccuggcauucagcaggugcucauaugugagcggcgcugguggggaaucagggcccgcaugacccagagcagcuguuguaagacauggguccagcaaagcauuccucaugcugcugccugcacuuacccucuaggaaggccagccuggaggagccacuucugcccuucaggcaaaugauaacugagcaccugucugugcgggugcuagguggaaagguccagagauggcaguggccuggucccugccuggggcaccuucucuccaccaacagacacuuacccagcugguuaggccuguucucaccccgcagucuguaguuagcacccaggcugggaacaacagccuguguuccucucccuuuccuugguaccuucucuucuuguuccuuuauuuuuuucugaagagauaggaucgcccuauguuguccaggcuggacucgaacuccugcccacaagccauccucccaccacagccuccugaguagcugggguuacaggcacgcagcaccgcggcacugcaccggcuauuguucuuuuauuuuuuucccucuuugucccugaaagagucaagcuacuaauugucaguaaucaaaucagaccacgauuucccaggcaaacuccuggcaguucuacauuuaggaaugacuagcuagagacauccugaagaaugaguuauucggggaggcgccagccaccuccucuaacuucaccucuaucugcccucuguguggguaccccuugcuucccuggaugcuugacucccccauuucauccucaaaaugccaccaccccccaccaggccuuuaggaacaucagcuggcuguuccccacaguguccuguggcccugggcuacucauucugacacuggccauacuguggcacaccuuguuaugggcuguugucagacccaacuggagaaagaccagcuguaggucauuucccuuacgggagugccccaacuauaugaccugcccccucuuuccugguaucuuuuugagucagggucucacucugucuccuagauuggagugcagugaugcaaucacggcucacuguggccucgaccucccaggcucaggugaucuuccuuccucagccucccaaguaacugggaccacaagcacaugccaccaaacccaguuauuuuuauuuuauuuuauuuuauuuuauuuugagacagaguuucacucuuguugcccaggcuagagugcaauggugugaccagcucacugcaaccucugccucccggguucaagugauucuccugccucagccucccaaguugcugggauuacagccacccaccaccacgccuggcuaauuuuuguauuuuuaguagagaugggguuucgccauguuggccaggcuggucucaaacccuugaccucagguaauccacccaccuuggcccucagguaauccacccaacugcugcuguauguugggauuccaggcaucagccaccacgcccagccacuaauuuuuguauuuuuguagagauggaguuucgccauguuucccaggcuggucugaacgccugggcucaagugauccgcucgccuuggccucccaaagugcugggauuauaagcgugagccaccaugccuggucucugguaccuuuuaaaauauacaggcugggcaugauggcucaugccuguaaucccagcacuuugggaggcugaggcagguggaucgccugaggucgggaguucgaaaccagccugaccaacacggagaaacccugucucugcuaaaaauauaaaauuagcugggugugguggugcaugccuguaaucccagcuacucgggaggcugagccaggagaaucgcuugaaccugggagucggagguugagcugagaucacaccauugcacuccagccugggcaacaagagcaaaacccuaucucaaaaaaaaaaaauauauauauauauacacacguauauauacguguauauauauauacacacacauauguauacauauauacguauguauacacauauauacguauauauacacauauauauguauauauacacacauauacguguauauauauacguguauauauauaugcaugccagacauggugacucaugccuguaauccuagcacuucaggagacugaggcaggcggaucacuugaggucaggaaucuaagaccagcuuaaccaacauggugaaacccugucucuacucaaaauacaaaaaauuaacgaggcugguggcaccuauaaucccagcuacuugggaggcugaggugagagaaucacuugaacccagaaggugaggguugcagugagcugagaucgcaccacugcacuccagccugggcaacagagcgagacuccaugucugucugucugucuaucuaucuguauaauguauauguauguauguauauauguguguguauauauauacacauauauacauacauauauacacacauacucuguuacagagcugcuguguguguguguauauauauauacacauauguauauauacacauauacacauauauauguauauauauacacacauauauauacacauauauauguauauauauacacacauauauauacacauauauauguauauauauacacacauauauauacacauauauauguauauauauacacauauauauguauauauauacacacacacacacauacacauaauuguguuacagagcugcuauguaaucucacaaucaucagaaaaaugacccccaaaaggggaaccuuguucagaucagaugacuucuuagcauuaggcauuccaguaggacacucuagacucuugcggggagacaaaagccagcuuaguuuuuucuaacacucauauguuaaacuuguuuguguccaaaacuucuuuagaacugugauauucuuacaggcaaaugaaguugcuuaacaaguguuuguauuuucuccccuauuucuuccucccaggcucaaagauuuggaaagagacagcuuaacagaaaagguaaucuccaccuuaaaauuuuucuuauuaccaaaucugacugacacacuuuguggcucauaaaaagaaauuuguuuucuuuaaauggauuuugcauuuuuucccauggaguuucaaagauaauuuggauauucuuguuaaaugucagcacuaauuugcugcuaauaguugggugguggugguguuuuuuuuuguuguuguuuuuguuuuuugagacagagucucacucugucacccaggcuagagugcaauggcaugaucucggcucacugugaccucugccucccggauucaagcuguucuccugccucagccucccaaguagcugggacuacaggcacgcaccaccaugcccagcuaauuuuuauauuauuaguagagaugggguuucaccauguuggccagacuggucuugaacgccugcucgugaucugcccaccuuggccucccaaagugcuggaauuacaggcgugagccaccaugccuggcccagguuuuuuuuuuuuuuaaccaaucucaguuccuaaacaaucuacucuggauuguaacuuguccugguaacacuguuuuauuguguuuuuguuauuguuuugagauagggucucauucuguagcccaggcuggagugcaguggcacaauuuuggcucacugcaaccuucgccucccaggcucaagugauuuucccacucagccuccugaguagcucuaacuacaggcucaagccaccaugcccagcuaauuuuuaaauauuuuuuguaaagaugggauuuugucauguugccccaggcuggucuugaacucuggggcucaaagcaauccacuugccucggccucccaaagugcugggauuauaggugugagccacugugccuggccgacacuuuacagaagcacaguauuauucuuauaaaccaugauaugucuccaucucaccuccagcuuucccauuuuucaccacuuuggagacaggagugaagugauccuaauggaaauucccugaacacauuucaugacuguuuaguguuuugacugagacagcauugccugccauucacucauugugaugugaucaggcagcucaauaauuuguguauuaguccacuagugaauagcuugggaauguggguacugcuaaaccuauauccuucccuuaggaaugugugaaggagaaauugaaucucuugcacgaauuucugcaaacagaaauaaagaaucaguuaugugacuuggaaaccaaauuacguaaagaagaauuauccgagguaagucaguucucagcauccuagccucuagaaaaaugucuccuccuaguaacuugucugugaccagggaggcagcaagauccccagcuguccucauugccugaugaugaugaugaugaugaugaugaugaaggaaacacauguguuuccuuguucucugacacuuguuuacauucacugcuacuuaaauuauccuuuccugcuguaggagggcuaccuggcuaaagucaaaucccuuuuaaauaaagauuuguccuuggagaacggugcucaugcuuacaaccgggaagugaauggacgucuagaaaacgggaaccaagcaagaagugaagcccguagagugggaauggcagaugccaacagcccccccaaaccccuuuccaaaccucgcacgcccaggaggagcaaguccgauggagaggcuaagcguaagagcagaugauuccuuuuauuuuuaauuguuuuugagauggagucucacuguguugcccagucuggagcacagugguguaaccucggcucacuguaaccucugccucccagguucaagagacccuccugccucagccucccaaguaacugggauuagagguaugugccaccacacccagcuaauuuuuguauuuaguagagauggggucuuaccauguuggccaggcugguccagaacuccugaccucaaguaauccaccugccuuggccucccaaagugcugggauuacaggcauaagccaccacgccuggcccugcuuaacucucuuucuuucuuucuuuuuuuuuuuuuuuuaaugacagagucuugcucuaucgcccaggauagagugcaauggcgcgaucucggcucacugcaaccuccgccucccaguuucaagcgauucuccugccucagccucccaaguagcuaguauuacaggcgggcaccaccaugcccagcuaaucuuuguauuuuuaguagagaugggguuucaccauguuggccagacuggucuggaacuccugaccucaagugguccucccgccuuagcuucccaaagugcugggauuacaggugugagccaccgugcccggccccacuuggcucauuuucaaccuagaagcaggcuuugguagcauauaagggggcaguuaaacuuggaccccaggucaguguguccagguuccuuucuuuuguacgcauccucacuaguaauuacuggacacuuccuaacuagcuuagauguguacgucuuuaaauuuugucuuagcugggggugugguggcucaugccuguaaucccugcacuuuggguggccaagguggcuggaucaccugaggucaggaguucgagaccacccugcccaacauggcaaaacccugucucuacugaaaauacaaaaaauuugccagacgugguggcgggugucuguaauuccagccugggcaacaagaguaagacacugucucaaaaaaaaaaaaauguuguuuucgaccaaguugcagcauuagaucccaaaacauggcuaugagugugacagguugcagaugacaagugcuacaaauacuuacuccuucuaagaccuuauaugccugguuaaacauuuauucucagacucuugcccaguuuuaggcaaaggaacucuaauggaaauuuuuuuuuuuuuuuuuuuuuuuugagauggagucuuguugucucccaggcugaagugcaguggcgcaaucucggcucacugcaagcucugccucccagguucaugccauucuuuugccucagccucccgaguagcugggacuacaggcgcccgccaccaugcccggcuaauuuuuuuuguauuuuuuaguagagacgggauuucaccauauuagccaggaugauuucgaucuccugaccucaugauccgcccgccucggccucccaaagugcugggauuacaggcgugagccaccgcgcccagccucuucuggaauuuuuuaaaaaacaaacaauaggauaguacuugagcucaggucugguucucagcuacuucauuuuuauuuuguuuuauuuuauuauuauuuuugagagagaaucucgcucuguugcccaguggcacgaucucggcucacugcaagcuccaccucccagguucaugccauucuccugccucagccucccaaguagcugggacuacaggcgcacaccacgccuggauaauuuuuuguauuuuuaguaggaugggguuucacuguguuagccaggauggucucaauaucccgaccucgugauccaccugccucggccucccaaaguguugggauuacaggcgugagccaccaugcccagccuuauuuuauuuucuuuuaauuuuuauuuuauuuuuugagauggaggcaugcgccaccacgcccaguuaauuuuuguauuuuuaguagagacaggguuucaccauguuggccaagguggucucgaacuccugaccucaggugauccaccugccuuggccucccaaagugcugagauuacagguguaagccaccucaccuggcccuuuauuuuauuuuuuuuugagauggagucuuacucuguugccaggcuggagugcaguggcacaaucucggcucaccacaaccuccaccuccuggguucaagugauuuuuuugccucagccuccugaggagcugggacuacaggcacgugccaccacgcccagcuaauuuuuguauuuuuaauagagacgggguuucaccauguuggccaggauggucucgaucucuugaccuugugaucugcccgucuugccucccaaagugcugggauuacaggcaugagccacugcaccuggccuauuucuuuuuuuucuuucuuucuuuucuuuuuuuuuuuuuuuuaagagacagggucuugcucugucgccaaggcuguguacaguggcgcgaucuuggcucacggcaacccccaucuccuggguucaagugauucuugugccucagccucuugaauagcugggauuauagguguguaccaccacgcccagcuaauuuuuuuguauuuuuaguagagauggggguuugccauguuguccaggcuguucucgaauaccugagcuuggauuauuuucccaccucagccucucaaaguuuugguauuauagaugugagccacugugccuggcccacuucaucuuuugauauuuuaacaagaggcucuguuuccuggccuucuuuagcauuuggccccucaaauaacugacaugauauggcucaacaaacuggcaggugcuaacugccaacauuagcaagcugguuguugacuagaauaaaaaugcaaagaugcuuaguccuuagaaccuggcuuccugcaauagcuuaguaauguugaacugcauuauugcugugggcuuucuauugauaguggcuuuuuuuuuucuuuuuaaugcuuuuucuucuuuaaacagcugaaccuucaccuagccccaggauuacaaggaaaagcaccaggcaaaccaccaucacaucucauuuugcaaaggggucaguauacgauaaauuggcggcugccuuuuuuaggggccggcuguuuugggauggaauugguagggcgucacguggcaauucugucuuccguguuguauagguuuucaucuugcgguucuguucucuagacauuuaugaauagcauuucugaaaacguuaccuguuuuuacucauauaggaaaguucaaauguacacaaaaucaugaguuuuguauaaugaacccugaaauacccaucaucuagugccaacaguuaucaaguuacagccguuguuucaucuauacccccauauugugugucccugccccaccuggauuacuuuguccauauauaguuuaguauauuucuagacaaugagaucucuuuugacaacuuuuuaaaaaauuacucauauuuuacaauaauugcuaacauuuagcagucuuuuuuuuuugagacagcaucuggcugucacccaggcuggagugcaguggcacgaucucggcucacugcaaccucugccucccggguucaagugauucuccugccucagccuccugaguaucugggauuacaggcgcgcgccgccacgccuggcuaauuuuuguauuuuuaguagaggugggguuucacuauguuggccagacuggucucaaacuccugaccucaggugaucugcccacuucaaccucccaaagugcugggguuacaggcgugagccaccgugcccagccaaaacagucuuuuuaacaaaccaaaguauaauacuguucugaugucuuuauaaaaauguaagaauucccugcuaucagauauauaguugguauuuacguuuuucccuuuguggugaacaagccguguggcaaacagacagcguuugguugacuuguuccuuaaaguuauagauuccuucccuccuauuuuacuuaaaauuccucacagauuuuaaauuccuucaucucuuaucuucuugccauuuacuugaagaaauucauuuguccaauaguuccuagauugggccgauugcauccuugugguguuccacagguccccuugccuucuguucccuauaaacugauaggauuacaggacugaucagauuccagcuuuuuauuuuuugagacugacuuuuuuuuuuuuuugauacggagucuugcucuguagcccaggcuggagugcaguggcaugauuucggcucacugcaaccuccaccucccagguucaagcgauucuccugccucagccuccugaguagcugggauuacaagugcccgccacaaccccuggcuaauguuuguauuuuugguagagacaggguuuuaccacguuggccaggcuggucugaaacuccugaacucaggugauccucaugccuuggacucccaaagugcugggauuauaggcgugagccacugcaccuggucugaggcugacuuuauggauggugcugugucccuccaucagaaaggugugugaggucucuucucugacacuagcagcuguugaucgguguuuagacccgugauuucuuaggacuuacaagauggcaagacaacauucuaaacccgucauucagagaaacauuaaacuugaagccucuuucaacauccuggugaaugaggguccacuucaggccagcuggaggccuagggucuuguuccacuaaugguuggccucacugugugugacagcccugccaaacggaaaccucaggaagagucugaaagagccaaaucggaugaguccaucaaggaagaagacaaagaccagguagggccagugcuuucauuuccugacucuaccuuaacuugguguauuugaugauugugacuucauauguguucuguccaaguaaauaaaaacccugucuagggcucuauuuagggcucuccagagagacaggaccaauagaauguauauguguguauacagcuauagguacauauauacauaugcacguguauguauauauauauaauucguuugauuuuuuucuuguuuuuauggguacauaguuggaauauauauuuauggggagagacuuuauuuugagaaauuggcucacaagauugugaaagccagcaaauuugaaaucugcagggcaggcuggagguccaggggagaaaugaugucauagcucaaguggcaaggcagucuuacauacauacauguuauauauauguguguguguguguguguguguguguguguguguguguguguguauguauguauguauuuagacuucuuuuuuugagacuuuuuuuuuuuuuugagacaggguuuugcucuuguggcacaaucuugguucauugcaaccucagccucccggguucaagugauucuccugcuucagccucccgaguagcugggacuacaggcgcgugccaccacgcccggcuaauuuuuguauuuuaguagggaugggguuucaccauguugcccaggcuggucucccauguugcccaggcuggucucgaacuccuugagcuuaggcaaucugcccgccucagccucccaaagugccaggauuauaggugugagccaccgugcccagccaauuuguuuuuuuuguuguuguuguuguuguuuuuaauuuuuuuuagauggagucucacucuuucacucaggauggagugcaguggcacgaucucagcucacugcaaccuccgccuccuggguucaagugacucuccauccucagcuuccugaguagcugagacuacaaggcaugugccaucauacccagcuaauuuuuauauuuuuaguagagaugggauuucacuguguuggccaggcuggucuugaacuccugaccucaagugauccacccgcuucagccucccaaaguguugggauuacaguucugucuuuuuucuuuucuuuucuuuucuuugagacaggucucauucugucaccaggcuggggugcaguggcgcagucauggcucacugcagccucaaccuccugggcuuaagcgauccucccaccucacccucccaagcagcugggacuacaggcgcaugccaaugagcuaaguuuuguauuuuuuguagagaugagguuucccauguugcccagacuggucucuaacaaauaaauuaaacaaauuccugacacaagauggagaaucuuugauucuuuuacauaguaucaccaggcgaucucuagugaugggcagugugccugccuacuucucggaccugcuuuuguuuugggguugguggggauuaauaccagaguaagaguuucucagaucuucuccccaaaacccaggccccuucuuuucccacucuugcucuaaccaugucaaauguguuaauauuucaacucacacuuuugguguugaccuucccuugaaaccaguauucuaaucuuuuuuguucuuccuucccuccacacaggaugagaagagacguagaguuacauccagagaacgguaagaauaguuacuauaccuuucuuuuuguucuacgaguuguguaaucuugaucacaaaacuuuuucagaaaguuuaaggccgggcacggugacucaugccuguaaucucagcacuuugggaggccaagaugggcgaaucacuugaggucaggaguucaagaccagccugaccaacauggcgaaaccccgucucuacuaaaaauucaaaacuuagcugggcgugguggaaugugccuuuaaucccagcuacucaggaggcugagucagaaggauugcuugaacccaggagguagaggcugcagugaucugagaucauuccacugcacuccagccugagugacagagcaagacuccaucucaaaaaaaaaaaaaaaaguuuaaaaagaagaacuuuaucguguguuuccauggcaaccauaucguuaugaaguaucugaauuuggggucagaucauuagcguuuagauucaaguagaauucuccuguuuucuuggaaggaaugaaucgagggcagcuggcauucgaaccagguguaaaagucauaucaaauacuaaauguuaaaugaguaugugucugucagggcuccugagauaaugaagauugcuuuugggggaaagaggagcuuuaugaaaacugcuucuuuggggaagcuccuggcacucacacuuggggucuguguuauuuugcuugacagaguugcuagaccgcuuccugcagaagaaccugaaagagcaaaaucaggaacgcgcacugaaaaggaagaagaaagagaugaaaaaguaaagcucuaucaccucuaaguuuguuaauucucccuuaauccuauauggucccaauuuccuuccaggacguggggacaggggguggggaacguggaagaacaagauggguuuugcuagugaucgaaaugccuuugacuuuggcuaaacaccuuucaaacuuguuuucucguggucucuacaugaaagguggguuaugagauugugauagugaggacccuugcuacuuauuugugauauuuuauuuuauuuuauuuauuuauuuauuuuugagacagucucccacucugucacccaggcuggaaugaguacagaggugcgaucucggcucguugcaaccucugccucccagguucaagugauucucaugucccagccucuugagucacugggacuacaggcgcccgccgccauacucggcuaauuuuaguggagaugggguuucacuguguuggccaggcugaucuugaacuccugaccucgagugauccaccugccucagccaccaaagugcuaggauuacaggcaugagccaccacaccggccaaccuaugccacuuaaucaacuagucacagagcuucaguuugucaccucgccuucuugcuucucuggcugaugagaucuuugugaagaucuaauuuucagacguacgaggugcuaaaacuuuuuuuuuuuuuuuuuuugagauggagucuugcucuguugcccaggcuggaaugcaguggugugaucuugucucaccgcaaccucugccucccggguucuugugccucagccuccugaguagcugggauuacaggugccugccaccacagccagauaauuuuguauuuuuaguaaagaugggguuucuccauguugaucaggcuggucuugaacucccaaucucaggugauccaccugccuuggccucccaaagugcugggauuauaggcgugagccaccacacccggccuaaaauacuuuucaaacuuauuuuuuuguaguucucuacauggaagguggguuaugagguugucauagcgaggaucuuugcuacuuauuugugguauuuauuuaauuuaauuuaauuuuuuuuuuuugagacagucucccgcucuaucacccaggcuggagugcagaggugcgaucuuggcucauugcaaccuccgccucccagguucaaguaauucucaugucccagccucccaacuagcuggggcuacaggcgccugccaccacaccuggcuaauuuuuguguuuuuauuuauuuauuuauuuauuuauuuauuuauuuauuuauuugagacggagucucgcucugucgcccaggcugaagugcaguggcuugaucuccgcucacugcaagcuccaccuccuggguucacaccauucuccugccucagccucccgaguagcugggaccacaggcgccugccaccaugcccggcuaauuuuuuguauuuuuaguagagaagggguuucaccacguuagccaggauggucuugaucuccugaccucgugauccucccaucucggccucccaaagugcugggauuacaggcgugaaccaccgcgccuagccaauuuuuguguuuuuaguagagacgggguuucaccauguuggccaggcuggucucaaacugcugaccucgaacgguccaccugccucagccaucaaagugcugggauuacaggcacgagccaccacaccggccaaccuaugcuacuuaaaucaacuagucaguuucagucugucaccucagccaccuucucuggcugacgagaucuuggugaagaucuaauuuucagauguaggaggugcuaaaauucuuuagcaucauccagacauaaaguuguauucuccucucugaagucagaccagcucuuuccccagucccucaucuucuuuguaaaaucugagucuaagguucuaugcaauacagaugcuggguccuguuuuuuuuucuguuuguuuuguuuuuuaauaagaugacugagggccgggugugguggcucaugccuguaauucuagcauuuugggaggccgagguggguggaucgcuugagcucaggaguucagggccagccugggcaauguagugagaccccgucucugcaaaaaauacaaaaaucagcuggaugugguggagcuuacaacaggcagugugccuguaguuccagcuucucaggaggcugaggcaggaagaucacuugagcucaggaggcugaggauacagugagccaugauugucccacugcaauccagccuggaugauaaagugagacuggucuuaaaacaaacaaacaaacaaacaaaacaaacaaacaaaaaaaaaccaagaugacuagaaguuucuuaccaacuuagguaggugacgagugccuuacuugggagcuuaguaaaggauggcuguccauuggggaaucaacuaaaauguacaguaauuuuuuuuguuuuuugagacggaguuuuguucuacuugcccaggcugcagugcaguggugugaucucggcucacugcaaccucugucuccugcguucaaacaaauucuccugccuuagccucccgaguagcugggauuacaggcuuccgcuaccacgcccagcuaauuaacuuuuuguacuuuuaguagagacagggguucaccauguuggcuaggcuggucucgaacuccugaccccaggugauccacccgccucggccucccaaagugcugggauuacaggcgugagccacugcauccggccgcuguacaauaauuuuugaaccauucaguacuugagguuggucuuucuugcuuuuuuucuuuuuuuuuaauugagauggaauuuugcucuuucgcucaggcuggagugaaguggcgcaauuuuagcucacuacaaccuccacccccuggguuccagcgauucuccugccucagccucuccaguagcugggauuauaggcgcccgccaccccguccgccuaauuuuuguauuuuuaguagagacaggguuuugccguguuggccagguuggucuggaacuccugaccucaggugauccacccaccucagccucccaaaguccaggauuacaggggugaaacaccacgcccggccgaggcuggucuuucauugaucaccuuuccuacccugauccuaguuaaauuagacagcaguugcagucagugcauaccucgaauuuguuucagaacaagcaguccuaacgggcuaguucaaccaccaccuuccaaagaaggaaccuggggcaagaucgaaaucccucaccuguaagcauacucucaggauuucuucuuguaguaggaagauuugcuaagcguuuuuuuuauuuuuauuugagacggagucucacucugucgcccaggcuggagugcaguggugcgaucuccgcucacuucaagcuccgcuucccagguucacgccauucuccugccucagccucccgaguaacugggacuacaggcaccugcuaccacgccaggcuaauuuuuuuuuguauuuuuaguagagacgggguuauuuauuuauuuacuuauuuauuuuuugagacggaaucucgcucuugucgcccaggcuggagugcaguggcacgaucucgguucacugcaagcucugccucccaaguucacgccauucuccugccuccaccuccccaguagcugggacugcaggcgcccgccaacacgcccggcuaauuuuuuuuuuuuuuuuuuuuuguauuuuuaguagagacgggguuucacuguguuagccaggauggucucgaucuccugaccucgugaucugcccaucucggccucccaaagugcugggauuacaguagugagccacugugcccagcugcaaaguguuucuuaauauuccugaccuuugcgaucucuucacagacuaccacauguggaguuucugaggguuggauuugacuugccugauucucuggcaagaugugucugguucuuuaaaugcagccucaggcugggcaugguggcucacgccuguaaugccagcacuuugggagaccaaggcagacggaucacuugaauucaagaccagucuggccaacgugaugaaacccugucucuacuaaaaauacaaaaauuagcuggucaugguggugugugccuguaaacucagcuacuugggaggcugaagcaggagaauuguuugaaccugggaguuggagguuacagugagccaagaguacaccacugcacuccagccuggguaacagagugagacuccgucucauaaauaaauaaaugaauaaaugcagucucagaggauguguuguugugucucaguuggagcuacuuuucagauugggccauccuauuucauuccuuuaauaucggaaguagagauuuauaauaaaguuacuuucugugaggcuaucaacacuuaacugaugacaaguaguagaggaauuuugaaguaaaaauacugaaacugcaguguuguaguaucuccuuucuaagaguuucauuuccugucuacuuaccccacugaagaagaaaagaaaauugcugucuugaacaccuggcacaagugauccucucaccucagccuuccaaaguucugagauuacaggcaugagcuacugugcccacugguagacagucuuuacucccaccaguggacucuagaaucaguucagguguuuuauuuccauaggacacuuuaauagaaagauccaaaccaaauggaaaaaauuaacuugucuuuuuucccugcaacuuaggaagaaaagagacuccgaagucaaaccaaagaaccguaagugcagcgaaccugccuuugugcuuuguugugaaacugaauugcuaacauaaguaucuugguaaaauaacggguugguguggaacagugggcacuaaucauaugucucuuaugugggcaaguucugcuugugaaaggugagaccacccugaagugaaggcugaaguuaacuuuuuuaacuuuaauuuaauuuaauuuaauuuugagacggagucuugcugugucacccaggcuggaguacaguggugcaauccuggcucacugcaacccccaccucccgggcucaagcaauucuccugucucagccucccgaguagcugggaguaugggccuguaccaccaugcccaacuaauuuucguauuuuuaguagagacaggguuucaccauauuggucaggcuggucuugaacuccugaccuccgugacccaccugccucgccucccaaagugcugggauuacggggugaaguuagcuucgauuucuccucccaaccccagggcccuucucaggguuggucacacagcugugugucaugugguagugaaaggccaucaggugagcagcugugucacuuaccuuucacugugaaaaugcugugugacaaauggcuccaaggccagaggccuagaacagugagcauuuuucaagcucacuugucuacagcuugguggcugucggcugaucuugagguggcuuaguggggauggcugggcugacccagcucugccuccgcaauuuggccaggcuggguacacgcuuguggcugugccagaccacaagggcagaaaugaaaaguagcacuuuuucaaaccucuguugaaaaaaguugggccaggugcaguagcucgcgccuauaaucucagcacuuugagaggcugaggcggguggaucacuugaggucaggaguucaagaucagccuggccaacauggugaaaccccgucucuaauaaaaauacaaaaaauuagcugggugugguggugcaugccuguggucccagcuacuugggagacugaggcaggagaaucacuugaacccgggaggcggugguugcagugagcugagaucacaucacugcacuccaggguaggugauagagcgagacucugccucaagaaaaaaaaaaaggaaaaaagaaaaagaaaacaauuagcugaagcaaauuuugagacugagccugaauccagaggugggcagaauaccccaccugagcggcagggcccuggcagagugggaggugaagacucggaccccugugugcagucagcuguccacggucacugacugacgcugaucgcacaucagcccagcucucaaccuaggcaggccagacaugggucuuccuccaccgcaggcuggauucccaucaggccacggaaaucaugacaucccuuugucugcuuuuuguauuaaaccacuggcaucucugaccaacauucagaugggguauugaugguguuccugaagaccuugaguccuggaguaguaaaugcccucugggcuuccugcagugaagacaggagaggcagccuguccucugaaccuggggaggagcuugugucagcccuuaggagcuguuggccccggugcagggccccccccgagcugaccagccuguguguguguugucuucugugacagaacacccaaacagaaacugaaggaggagccggacagagaagccagggcaggcgugcaggcugacgaggacgaagauggagacgagaaaguaaaggcggguuauuuguuucugaacucccccucauucuucugcuccuguuugcuugggcgggagugcgcaggguggggcucuggguucaaguccagccccauccacccaggcuccauggggccauccagacucugggaaggucaccuuuuccuccuuuugggggccgggauuuguggcuggaugccugugcuggaugccuagugaacacucaguuguccucugucuuucacacuagagagggucugugugagccugggcugagaugugcaugaagcauccucuccugaggccucacugcugagaagccuugacacacagucagcucugacgcacaugucagccacaccuuugauucuuucccagccuccuacguucugagucuagcucucccccugccagccuccccagucuaguuuagccaagugcaugcguuuaaacccuaaagcaucauguggaacacugcugggccucugucaaaguacaggauggccagguugccugcaggcccuccugcaugaacucuagggaagggagcuaggucaucgguggggggcggcgggucccuaucuaagagaugccgaagaccccaagagggucucuggguuucugccuguuacaaucuagagaguggagcccaaggucacgggcuugcugggugacaagcacccucacuucugacccggucgccagugggcuuccauccccaccccauagcaggggagccuuugguauugccuccagccucccaucccucaccucuucuguccaaauguuggucaccuuacugucagcacuccuucagacuggaguagucacauuacucccugcccucuauuggaaacuggcaggggccugagcucacacugccagcacuuuugccucaugguagaaagggaugugagggcugggcaugguggcucacuacuguaaucccagcacuuugggaggcugagguggguggaucacuugaggucaggagucugagaccagccaggccaacauggugaaauccggugucaccuaaaaauauaaaaauuagccgggcaugguggcaugugccucuaaucccagcuacuugggaggcugagguaggagaaucacuugaacccaggaggcagagguugcagugagccaagauuaugccgcugcacuccagccugggcaacagagcgagacucugucucaaaaaaauaauaugguaauaauaauaaaagcagugcccagagaacaaggauuguuggcuguuccaccccagggggccccuugcacaggaggugccaucucugccucccaaagcucuaagagccacugucccccaucccaagagacagggucuugcuuugucacccaggcuggaaugcaguggugcaaucacgguucacuguagccucgaccucccaggcucaggugaucuucccgccucagccucccaaguagcugggacuauaggcaggcaccaccauguccagcuaauuuuuuuuuuuaauuuuuuguagagauaggguuuugccauguugcccaggcuggucucagucaaacuccuagacucgaguuauccaccuaucucagucccccaaaguggcggagugguaggauuacaggcaugaaccguugcauucagucuguuugguuuguucuuuuuuuuuuuuuuuuuuuuuuuuuuuuuuuuuuuuuuuuuuuuaagauagucucucucugucaugcaauggugugaucucgagucacugcaaccuccaccucccagguucaagugauucuccugucucagccuccugaguagcugggauuacaggcgugugcuacuaugccuagcuaauuuuuauauuuuuaguagagacagggauucaccauguuggccaggcuggucucuaacuccugaucucaaacaauccaccugccucagccucccaaggugcugggauuaugugugugaggcaccacgcccggcguguuuguuuguuuguuuguuuguuuguuuuugagacaggaucuugcucuguuucccaggcuagagugcaggagugcaguggugcuaucauagcucacugcagucuccuggguucaagugauccucccaccucagccucccaaguagcuggcacuacaggcaugcaccaccauggaugucuacuuuuuaaacuuauuuuuuguaagccaggcgcggugucucacgccuauaaucccagcauuuugggacacugaggugggcggaucaccugaagucaggaguuugaaaucagccugaccaacauggugaaaccccagcucuacuaaaaauacagaauuagcugggugugguggcgaaugccuguaaucccagcuacuagagaggccgaggcaggagaaucguuugaaccugagaggcagaggugagccaagaucauaccauugcacuccagccugggcaacaagagugaaucaaucucucucucucucuccauauauauguauauauuaaccauauauauaugcugcuuuuuguauuaaaccacuggcaucucugaccaacauucagaugggguauugaugguguuccugaagaccuugaguccuggaguaguaaaugcccucugggcuuccugcagugaagacaggagaggcagccuguccucugaaccuggggaggagcuugugucagcccuuaggagcuguuggccccggugcagggccccccgagcugaccagccugugucauauauauauauaguauauuuugcagagauggggucucagcauguugcccaggcuggccucgaacuccuggcaucaagcaauccuccugccuuagcuucccaaagugcuggguuuacaggcacaugccacugcacacagccuguaaauaaaguuuuauuggaacagagccacacuuucucauuuacauuuugccugugggugcuuuugugcuaccauagcagagaugaucauccugacacagaccacguggucagcaaagcugaaaauacugauccucuggcucuuacaaaaacaguuugccaagcccuggucuaggagguucuuuagugcccucuuguuaguuucagguggggaauuaagugagggaaagugaagccucgugucuacccgguagaucugcccaggccugccugucuuccagcuccacagugcugggaucccuaaccuguaacuucaguguuugcauuuuaucucacucuggcucagaaacuaauuuuuucccuucuuuaucucucuaccucccccuuauuuuucugucaggaugagaagaagcacagaagucaacccaaagaucuguaaguguuuaaaaugcuugugcuuuugugucaucuggaucaguagaaagccuguucuaggccaggugugguggcuugcaccuguaaucccagcacuuugggaggcugaggugggugaaucaccugaggucaggaguucgagaccagccuagccuggccaacaugguggaacccugucuguacuaaaaauacaaaaauuagcugggugugguggcgggugccuauaaucccagcuacucggaaggcugaggcagaacugcuagaagccaggagguggagguugcagugagccaagauugcgccacugcacuccagccuggacaagagugaaacucugucucaaaaaaaaaaaaaaaaaaaagccuguucuagaaaccuguggugauguagauguguggggacccuggggccucugaaggccucgucucgggaugacaagcuggcagugugccuauagagcucccauggguaucuugcuuucccauggggaggcauuaguuugucacuuuccgugcgaguuggcgaugugguuaguguuucuaagcugcuacuugcuguguaucuguucacccugcagagcugccaaacggaggcccgaagaaaaagaaccugaaaaaguaaauccacagauuucugaugaaaaagacgaggaugaaaagguaaaggucucacuuuucuuucuuucuuuuuuuuuuuuuuuuuuuuccccaagacgggguuucgccauguugcccaggcuggucuuaggaaaaagaagacugggcgugguggcgcacgccuguaaucccagcacuuugagaggcugaagcgggugaaucacaugaggucaggaguucaagaccagccugaccaauauggugaaacccugucucuacuaaaaauacaaaaauuaucugggcaugguggugcacgcccguagucccagcuacucgagaggcugagauaggagaaucgcuugagccugggagguggagguugcagugagccgagaucgcacuccaggcuggggacacagcaaaauuagcugggcgugguggcauaugccuguagucccagcugcuuggaagccugaggcaugagaauugcuugaacccaggaggcggagauugcugugagcugagaucgugccacuguacuccugccuggacaacagagcaagacucugucucaaaaaaaaaaaaaaaugcugggcacagcggcucacgccugucuuuucagcacuuugggaggccaaggcaggcgcaucaccugaggucaggaguuugaaaccagccuggacaacauggugaaacccugucucuacuaaaaauacaaaaauuagccaguuguggugauaggggccuguaaucccagcugcuugggaagcugaggcaggagagucacuugaacccaggagguagagguugcagugagccgagaucacaccauugcacuccaggcuggggacacagcaagacucugucucaaaaccaacaacaaaaaauacaaggacauuggucuuauuggauggggccccaccuuuauuaccucauuuaaccauaauugucucuuaaagacucuacauccaaauacagucacauagcagguuagucuuaacauaugaauuuugcaggggacaugacucggucuguauacccccucaucaauuguuugcuuaccuuuacauuuuaguauuuauuuuugagacagggucucacucuugucgaggcuggagugcagugguacagucauagcuaccauagccgcaaacuccugggcugaagcaauccucccaccugggccuucaagguagcugggacuacaggcagauggcacuacacccaguuaacuuucuauuuuuguagagacaggguuuuacuguguugcccaggcuggucuugagcuccugugcucaagcaguccucccaccugggcuucuucaagugcuggaauuacaggcaugggccacugugccuggccaguuauuuauuuauuuauuuauuuauuuauuuauuuauuuauuuacuuauguauuuguuuuuugagacagagucucgcucugccgccaggcuggaguacaguggugcgacaucggcucacugcaaccucugucucccugguucaagcuauucuccugccucagccuccugaguagcugggacuacaggcaugcgccaccgcgcccaacuaauuuuuguauuuuuaguagagacaggguuucaccaucuuggcgaggauggucucaaucucuugaucucgugauccauccgccucggucucccaaagugcugggauuacaggcgugagccaucgcgcccggcccugugccuggccaauuauuuguuuaccuugagguguccacuuacacaggaaagcuaagguuuuaaaaaauuggcuuuuccucuaaaucuuuucaggaagucuuugguuaugagauuuauuuauucauuuauuuugagauggagucucacucacucugucgcccaggcuggaaugcaguggcaugaucucugcuuacugcaaccucuacgucucggguucaagcaauucuucugccucagccuucugaguaucugagauuacaagugcccgccuggcuaaucuuuguauuuuugguagagacgugauuucgccauguuggccaggcuggucuggaacuccugaccuccagucaucugugugccuuggccucccaaagugcugggauuacaggcaugagccacugugcugggccugacuauaagauuuuguauucuaugacuuuagaugguagagugagucagagcucaccugcuggcccucucacugccucccuccccuucucucuguuuuaugauaaucacuuauacaaaguucuuaacaccgaagcacuaucuggguguaaaacacucucuuagccuuuaauccucuuuuguuuucccuguguaggaggagaagagacgcaaaacgacccccaaagaaccguaagaauuuauucuugacauuaucgaaagcagaugguaauguuaaaaugaugguucuagaacaaaagggaagggguuucaguaauugccagagcaaccuuaggcucauuuuggaucggguuggugaacauaggaccaaggugcgucaggcaggaugccccugcggugaagagccacugugaccacgcgccugggccucacugccacagccggugccucccugugccacaggcaccucaggcagaaaccucacaggggcgauuuugauauuuucugaaacaauuaaacaaacgaucuugugauuuuuuuuuuucccccagaacggagaaaaaaauggcucgcgccaaaacagucaugaacuccaagguaaacaucugccgggaauaaagccgguggcggcgcucacgaggcggcugggagcugcucucugagugccaucaucuguguuccugcucccacagacccacccucccaagugcauucagugcgggcaguaccuggacgacccugaccucaaauaugggcagcacccaccagacgcgguacguacagcucucuucccagccuuccucugccugucccuugucccacugcucaccagccccguguccuucagguggaugagccacagaugcugacaaaugagaagcuguccaucuuugaugccaacgagucuggcuuugagaguuaugaggcgcuuccccagcacaaacugaccugcuucagguaagugcacuuucgugugcauguuugcuucguggaaggaggcacauccccagaggugccugcgggcucacgauucuggugauguuuuuuagugccugaccugcaacaugucuuaagcuaacacuucguggauaagagccaccguggagggcugggcgcgguggcucaugccuguaauccuagcacuuugggaggccgaggugagcagaucacuucaggucaggaguucgagaccagccuggccaacauggcgaaaccuaccgaaaauacaaaaaguagccagguguggugguacgcgacuguaaucccaacuacucgagaggcuuaggcaggagaauuucuugaacucuggaggcggaggcugcagugagccgagguggugccacugcauuccagccugggcgacagagcaagacuccgucucaaagagccacguggaaagcugaugaagggacaauagagcuuugcugauuuuugguuugguuuuuggguuuuuacacuacacauauuaccccuccauucugcccacauccugagggucacacgcucagaugaaggccuacucugugcuagguaccagugaucuaggugucguggauguagcugcucagguccugccuucacggagccagaaaugggugauaccugucggguagugacagccacgacagauuuuaaaagccuggugacaugcagagagaauaagugggaggaggaaguucugugaagacgggagagguaaugauuuucaguaaagaccuugauggccugugagagaagaggccgaggggauggccgggguggggcacccuagguagaaggggacaccauuaccagggcucggaggggccugugccagcuguggaaggugaauggugagucugguguggugguugcuggguuggggcugggccacacagggccuugcaggccucagcacugacucuccuguccucugagggaaggugccuggcguccggcccguaccuucaccgaggcucacgucagcucuugagugggcagaggcccugugcucucaggcauccccagccccauuuugcucccucucccugcgggugcaguuacccuccagggcuucaccuuguucuucgugggaaaugccucagcuccaggaacggcccugccuccuuuuaggccugggugguauuuucccucucugugaagaggagggggaagugccuuggggaccccuguuggaagcacccccaggcagcgguuccuguacccacugggagggcacccacacguuccccgugcuuggcugaugguuguuccccucccucuccuucuaugggauccuucuaucuagaucaagaugcuguugcguccaccagcaaccgcuagccccccgaggccuggcccaaagcagggccacacaccucugccugcuggugugagugaggugugcuguggugggcagagcuggcaaccaugcccgagggccucacucuggccuucaccagggacaaaggcuugggggagccuggggcuggggcugccagaguccugagugucucagcuuccucccuaaguugagaucuaucauagauucguuccuggaggguggaugguggccuggaggacacuuuccagaagucacaugccuucuguccacuggagcuggacugccugaguuauuuaggggcucuccauacugcuguacuuggcuugaaacuggcgauagaagccagucauggguggggucuggccuaccaaccaguggguccugccccugccuggggcuuagagcuucucucccaugucuccccuauggagagagccuccagcccaccugugcagcggggagcgggacccccucuucuguaggcccucccuugauccacgcuggcuucaucucucugucucuucuucugggccuuacauccugaggcagggcugcaaccuauucugucugccaugccugguacgcaguaggggagcuccgcaggagguaugcaguguuuuguuugagccuuucuggcuuccaaggcacuaagcugggugagugugguggagggugcucuccagagaccugugcagacuucauaugggggcucugaggauagcccagcaucuuuggccgggaaagggugguccuugucuagaugagcagguuuguaagcagaacacccaguucaugucuuuuuccuugaguuugacaucuugccucucugucuucacuaaagaacgugcucccgaaugucaaggggcaucuggacaguggggccgcagguguuugagauuuaugcccaaaaggaggcagaaguccuuccuucccacaucccuuuucacacuguucuauaaccugcuuuauuuucuaaauugaggucuaacucguauaauauaaaauuaaccauaugagguaucuugaauaggugaauucauagguauagaaagcagauuggugguugccgggggcugggggcugagggccgguugggaggagacuggagagugacugcuacuugaugggaaugaggcuuuauuaacauuugagugacagaaauguucugcagcugaauagagcuaguggcugcacugcauaguagaagguguucuagaaaccgguauuucccgcacuguaagucugacugaucuuuugguguugcuguugcagacacacauacacuugaugcuuaggugggagaauaagguagaaacucugggugauagaacgcugucuuaauccaguguucccgcaaccaaaaaaugagugucggggccaggcauggugguucagccuguaaucccagcacuuugggaggcugagguggguagaucacuggagauaaagaguuugagaccagccugcuacacauagugaaaccccgucccuacuaaaaauacaacaauuagccgggcauggugguucaggccuguaaucccagcuacucgggaggcugaggcaggagaauuacuugaacccgggagguggaggcugcagugagccaagauuaugccaucgcgcuccagccugagggauagagcaagacucugucucaaaaacaaacaaaaaaagagugucagacuuguacauucucucauugccucgugccugaucugaagucugcacgaagacccgccuucacggcuuagcugguaagcaugugcuuuguuuccugucuaguguguacuguaagcacggucaccugugucccaucgacaccggccucaucgagaagaauaucgaacucuucuuuucugguucagcaaaaccaaucuaugaugaugacccaucucuugaagguaaggaauaguccgggauuauguuuggggcacacuuuaaaaacagccaggcaggguggcucacaucuguaauccuagcacuuugggggucugaggccagaggaucacuugagcccgggaguuugagacgagccuggacaacauagcaagagccugccucuauuaaaaaaaaauauauagcauauauauauaguauacauauauacuuauauauauguauaaauaaaaaacauacuuaugaagcaauagucagcuggaguugcugcugccucuuaaaguuagggugugagacuuugugccaggagcagcuguaggccaagucauugugaugacugaggagcacccgaccuggcugaugggaugucugcugagugggcgcuuagagcgccuccuggguuugggaugugagucagagccuuuaguccauuuccuuuuucugcucuaggugguguuaauggcaaaaaucuuggccccauaaaugaaugguggaucacuggcuuugauggaggugaaaaggcccucaucggcuucagcaccuguaaguguguggcccaucauaggcuggccggggucugaaaggggccuucauguucuccuuccugggggcugacggggcucuggugggaauucucagcaggcuugcagaaggccaugugacugggaaccuuagcagguucaguugggguagccucuuguguuaguuaugacuggcucuggaacugacucuccaguuguaagagcaggucuuggccggauaugguggcucacaccuguaaucccagcacuuugggaggccgaguuggggggaucauuugaggccaggaauucgagaccagccuagccuggccaacauggugaaacccccucucuaccaaaaauacaaaaauuagccacgcaugguggugcauaccuguaaucccagcuacuugggaggcuauggcaggagaaucacgugaacccagcagacagagguugcagugagccgagaucacgccacugcccuccagccugggugacggagcaagacucuguccuccccugaaaaaaaaaaaagagcaggucuuauucuugcaacccaaacccagacugaauuccaaacaccagagaugagcucaaugaaggccuacucagcuagucuucgcucucuggcuggcucagacaggcuucuucagaacaagccagcuaugauguguugugcccuauguuucugacauuuggguacgggaugacuuuuagacuguugggugaguuugguagacuccuccaugcccuguggccacuguaggcgccaucagauuccagccccuuuuccacaccuccucuguucaccccagcauuugccgaauacauucugauggaucccagucccgaguaugcgcccauauuugggcugaugcaggagaagaucuacaucagcaagauugugguggaguuccugcagagcaauuccgacucgaccuaugaggaccugaucaacaagaucgagguaagagaucgaggguccucagcauccgggauucccacuggaaacuugccuucagaaccagcagacacuguucuucaguuggauuuaggccaguuuggcuuaagcaugagagaaaccuguucucuuucaagaccacgguuccuccuucuggccucaacuugaaccgcuucacagaggacucccuccugcgacacgcgcaguuugugguggagcagguggagaguuaugacgaggccggggacagugaugagcagcccaucuuccugacacccugcaugcgggaccugaucaagcuggcuggggucacgcugggacagagguaaggaugcggcagggaccagagugaagacuggagaccggggaggguagagcauggcccacauccucugucccaguccucugagaugcuggaaccucucccguaggcgagcccaggcgaggcggcagaccaucaggcauucuaccagggagaaggacaggggacccacgaaagccaccaccaccaagcuggucuaccagaucuucgauacuuucuucgcagagcaaauugaaaaggaugacagagaagacaaggagaacgccuuuaagcgccggcgauguggcgucugugagguaaccucaccugugggugcucccgcuccccuaagguggcccagccucuggccugaucugaggacugcuccaucuuucucucuguggcuugagacucuggcugcucaaaugugaccccugagacagaaauuaguuaguggucugggaggacccugcauacuucauugaacgucaauaggacagauguccacagaggcaugcuugggugcuuugcugauaaugccacuguccuuaauugaagagccuggcuucuggguggcucugcugugccugcaucucacagucugaaggccccuguuggacugcuaaagggguauucacaucuaagugggcacuuuguccagcuuagauuugaggcccucaggaggcgucccuuucugugaguuuuuaaaauauauguuuacuucacucaggaggaacuaacuuccuaguccuaugacccaaagaccaggacuauuuugauaccuauuaccugacuuucuuuuggauaaagacuggcuucagggcuuugcuuuugauccccgcuggcaucucuuaacaggagccugcauguccucaccauuguuauuuugguuuuauuuuauuuuucuugguuaacacacguguguccaauguuuuauaacuucuaaaaucuuuuuuuuuuuuuuuuaauuuuuuugagacagucucucucugucacccaggcuagagugcaguggcaccaucucagcucaccguaaccuccgccucccggguucaaucaguucucccaccucagccucccgaguggcugggauuauaggcacccgccaccauacccggcuaauuuuuuuuguauuuuuaguagagaugggguuucaccauguuggccaggcuggucuuaaacuccugaccuuaagugaucuaccuaccucggccucccaaagugcugggauuacaggugugagccacugugcccagcccuaaaaucauuuguuuuuauuuguguaacuguuacguguugauacugguagaucuaguuauuucauuuuaaauauucuguaguauuuuguuaaaugaauauccuaacuuacuccucaaugauaggcaccucuucaguauuguaaauauguggcagcauccuugagcaaagcuucucgcgaguguaucugcuuagaaguagcguugcuggguuguggguguguauucuuaacuuugaucuagaagauugcucuccaaaaugguucuaccaacuuaccauuugagcagugugcguucuucuuuccucacaccaccuaucuggcuucuuaacccaucuggagaaugggaagggaauuuuauuucucucacuuaccauauuucuaaugagguugaauauugcuuuuuuuuuuuuuuuuuguagagacaggguccugcuguguugccuugccuggucucaaacuccuggcuucaagugguccuccugucuuggccucccaaacugccgggauuagaggcaugaggcacugcacccagccaaauaggcacauuuuuaaaagucuugguuuuguuguuguuguuguuguuguuguuguugagaugggucucguucugucacccagucuggaaugcaguggcaugauuguagcucacugcauucucaaccuacugggcucaagugaucuucccaccuuagccucccaaguagcugggaccacaggugcacgccaccaugcccagcuaauuaaaaaaaaacauuuuguagaugggauuuugccauguugccuaggcuggucuugaaugccugaacucaagcaguccucccgccuuagcauccugaguugccgggacugcaggaauuugucacacgccuggcuaauuuuaauuuuuuguagaguugggggucuuaauauguugcccaggcuggucuugaacucuuggacucaagugauccaucuaccucugcuucagccucccaauguacugguucagguaugagccaccaugcccagccuaaaagucuuaauucaccguuuguuucauuguugcuaagggcugugugacucacuuuuuuuuuuuuuuuuuaauuuuuugagaccuaaaagucuuaaugcaucauuugucucauuguuaguaagggcugugugauuugcccuuuuuuuuuccuuuuuuuuuuuuuuuuuuuuuuuuuuuuugagauggaguuuuacucuugucguccaggcuggaauaugguggugugaucuuggcuaacuguaaucuccaccucccagguucaggcaauucuccugccucagccucccaaguagcugggauuacaggcacacccuaccaugccuggcuaaucuuuguauuuuuaguagagaugggguuucaccacguuggccaggcuggucugcaauuccugaccuuaagugaucugccugccucggccuucugaaauacugggauuacaggcaugaaccacugugcccagcccugauuugccuuuuuaaugccauuuuuuaggugugucagcagccugagugugggaaauguaaagccugcaaggacaugguuaaauuugguggcaguggacggagcaagcaggcuugccaagagcggagguaggucaggccgagucuuccuccuguggcagaggacuugccagcugguggcagaugcacuguggagaagggccugcaugugugggacagcaccaggauuccuucguuaggcauugucucaggaccugucccuguuaugaagaaaacagccccgguuggucuuacuuagaaaaggggccuuagguauaaccagugacauugcaggugucccaauauggccaugaaggaggcagaugacgaugaggaagucgaugauaacaucccagagaugccgucacccaaaaaaaugcaccaggggaagaagaagaaacagaacaagaaucgcaucucuugggucggagaagccgucaagguaacccuuggagccccuuggucagcucacugccauguucccaauaagcagguugcccucuaguaucucgccaaccugaccucucaggcagccugagccccggcacuaagaaaccugucuguuugccccugagaagagcgggacuggccaagagaccauguuccauggcucaguaccagcaaggcauuuuuguguggccacaaggcucaguucuccuaaugucccaaaaugggcauuugacacaguucuaggggcaucaggcaggugagcccucauagcuuguuuuucuguuuuguuuuguuuaagauggaaucuugcucugucacccaggcuggagugcaguggcacgaucucagcucgcugcaaccucugccucccagguucaagcgauucuccugccccacccuccugaauagcugagauuacaggcgugcaccaccaugccaggcuaacuuuuuuuguauuuuuaguagagacgggguuucaucauguugcccaggccauucucgaacuccggccucaagugauccacccaccucagccucccaaagugcugggauuacaggcaggagccacugugccuggccccucauagcuuguuuccaagagagcugucacagcccccucugguguggggugggucuuuuuggggcaccaacagauggccucccauccguucuguggucauuggcuucacugaaggucaguuccuuuaccacagugugagagagaggagugaguauccucuguguugcuucucugacguccauaaauuaaagaugcaaucaguucacuuaauuaugaggcuugccaccugcuggcugccugggccguggcugagccccugcaggaggacagacauggguacugcugcauggcaugagugccucugcaggguagggggcugggaggaggcuggggccacgaggccuugcagaggugacaccugggcugagauggagaaggucagguaggaccuagccacacgaccugggggagagcugcacugagguggcagucagcuuacuuuguuggagaaaaggaaggaggccccugcagcuggaguggcuugagccaggggaugaugggcaggacaggggucaggguucaggcuguggccuuacagaccauggugagguauugugggcugugcuguuaaaaucaaauccugggacccgaguggcagagcagaagugggagggacauggaugcccuuggccacagcaucuggccaaggaagguggauguucuucuuuuuucuuauuauugaagcccuuguagaacaggauguucucuuuagcagcaacucuucauugacuucuuaaugaaaucgagucaugucuuacuuuaaguaacagaggaccaugcaagucaaggccagcaaagacccucagaaugauccuccaugaacuuaugcucucauuuucagacugaugggaagaagaguuacuauaagaaggugugcauugaugcggaaacccuggaagugggggacugugucucuguuauuccagaugauuccucaaaaccgcuguaucuagcaagguuugcaucuuucuuuuugcuugacuucugcaugcacuuucucaucaaguaggagaugccuguuuugccaaaauagcaccagcagcuuuuugcccuagaugaaaacugaaaaggacgagugcuccugcauagacuuggucacauaucugcuggccaagucagaacuuucuccccaugcccgucuucugauuccagggucacggcgcugugggaggacagcagcaacgggcagauguuucacgcccacugguucugcgcugggacagacacaguccucggggccacgucggacccucuggagcuguucuugguggaugaaugugaggacaugcagcuuucauauauccacagcaaagugaaagucaucuacaaagcccccuccgaaaacugggccauggaggugagugccuggugucccucgugagccccugccuuaucguggagggucacugcugacgugcguucuguuuuguuuugauuuguauuuuuuuuuaauuugguuuuuuuuuuguuuuuuuuuuuguuuugagacugaguuucgcucuuguugcccaggcuggagugcaauggcaugaucucagcucacugcaaccuccaccuccuggguucaagugauucuccugccucagccucccgaguaguugggauuacaggcacccaccaucacguccagcuaauuuuuuguauuuuuaguagagacgggguuucaccauguuggccaggcuggucucgaacuccugaccuuaggugauccacccgccucggccucccauagugcugggaauacaggcaugagccacugcgccuggccugacacgcauucuuaucucccaagggaggcauggaucccgagucccugcuggagggggacgacgggaagaccuacuucuaccagcugugguaugaucaagacuacgcgagauucgaguccccuccaaaaacccagccaacagaggacaacaaguucaagugagcacuggggcuggacucggggucagcaggcacuuucagcccacaucacucccuuuucccgugugcuuccgucugguuggcuuccgccaacggccccccaguuugugucucuugcucgucaaaggccagccugacuaugaaugaugcucaaguguguagauggccuggaguugcuuuaaguguguggaugaccuggcguugucuuuguaagaggguucccuacccaggaacaggguucgucuugccauuucaagacuucccguguguucuucagugugugcccagcucuugcauguuuuuggcuguuucuuagauauuuucuccuguaaaugagaccucuuauuugauucuuuucuuuccuuuuuuuuuuucuuuuuuuuuuuuugagacggagucucgcucuguugcccaggcuggagugcaguggugcgaucuuggcuuacugcaaacucagcuuccuggguucaugccauucuccugccucagccuccugaguugcugggacuacaggcgccugccaccacacccggcuaguuuuuuguauuuuuaguagagacgagguuucacuguguuagccaggauggucucgaucuccugaccuugugaucugcccgccuuggccucccaaagugcugggauuacaggcgugagccaccacaccuguccucgauucuuuuguaacugggugacugcuuugagggaagcuuuuauuuuuuauuuuauuuuauuauuauuuuuuuaauuuuuuuuuuuuuuuuuuuuuugagacagaguuucgcuuuuguugcccaggcuggagugcaguggcucaaucuuggcccaccgcaaccucuacuuccuggguucaagcgauucuccugccucagccuccugaguagcugggauuacaagcaugggccaccaugcccggcuacuuuuuuuguauuuuuaguagagaugggguuucuccauguuggucaggcuggucucgaacucccgaccucaggugaucuacccgcuucggcuucccaaagugcugggauuacaggugugagccaccgcgcccggcgagcuuuuauuuuuuaauguccaaugccccaugccuucuuuuuaaccuccguaccucacuuguuucaacuaaaagcagcagccagcacccccagaggagcagguggcaaccagggaaacccaggaggccaagagggcuccccgggggcaucugugcuucucccauaagucucgugcuagcuuuggcuugaucucuauuuucauuuuauuuuuuacuuuuuugugauggaguuucacucuugucacccaggcuggagugcaguggcacgaucucggcucacugcaaccuccaccuccuggguucaagugauucuccugccucagcuucccaaguagcugggacuacaggcgccugccaccaugcccggcuaauuuuuguauuuuuaguagagacagggcuucaccguguuggccaggcuggucuggaacuccugaccuugggucaucugcucccuucaggcuccuaaagugcugggauuacaggcaugaacuacugcacccaaccucauuuacuuauuuauuuaucacccaaccucuuuuauuuauuuauuuauuuauuuauuuauuuaucugagacagggucucccucugucacccaggcuggaaugcagugguguggucacagcucacuguagccucgaccugcugggcucaagugaucuuccugccucagccuccugaguagcugggacugcaggcaugcaccacccugccugguuaauguuuuaaaaauuuuuuguagagacggggucucacuguguuggccaggcuagucucaaacuucugggcucaagcgacccuccugccuuggccucccaaagggcugggauuacagacaugagccaccaugcugggccuugaucucuauuuuuaaggccaucuucaagucuccuuuaagggcuuacuagucaagaauaauguugaauuuccucaaauaccuguugagccuuuauggagagaacaguaggagucucugcuggauugaguuccucacugagccacucgggacuguugcucgugguguguucuuaaccauauucuagacccuguucauugauaucuuaggguuuuugucucaaugacucaaaaguugccugauuuucuugcuauguucucucugggcuuuggucucaaauaagugccuucaaaaugucaacacaaagcacaagaaagccaccucuuccuucuagcaucugcaaauguuuuuuccucuugguuaccagagucucuggauuaagcuggcaguagcugcugcggccacugccggccaccucagggccuuauguuucugucccuuuguuuccuucagauucugugugagcugugcccgucuggcugagaugaggcaaaaagaaauccccaggguccuggagcagcucgaggaccuggauagccggguccucuacuacucagccaccaagaacggcauccuguaccgaguuggugaugguguguaccugcccccugaggccuucacguucaaguaagugcccccucggagcagccggggccagggcgcuccaggcugagccaggcuggcuuuguggugucccccuccuuacagacauugccaaucccuccgcaccagcuguuguccuagccgucacguuggcauagguggcaaacagacaacauaaaucguguagacugaccaugaugcuauugcagagcaaagcugagcguaaaagucaacucgcugguuuggcugggugugguuucucacgccuguaaucccagcgcuuugggaggccgaggcaguggggaaucaucugaggucaggagucugagaccagccuggccaacauggugaaaccucgucucuacuaaaaauacaaaaauuagccgggugugguggugcgcgccuguagucccagcuacucgagaggcagagacaggagaaucacuugaaccugggaggcagagguugcagugagccaagaucaugccacugcacuccauccugggcaacagagugugacuccgucucaaaauaaaaaaagaaaaaaaaagaacuuacuggauaaagcgcgagggacagcugggggcccacccccaaguucugccucugcccaaggacaccuccucuccguccccuacugugaagugggagagugggaucuugccugcuggggcucgaaggguugagugaguugaaagugcuccauacaguaccuggcuuaaaguaaagguuuaacggacaugaguuacuucuugguuagagggaaucacaucagaugacuucucugugucagaggaucgaggcucuuccaggaaaaaccuaaagccacagaucguuuccacacugauccauucuguguuuuuucuaagaaucagcgugugguuggaauuacagccaacguuuuccagaugccuucccggcucacaauuccauuuccuuagagccccagcucccuugccuuaguucaguuacugugaauuaugagaacuggagaagcagguucccuccagccuuggcacaguuggggcgcguuacccccucugguuguccuuggugggaaggggacaccuccccguaguguuuucugccaguugcuccuggcaaagugggagagucagcacagagacgccuuuggggcccgucagacuccuggggggccuaguggggagaacgugacagcugacuucccuaacggcaggccuucuucaaagaacagcuuuuccacacuagucagaccacacucccauugucccaggcccuguggcgccuuacauuggccuccagugucgcuucuagaucagagccuuagucaggguagcguagguuguaucauagcaacaaccccaaaucacagugacuuaaaaccacagaagcuggacugggugcgguggcucaugccugucaggaguucaagaccaagaccagccuggccgacauaccugucucuacuaaaaauaaauuagccaggguuagcugggugugguggugggcaccuguaaucccagcuacuugggaggccgaggcacgagaaucgcuugaaccugggaggaggaguugcagugagccgagauugugccacugcacucuaaccugggugacagagugaaacucucucaacaaaaaccacgguagccgcugucucgcucauacgaggugcccaucacaggucagcagaggacuccaccuguugugucccuuggauaucugggccgcuggagucagaaguugccaguguuugagcccaagggaaagcacacaggacauuccccaggcagugacauccucuuuggucacuucugcccacgucacaugccaggaaacacaagaugccaaguagucgggaggcaggagccugggguauuugagcagugucagccaccaccguagccaguaaugcgcagagggugaaugcgugcuucaaacugugagacuaaaucugcagcuaaaucuuuuuuuuuuuuuucugugagauggagucuugcucugucacacaggcuggagugcaguggcacaaucucagcucacugcaaccucugccuccuggguucaagcaauucuccugccucagccucccaaguagcuggaauuauaggcauguaccaccacacccggcuaauuuuuguauuuuuaguagagacaggguuuuaccguguuggccaggguggucucgaacuucugaccuugugguccaccugccuuggucucccaaagugcugggauuacaggcgugagccacaaugcccagccuaaaucauuucuuaggguacacaccuaccuuaauucaucaggugcuugacuuuaaaugguuauuuucacuggucagucaugccugacugaccacugcaagguggaagguucauugaugucaagugggugcuucucugcagcaucaagcuguccagucccgugaaacgcccacggaaggagcccguggaugaggaccuguacccagagcacuaccggaaauacuccgacuacaucaaaggcagcaaccuggaugccccugagcccuaccgaauuggccggaucaaagagaucuucugucccaagaagagcaacggcaggcccaaugagacugacaucaaaauccgggucaacaaguucuacaggucagcagaggccucuguucuuccacgaggccacagacucuucuagaaggcucugccugaaacaagguuguggcauagcacccacaguuguucuaagaguuagguugaaguagcuguuuuuccaaguguuucugauuaucggugggcacugauaaugacuagaauucuaguucccagcccucacuuuuagguccuuauuuuaauguugcagagcccuuuuuccaaaagaaauccuuaagcuggcugggcacuguagcucacgccucuaauccuagcacuuugggaggcugaggcaggaagaucacuugagucuaggaguucaagaccagcuugaggaaacguagugagaccccggcccuaccaaaaaaaaaaaaaaaaaaagacuagcugggcgugguggcacacgccuguaaucccagcuacuugggaggcugaggcugaagggaucacugaaacccaggaauuugaggcuguagugagccaugaucccaccacugcacuccggccugggugacagccagaccccgucucaaaagaaaaaacggguagagugccugggcacccccagagaaccucccaagcuccaucuaugacuguccagguucugucccgcuguccccaccucuucccagguccuccuuucugucucugggauuuuuucucuuuccuaagcuuuuggccuauuacguuuucuuuuucuaagacccgaguaacuugcggugauuaggcauuaaccugaaacuagccuguacaggaagcuauacacuugccucaccucuuagcuaacauagaucaaagauuuccugaagccuuuguaauaacaggaaauaaaacaagggcugugagugguacaggugagagaaacacacucgagaggcugcuaccggcaggcggacacagcagggcagggccaggcgugcagagcaagcagccaagcugaccuaaugguuggggggucucuacccugugguucccuaauugggggcgaaucuaccuugcaguucccucauuuggggagggguuaucuuuaccugcgguucccuaaguaggggggucuuuacccuaugacucccuaacuggggaggucuuuacccugcgguuccauaacuggggggucuuuacccugcgguucccaacugggucgggggucauuaccuggcgguucccuaauugugggggaaucuaccuugcaguucccuaaugugaggaggggauaucuuuacccugugauucccuuacugggaggggucuuuacccugcgauucccuaacuugggggaucuuuacccugugguucccuaacuagggggggucuuuacccugcaguucccuaaaugggggggagucuaccuugcaguuccccaguguggggaggagauaucuuuacccugcaguucccuaacugagggggucuuuacccugcgguucucgaacuagggggucuuuacccugcaguucccugagcaccccaggaacaugguacuguuuaauucagcauaagcucaccacaaaggagagcuccuaacgaggccucucccgcucgcaggccugagaacacccacaaguccacuccagcgagcuaccacgcagacaucaaccugcucuacuggagcgacgaggaggccgugguggacuucaaggcugugcagggccgcugcaccguggaguauggggaggaccugcccgagugcguccagguguacuccaugggcggccccaaccgcuucuacuuccucgagguggugccccugcuugcuagagggaaggcuucggggucaaaguuggccagaaggagucugaugucggguuauacacaaggcggcuuggcugcaggguuucagcuuuuguaagaagugggugguuggcugacgugaagcuguucugcaggagcuuuacgggggucugagcaggguucuccagagcacaaguuguaugagauucaaguggucccggaguuuaacacuccugguuuuuaaaaaguacgucauuagagaaccuaacguuuuagugucuuggugcaacugaacguugaggaccaugaggcagcuuccaccagccugacuggugucuuaguaugaguuggagaaggugccccugcuccugggucccuugggccaggcgccuacguccaggcccagcccacaugccugugcggguggcccucguuauggagagggcccacgagucagcugaucaagcucaugacuuguaaauuguuggggcuuggccuuuccguguuguuaccuuaaaacgauacauccacguucucccaggcauggaugagguagcccaauuggacagcagauucugcauagcacuuuuuccuguucuagaagguacucucaagugcuuguaauaggcauuucagugucagccagaucaaauguuaguauuaauaaaauggauuguuuuaaguuucuauuguagcaaagucaaacuacucuuauugguggcuaauuggucauggccccacugagggagaaauuaagugacuaucaaauugccuucuuacuagucugcguuagagaggggacagugcguuucucucccaaacgauugcaguucucuccuuuucaggccuauaaugcaaagagcaaaagcuuugaagauccucccaaccaugcccguagcccuggaaacaaagggaagggcaagggaaaagguacgucauuguaugaguuucuuuucaaguuauucuucuguaacuuggaggcugccugugaaucccucaguguaaaaccaccucugguguuacugacucugggacagcgaggccgccugaguuaacaaggcgcuugagagcaagguggacuuggacucugaggaucggguuuagccucuggccucucucccccagggaagggcaagcccaagucccaagccugugagccgagcgagccagagauagagaucaagcugcccaagcugcggacccuggauguguuuucuggcugcgggggguugucggagggauuccaccaagcaggugagcgcccguaggcuccaucucugaauaccuggugagcccagaccgggcaggugcuaccugaaacgacuuccaaccccggucaccuuccugacucaagaaucuccuuccgaggccaggcacgguggcgcacgccuguaaucccagcacuuugggaggccgagguggguggaucaugaggucaggaguuugagaccauccuggccaacauggugaaaccccgucucuaauaagaauacaaaaauuagcugggcgugguggugugugccuguagucccagcuacucaggaggcugaggugggagaaucgcuugaaccugggaggcagagcuugcagugagccaagaucacaccacugcacuccagccugggugacagagcgagacuccaucucaaaaaaaaaaaaaaaucuucuggagaguugaaagcauggcuucgugcuugaucugccaggcaucucugacacgcugugggccaucgagaugugggacccugcggcccaggcguuccggcugaacaaccccggcuccacaguguucacagaggacugcaacauccugcugaagcuggucauggcuggggagaccaccaacucccgcggccagcggcugccccagaagggagacguggagaugcugugcggcgggccgcccugccagggcuucagcggcaugaaccgcuucaauucgcgcaccuacuccaaguucaaaaacucucuggugguuuccuuccucagguaaacggguagaagccccccaguguugccagacggcccggggcugugccgcaugucagcaguggucauuuucgcccugcacugaggccucugccccccggaagcucacagcucagcucucaccagggagagacuuugauaacauucgugaggggcuuccggcacagugggucguuucuucccucugucuguggaggugacuccugcagucucuccugcccccuacagcuacugcgacuacuaccggccccgguucuuccuccuggagaaugucaggaacuuugucuccuucaagcgcuccaugguccugaagcucacccuccgcugccugguccgcaugggcuaucagugcaccuucggcgugcugcaggugggcccuggggcuggggcgggcagacagauguggccagcacgugacccggccagcagccagccaucccuuacugaaggcaggguucaauggcauaggccugccauccaggcagcagaggcuggcauggugcucugucccacuggcggagucaggggagaugcgugcucagccggcccccagcaaguccaccgcuagugucucuugagcuguguucucgaacaugccugggagggcuggcuacaaugggcuucucgccaugcagcuccuggcuccuuucccucgauggggaagggugagcagcccaccauggagcacuguggaauggcugagucugcacagagcgggaggggaagugaggugcgcagagccauguguaggcggcagcuguucgauugguuuaaaagacaguuuugcucuggguaacugcgcacacaaacccccacagauggccgaggguugcacuccagguggcugugucugcagggacagggauggacauagucuguggggcccaggccuuaucugaaaagcaucccccauccucucuguaucagcucagcaauugagggcauaauuaaaaaugaaacagcuauccagaugcuagcacaggaugucugccuaagugggcaagcacuuggcuacccgguccccuagcucagccucagggcgacucaggcucaccagacaagacuuguugcagccacguucucuguccuugugaccacagccaucagggaagcgacagggcuccuggucuccaguguucuccccgagugcuaagaccuuggggcccuugcagugcuuucagagcuggccggacuuccccgcaggguuugcucccaccuuccccaguggcuguccccugggcucagcugcuuuuguucuuuaucugcuccaaacuccucugaccaggagcacgccugcugagguaacuggggauuucugcaagugcacuccgcauuggccagccacucccgacucaggcugcugacccugggccugggucuggccaguccaguugggagugucccacugacggugggguuguccguccuucucccccacaggccggucaguacggcguggcccagacuaggaggcgggccaucauccuggccgcggccccuggagagaagcucccucuguucccggagccacugcacguguuugcuccccgggccugccagcugagcguggugguggaugacaagaaguuugugagcaacauaaccagguagguggcccccgucgcuccuccacacacugccgagcaggccucaguagcucauggggcccgugaguacucccuggugaggcuuggggaggagaggaugguacagcaucugcccugccacacggugcucugccacauggcacucugccaccuguggucuccaguucugacccugcaucaucugcuucccuaguagauagcaugugcagagcggccagccgcaugcuuggcuguggucauccacaaagcccacgccauagccccauccccccuuccagauggcauccaggcacacugccacccaugugaccucgggcagugcugugaucucgggagaaggccaucugagcaggcaggggguggcaccugugaugaggggacagcugcugcgugcaucuccagagguguugaccuccuccucuguugcagguugagcucggguccuuuccggaccaucacggugcgagacacgauguccgaccugccggaggugcggaauggagccucggcacuggagaucuccuacaacggggagccucaguccugguuccagaggcagcuccggggcgcacaguaccagcccauccucagggaccacaucuguaagguaauggcacccugacagagcggcuccuccucgaggcccagcccagcagccucgugggaacagucagccugcccaagacucaggggagacauggaaucugaucccaggcuccuccucccgaguccucagccuuugugugaccccuggucucucuugcauggucaugggaagugucagagcucccgcaguccuggacuuggucuggaauggugucaagccacugcccacccaccacugccuucccccuugcugccucuccccgcauguuuucccaggaugccaagaccagcccuuucaccauccccuggcaccacuccccuucccccacccuaaaggcucagcuuagauucccacgcucuccuacaccugcgcugccucaggucccugccguggccucgagccaagugcgauaucccugacugucucuuucccgaugggcgugagccccagggggcuuccuggucaccaugguguucccagcucccagcccaccauggaugcucggaugcugcucacaugaggugacagcugggccccccacacucuuucaggacaugagugcauugguggcugcccgcaugcggcacauccccuuggccccagggucagacuggcgcgaucugcccaacaucgaggugcggcucucagacggcaccauggccaggaagcugcgguauacccaccaugacaggaagaacggccgcagcagcucuggggcccuccguggggucugcuccugcguggaagguggguccuguaaguugugguucccggugggcugaggggaaggaaggcagagcccugggccuuuggccugugaaccuggaggccagggcagggcacagacacaccaagccugggugucccagagaagguagcugcugaccauguugaguaguaaaagcaggcuggguucauggcccacaccuauaaucccagcacuuugggaaaccaaggcgggaggaucacuugagccugggagguugaggaggcuacagugagcugugauugugccauugcacuccagccugggagacagagugagacccugucucuaaaaagaaaaaaaaaaaacaauaaauaaauaauaaaagcaggucaggcacgauggcucaccucuguaaucccagcacuuugggaggccaaggcaggcagaucacuugagaucaggagcucgagaucagccugcccaacauggugaaaccccaucucuauuaaaacuacaaaaauuagccgggcguggugucgcacgccuauaaucccagcuauuugggaggcugaggcaggagaaucgcuugaaccccauaggcagagguugcagugagccaagaucaugccauugcacuccagccugggcaacagagcgagacauauaauacuaauaauaaaaacagugcccagagaacgaggauuguuggcugcuccaccccagggggccccuugcacaggaggugccaucucugccucccaaagcucuaagagccacugucccaagccuauaccccaucccacaacugcagccucaucacuguccugucuuccagccggcaaagccugcgaccccgcagccaggcaguucaacacccucauccccuggugccugccccacaccgggaaccggcacaaccacugggcuggccucuauggaaggcucgagugggacggcuucuucagcacaaccgucaccaaccccgagcccaugggcaagcagguagguggggagggggcauccgagggccugggucaggcccuguacuuggcggccuaacuagguggaaguguggguuuagccaagugggggacagcaccccaggaccccaggcaccuggccucugccuccugccccuccacguccacgggacaagcucauaggccaaggccauggccguaugcugucacagugccauuucccucccuguccccgacggugacccggccugggugcuacugcccucgcccaccgcgccucuuucccccagggccgcgugcuccacccagagcagcaccguguggugagcgugcgggagugugcccgcucccagggcuucccugacaccuaccggcucuucggcaacauccuggacaagcaccggcaggucaguggggcggcgcccgcugggucuggacaggaaggaggcuucugugccugucaccagguggggcuggggccagcgcagucacuuccgggaggacgccugcuggcugccggguagccccaucacucucagugggaagacggcccacaggagggacagugcugagacauccgagucaggcugcgucccuaugcugguuccuuacuguuuguuuuugaggcagagauugagccagaaggacaguccgucgcgcuaaaggagcaggcuaaaacccaugguggcgacagcucacucgcuguagguucaaaugaacuagcaccuuaauuccuaccugcuucucaggugucggguuggcuuaacaaguuagucuaugaguuagucucaguuaaguguauuuucaucauagggcacgcgcauugcuuaaaaaccaguguccacgguucuugugaaaaccacauuucaccccuccccccgaaucugguucucgggaagcagccacucucucuuuuuuuuuuuuuuuuuugagauggagcuuuguucuuucgcccaggcuggagugaaguggcgugaucucagcucaccgcaacuuccaccccccugguuuuaagugauucuccugccucagccucuugaguagcugggauuacagucaugugcuaccacacccggcuaauuuuuguauuuuuaguagagaugggguuucaccauguuggccaggcuggucccgaacucuugaccucaggugauccgccugccucggccucccaaagugcugggauuacaggcaugagccacugcgccggccagggaagcagccacucuuaacugggagcgaaacgugucuagguggcccauuugucuuuuuuuuuuuuuuuucugagacagggucucacucuguccccuaggcuggagugcagugacaugaucucugcccacugcaaccuccaccuccaggguucaagugauucuccugccucagccuccugaggugcugggauuacaggcaugugccaccaugcccagcuaauuaguuuuuguacuuuuaguagagacgggguuucaccauguuggcgaggcugcucucgaacuccuggccucaacuaauccaccugccuuggccucccaaagugcugggauuacaggcgugagccacugcucccagccccacgugucuuugucucaagucuuucugaagcucuucaaaggcccagugacuuguggcuguggggcgggaugaugggccaguuggaggguccaaggaucuugugcuggaaggguuuugggcccaugugagcaggaccagaacccuuccccaaggggugcaaugcccagguuguccuccaucugagcaggggcuggcaguacaccugcccccgggccuugggccuggguguccacaucaggcauugcccuucuccccuccugcaggugggcaaugccgugccaccgccccuggccaaagccauuggcuuggagaucaagcuuuguauguuggccaaagcccgagagagugccucagguaugguggggugggccaggcuuccucuggggccugacugcccucuggggguacaugugggggcaguugcuggccaccguuuugggcucugggacucaggcgggucaccuacccacguucguggccccaucuuucucaaggggcugcugugaggauugagugaguugcacgugucaagugcuuagagcaggcgugcugcacacagcaggccuuuggucagguuggcugcugggcuggcccuggggccguuucccucacuccugcucggugaauuuggcucagcaggcaccugccucagcugcucacuugagccucugggucuagaacccucuggggaccguuugaggaguguucagucuccgugaacguucccuuagcacucugccacuuauugggucagcuguuaacaucaguacguuaauguuuccugaugguccaugucuguuacucgccugucaaguggcgugacaccgggcguguuccccagagugacuuuuccuuuuauuucccuucagcuaaaauaaaggaggaggaagcugcuaaggacuaguucugcccucccgucaccccuguuucuggcaccaggaauccccaacaugcacugauguuguguuuuuaacaugucaaucuguccguucacaugugugguacaugguguuuguggccuuggcugacaugaagcuguugugugagguucgcuuaucaacuaaugauuuagugaucaaauugugcaguacuuugugcauucuggauuuuaaaaguuuuuuauuaugcauuauaucaaaucuaccacuguaugaguggaaauuaagacuuuauguaguuuuuauauguuguaauauuucuucaaauaaaucucuccuauaaacca

SEQ ID NO: 192022 - RNA, 15775 nt, Homo sapiens
caagcuuagccuggccgggaaacgggaggcguggaggccgggagcagcccccggggucaucgcccugccaccgccgcccgauugcuuuagcuuggaaauuccggagcugaagcggccagcgagggaggaugacccucucggcccgggcacccugucaguccggaaauaacugcagcauuuguuccggaggggaaggcgcgagguuuccgggaaagcagcaccgccccuuggcccccagguggcuagcgcuauaaaggaucacgcgccccagucgacgcugagcuccucugcuacucagaguugcaaccucagccucgcuauggcucccagcagcccccggcccgcgcugcccgcacuccugguccugcucggggcucuguucccaggugagucgggguggggauugccgucgggccaguucuccgaagccccgggaggaccggcucccgggucaggucaugcaugcuuagguagcuguuuaugggaaggaggggcuagagacagcgauugaaaggcaacagccaguagguucgaauccagacccugcauaccuccacguguggccuugggcuauagauugcagcuuuaaaaaaggguaggggguuggagauggaggggaggggcgggccucguuuuguugcccaggccggucuugaacuccgggggucuagccuuaccuccugccucagccucccgaguagcugggaugagaggugugaaccaccgccuugcuuggcuagauugcgucucuuacaguuucucagcuguaaaacgggaaacguuauagcggccaccuggcaggguaucuuggcccagcgcagcaccuggccccaggacucgaucaugaugguuugggaacuuggcucugugccaacccaacaaggcuuaagggacccccaccccccucaagauguauauucuguuccucauccucucugccccuggggaaguccagggcugcuucuacuugggggaauuccagagcugacuuauccguggcccaaagcugagaagugggacgccccagcacacccucccccagcuccagcccagcuagggaagagggaaggggucagagggucuuucauggugguguaaguuuggggaaccaggagggugggagauugacagcuugguuaacagcucaacaaagccugagauccaggccagcacgguaguucaugccaguaaucccaacacuuuaggagccccaggcgggcgaaucacuuaaggucaggaguuugagaccagccuggccaacauggcaacaucccgucucuacuaaaaauacaaaaauuagcuggcaugguggugggcgccugugaucccagcugcucgggaggcugagggaggaaaaucccuuaagcccacgaggcugagguugcagugaaccaagauugugccacugcacuccagccugggagacauagcgagauucugucucaaaaaacaaagcguucugauccggacucagacccagaucgcacugcuuucuagcugaguaaccauuucucucuaugaaaugggaauggucccagaaucucccuuggagaauguauggagccaguguccucacacccccauccaagauagaacaaaucugagacaggaaucuuugagugaggcagugcugggcucagacauuuuuucccaccuucggaggcagcagaaucugagggaccugauccaaauaagccccuucuuucuuucuuuucuuuucuuuuuuuuuuuuuuuuuuuuuugagacggagucucacucugucgcccaggcuggagugcaguggcgugaucucggcucacugcaaccucugccucccagguucaaacgauucuccugccucagccucccugaguagcugggacuacaggcaugugccaucacacccggcuaaucacuguguuagccaggauggucucgauuuccugaccucaugaucugcccacccugccucccaaagugcugggauuacaugcgugagccacagugcccaccccguaagccccuucuuucuuaccugcaagguagccaguugcuacccauccugugcugaguuacuuguauuagcaagggaugggguggcuauacucacccaccuuacagauggggaaauugaggcccaaagagggggaaacuacgugucucagggagugaggagccagucugauuccuggagggcugacugucuccaccugacuucuuaggagggaggagggcaccaacuucacauuaaaaucugguuggacacaguggcucacaccuguaauccuggcauuuugggaggcuuaggcgggaggaucacuugaggccaggaguuugagaccagccuuagcaacauagugagaccccaucucuacaaaaauguuuuucagggccaggcgcgguggcucacaccuauaaucccagcacuuugggaggcugaggcgggcggauuaccugaggucaggaguuugagaccagccugaccaacauggagaaaccccgucucuacuaaaaguacaaaauuacccgggcgugguggcgcaugccuguaaucccagcuacucgggaggcugaggcaggagaaucgcuugaaccugggaggcggagguugcggugaacugagaucgugccauugcacuccagccugggcaacaagagcuaaacuccgucucaaaaaaaaaaaaauguuuuucaaauauuagccggguauggugguguccuguagucccagcuacuugggaggcugagaugggaggaucacuugagcccaggaguucaagguuacagugagcuaugauugugccacuguauuccagccuggguaacagagggagacccguuuaaaaaaaaaaaagugauggcuaaaguccuuccauggcucccuauugcccucaguauaaagaacacauguggcugggcguggugguucacgccuguaaucccagcacuuugggaggcugaggcgggcggaucacuugaggccaggaguuugagagcaggcuggccgacguggcgaaaccccgucucuauuaaaaauacaaaaauuagcugggcgugguggugcuugccuguaaucccagauacucuggaggcugaggcaggagaaucacuugaacccgggaggcaaagguugcagugagcugagauugcgccacugcacuccagucugagugacaaagcgagacuccaucucaaaaaaaaaaaaaauaaaagaacacaucuuuagcauggccuucagugcucacgggaucuuccugaauuaaucucccccucuucauccuugcucacucagcuccagccacccugccccgggacaucuguacuugccuggaacuuauuucccuuuucuccggacagccagcccuuucucgucauuuagaucucugcugaaacauuacccugucaccaaagcacugucuauucuaucacccuguuuuguuuuugucaaagcucauauuaacaucaguuauuaauuaucuuguuugcucauaauuuuuuuuuuuuuuuuuuuggagacagagucucguucuguugcucaggcuggagugcaguggcacaaucuuggcucacuguaaccuccaccucccagguucaagugauucuugugccucagccucccaaauagcuaggacuacaggcacgucccaccaugcccagcuaauuuuuguauuuuuaguggagacggggcuuugucauguuggccaggcugaucucaaauuccugaccucaagugaucugcccgccuuggccucccaaagugcugggauuacaggcgugagccaccacacccggccugcucaugaauuuucucuuuaacuuccacaucgaaggcaaaguauugucuuguuaaggcugugccuccagcacccagcacaggcugggcgcacauucccuugaugaaccugauuuguaaugccugucgccucuucccucguuucuucuaggaccuggcaaugcccagacaucugugucccccucaaaagucauccugccccggggaggcuccgugcuggugacaugcagcaccuccugugaccagcccaaguuguugggcauagagaccccguugccuaaaaaggaguugcuccugccugggaacaaccggaagguguaugaacugagcaaugugcaagaagauagccaaccaaugugcuauucaaacugcccugaugggcagucaacagcuaaaaccuuccucaccguguacugugaguaacugagcccggagggcuggacuaggcagacccggugggagagacgugcaggggcaccugcagaggccugggggaaucuuugccacuugcucguagggucaaggaggggcuccuugcagggcagguggggacauccuuggaaagucccuuugugaauuucuuuggguacaauuaaaguauuuacaggcugggugcgguggcucaugccuguaaucccagcacuuugagaggcugaggcuggcggaucaccugagaucaggaguuuaaguuucgccaacauggcgaaacccugucucugcugaaaauacaaaaaucagccgggcauggugucaagcgccuguaaucccagcuacuuggaaggcugaggcaggagaacgcuugaaccugagaggcagagauugcagugagccgcgaucgugccagugcacuccagucuggauaacagagcaagauuccaucucaagaaaaaaaaaaugccaucucucuaugccucacucuuugaacauaugacacgguccugcuucagacacuuuaauaaaagaugcaaauuaagccaagugugguggcuuguaccuauaaucccaacuacuccagaggcugaggcagaaggaugguuugagcccaggaguuugagaccagccugggcaacagagugagacccuguuucuuucuuuuuuuuuuuuuuuuuuuugagacggagucucacucugucgcccaggcuggagugcaguggugugaucucggcucacugcaagcuccgccucccggguucacgccauucuccugccucagccucccgaguagcugggacuacaggcgccugccaccaugcccggcucauuuuuuuguauuuuuaguagagacgggguuucacuguguuagccaggauggucucaaucuccugaccuagugguccgcccgccucggccucccaaagugcugggauuacagguguaagccacugugcccauccaagacccuguuucuaccggaaaaaaaaaguaaauaauuuagcugggcaucguggugugcaccuguaaucccagcugcuccugaggcugugaugggaggauugcuuuaacccagggguucgaauccuaggaguucgaauccauccuaggcaacauagcaaaaccccauuuuuauuuaaaaaaaaaaaaaaagauaugaguuaaaacuagcccugggauggcauuuuucacauauugguaacaaacaaaagaauugauggccgggcgcaguggcucacgccuguaaucccagcacuuugggaggccgaggcgggcggaucacaaggucaggagaucgagaccauccuggcuaacauggugaaaccccgucucuacuaaaacuacaaaaaauuagccgggcaugguggcaggcgccuguggucccagcuacucaggaggcugaggcaggagaauggcaugaacccgggaggcagagcuugcagugagccaagaucgugccacugcacuccagccugggcgacagagcaagacuccaucucaaaaaaaaaaaaaaaaaaaagaauugauaacagcugugcugccaaggcuauuggaacguaggagguccuaggacagugcuguugggagcauaaauaagcccaacccuguggcgggaaauugggcaucaguucucaaaaugucaugggcugggcacgguggcucacgccuguaaucccagcacuuugggaggcugagggaggcggaucacuugaggucaggaguucgagaccagccugaccaccauggagaaaccccgucucuauuaaaaauacaaaaaaaacuagccaggcauaguggcacauaccuguaaucccagcuacucgggaggcugaggcaggagaaucucuugaaacugggaggcagagguugcggugagcugagauugcgccacugcacuccagcuugggcaacaagagcaaaacuccaucucaaaaaaaaaaaaaaaagaaauaaaagaagguauguugaauaugagugguaugccacccucacauuagggaagggcaguuucggggaggcuguauuuauguauaaaauagcccuaaaaggaagugggagaaaugacaauauuagcuggcuaugagaagagaggcugggaggcugugggagagggcuuggguguggagaauucuuuuuguuuuuuccuuuuuuugagacagaguuucacucuuguugcccaggcuggagugcaauggcacgaucucagcucaccgcaaccuucaccuccugaguuuaagugauucuccggccucagccucccgacuagcugggauuacaggcaugggccacuacgccuggcaaauuuuguauuuuuaguagagacaggguuucuccauguuggucaggcuggucuugaacucugaccucaggugauccgcccgccucggccucccaaagugcugggauuacaacgugagccacuuugccuggcugagaauucuuuuuuuguuguugucuuuuugagauggaguuuugcuguguccccagccuggagugcaaugguguaaucucagcucacugcaaccucucccucccggguucaagcaauucuccugccucagccucccaaguagcuggaauuacaggcgcccagcaccacgcccggcuaauuuuuguauuuuuaguagagacgggauuucaucauguuggccaggcuggucuugaucuccugaccuugugaucugcccgccucggccucccaaagugcugggauuacaggcgugagccacugcccccagccgagaauuucucuuugcguccuuccuacuuuggggacuucgaauggugggaaagaguuaucaaggccaaaauaaggaauucaaaugaaaacaaaacaaaaucaaagaagaaaaaacagaagagcacugggcaggcuaggcacguggcucaugccuauaaucccagugauuuagaaggccgaaguagaaggaucgcuuggaggccaggaguuggacaccagccugggcaacauagcaagaccccauaucuacaaaaaauaaaaaaccuaaccaagcgugcuggcauacuaguagucccagcuacucaggaggcugaggugggaggaucaccugagccugggagguccaggcuguagugagccgugaugacaccacugcacuccagccugggugacagagaaagacccugucucuaaaaaauaaaaacuggccaaguagcuuugggauuagccuuggguuccagucccagcaaggccuuuaauagcuugggacaugacuucugcauuuacuuugcaaucaggugagaccuccucugauggggaaaaugacacggugagugacaaaggauguucuccuaucauugugucagggcaaggaagccucuggguaaaugaucaaaugaucagcuuugcuucugauuuggagggugggugagcagaugcugaccuucccaggugagggaaguccccgaacauucccagcagcuucuggaaaccccagggaaaccucuuugaaggucuuuucugcaucucugccugauaggucuuuuuuuuuuuuuuuuuuuuuuucuuuuuuuugacacacagucuugcucugucgcccaggcuggaucacugcaaccuccaucucccggguucaagcaguucuccugccucauccucuccaguagcugggauuacaggcaccuggcaccacgccuggcuaauuuuuguauuuuuaguagagacaggguuucgccaaguuggccaggcuggucucgaacucuagaccucuggugauccacccgccucagccucccgaagugcugggauuacaggcuugagccaccacgcgcggcucugccugauagcugagagcauagaacuccagguuugagaccuggcucugccacauuucucccucuaugacugugggugccccacuuugccuuaguuuuuaccucugugaaauggagcagauggcuggcacagguagcaaaggaguaaaaguuaugugggagggugguaccugagagagacucuagcuuggucuugccccaccccugguguaaacauaaagaagccucccuggauggcucaaucuucuccaaaaagguuagagguguaauuccuagaggaggcgaccacuagcugggcuuugaaggauguguaggaguucauaaggacaggcauucugggcaggaggaacagccugggcaaaaguugggagcagggagaaaucuugauggaggcaggaggaggaggagguagguugguguaggccaggugcaguggcucacaccuguaaucccagugcuuugggaggccaaagcaagaggauuguuugagcccaggaguucgagaccagccugggcaacauagcgagacccugucucuaagaaaaaauaaaaaaauuaggguacaguggcauaugcuuguauucucaacuacucuggaggcucaagugggaggaucacuugaacccaggaauuuuuuuguuuuuguuuuuguuuuuuugagauggagucucacucuguggcccaggcuggagugcaguggugccaucuuggcucacugcagccuccuccaccuccuggguucaaccgauucugcugccugagccucccgaguugcugggauuaaggugcccaccaucaugcccagcuaauuuuuuuguauuuuuaguagagauaggguuuaccauguuagccaggcuggucuugaacgccugaccgcaagagauccuccugccucaguuucccaaagugcugggauuauaggugugagccacugagccuggucaagcccaggaauuugagguuacagucagcuaugauugcaccacugcauuccagcccaggugacagagagagacacugccccuaaaaaaaaaaaaaaaauugauugaugggaggaagggugagguuggcagagccuugaaugccagguggaggagcugggacuuuccuucuuggggugauagggagucauggaggguuucugagcaggccagggauuagauagcugaaggcuggauuuacuggaagccaaugagcaguuggcuaugguccuuguccacgcggcccauguugugggcagugaccguauucaagaagggaaggacagacaaguauuugaauacuucagugaccaggauuugguaaaggacugcaggucagggucaagaagaggugagagcaggacagacuuccuccccgcugcaccaggcagcugagcuggguuuccucuaggggcugagguuugaggguaccucaaguucugcaagagucuauaggaggugguaagagagaagagcuggaggucagaguuuucuugacuauauauauauauauuuuuuuguuuuuguuuuuaacagcuuaacagcuuucuguuuuauuuuuagagacagggucucagggucucacuuugucacccaggcuggagugcagugguacaaucguagcugacugcagccucaaacucccaggcucaagaaauccuccucccacccuuagccuccugaguagcagggacuacaggugugagccagcaggaagcccagcugguuuuuuuuuuuucuuugguguuuuuuguuuguuuguuugagaccggaguuucgcucuuauugcccaggcugaagugcaauggcaggaucuuagcucaccacaaccuccgacccccaggaucaagcuauucucuugccucagccaccugaguagcugggauuacaggcaugcgacaccacacaaggcuaauuuuguauuuuuaguaaagacaggguuucuccauguuggucaggcuggucucgaacucccaaccucagaugauccaccugccucggccucccaaagugcugagauuacaggcaugagccaccgugcccggccuuuuuuuuuuuuuuuuuuuuuuugagacagagucucacucugucgcccaggcaggagugcagugguucgaucugggcucacugcaagcuccgccucccggguucacuccauccuccugccuuagccuccugaguagcugggacuacaggcgcccaccaccacgccuggcuaauuuuuuguauuuuuaguagagacgggguuucaccguguuagccaggauggucuugaucuccugaccucgugauccgcccgccuuggccucccaaagugcugggauuacaggcgugagccaccaugucuggccuggccaggcuggucuugaacuccugacuuccggugauccaucuguucuggccucccaaagugcugggauuacaggcauaagccaccacgccaugccgaagcccagcuuguuuuuaauuuuuuuuuuuuuuuuuggagaaaugaggucuugcaauguugcccaagcuagccuugaacuccuggccucaaaugaccccgccuuggcaucccaaaguacugggauuacagaugugagccaccaugccccagccuugcuuucuugagauacgauuuagaauaccauaagauucaucccuuuuaagcacauaauucaaugacuucuguacaaacaaccaugacuacaaucuaauuuuaaaauauuucaaucacucuaaaaaagaaaccuccugcuuauguacagcgacucugucuaccucuuaagugaauucuccuaccuuuaauagcccuauuuuacaguucaggaaacugagguucagagagacaaagucacuuacccacagcaaagaagcaaggcuggguaucaaaugcaggacccccccgguccugaugcuuuuuuuuuuuuuuuuuuuuuccucugagagagacucucacucugucacucagucuagaguacaguggcgcgaucucaguucacugcaaucucugccuccugggcugaaguaauccuuuccucacaaguaaaccucagccucucaaguagcugggacuacaggcacacaacaccacgccuggcuaauuuuuguauuuuuagguagagacgggguuucacuauauuggccaggcuggucuugaacuccugaccucaggugauccgccugccucggccccccaaaguguugggauuacaggcgugagccaccacacgcagccuuuuuguuauuagacucugucauuacugacuuuuuuuuuuuuuuaauagaaacagggucuuucuuucccaggcuaaaguacaguggcaugaucacaguucacuauagccuuaaacuccugggcucaagugauccuccugccucagccucccaaguagcagggacuacaggugugcaccaccacacccaguuaaccauucauucauucauucauucauuuauuuugagauggagucucgcucugucaccuaggcuggagugcaguggcacgaucucagcucacugcaaccuccaccucccagguucaagagauucuccugccucagccucccgaguagcugagacuacaggcgugcaccaccaugccagacuaauuuuuguauuuuuaauagagacgggguuucacucuguuggucaggcuuaucucgaacuccugacuucguggauccacccuccuuggccucccaaagugcugggauuaaaggcgugagccaccgcgcccugccaaccuuuuuuuaauuuuucuuagagaugggggucucccuauguugcccaggcuugucuugaacuccuggccucaagugacccucuugccuuggccucacaaagugcuaggauuacagccugagccaucacaccuggccaacagguuuuuuuuuuuguuuuguuuuguuuuuuaaagaaugucuaggccaggcucauuuacuuucaccuguaaucccagcacuuugggaggccggggugggcagaucacuugaggucaggaauucgagaccagccugggcaacaugcugaaaccccguuucuacuaaaaauacaaaaauuagcuggguguggugacacgugccuguaaucccagcuacucaggagguugaggcaggagaauugcuugaacccaggaggcagagguugcagugagccaagaucaugccaucacccuccagccugggcgacagaaggagacucagucuaaaaacuuaauuaauuaauuaauuaaaaauaaaaauacaaaaauuaaccuggugugguggugugugccuguaaucuaagcuacucaggaggcugaggcaggagaauccccugaaucccagaggcagagguugcagugagccaagaucgagccacuguuugcccagucuagugcacugggcugcugaauuuauuugaccagacaccuagcaauagacuuugaaguucuuuuccacuuuucacucuaagaugcugcugucaugaauaaggaauauuuugauccccuucacaaacacucggggcccucuuaccaguuuucacugaagaucuugacauuccuaucugcuuaggugucugggcguguuugggggagauacugaagagguagggcucccaggcaggugcaguucgucuguuaggcaggcagcaagguccacuucaccagacacccccaccucuguuuuccugcagggacuccagaacggguggaacuggcaccccuccccucuuggcagccagugggcaagaaccuuacccuacgcugccagguggaggguggggcaccccgggccaaccucaccguggugcugcuccguggggagaaggagcugaaacgggagccagcugugggggagcccgcugaggucacgaccacggugcuggugaggagagaucaccauggagccaauuucucgugccgcacugaacuggaccugcggccccaagggcuggagcuguuugagaacaccucggcccccuaccagcuccagaccuuuggugaggauugaagaagccagcagggagaaggugggggugggguauccugcaaugcggugccuguggccacaggaucuuuugagauggguguggccccggcuaaggggugcauguguucuaggcguaugugaccuaggcugcugaguggcccuggaagaggaucucgcaggagggggaaugaaaugccccagagaagggcuucgggacguccaucccugucugcucacaccuuucuucucucccuaguccugccagcgacucccccacaacuugucagcccccggguccuagagguggacacgcaggggaccguggucuguucccuggacgggcuguucccagucucggaggcccagguccaccuggcacugggggaccagagguugaaccccacagucaccuauggcaacgacuccuucucggccaaggccucagucagugugaccgcagaggacgagggcacccagcggcugacgugugcaguaauacuggggaaccagagccaggagacacugcagacagugaccaucuacaguaagaaggggcaggggcggaguggggcuucuugggggugugaccugaacccggggcggggcucacugugugccuauuccaggcuuuccggcgcccaacgugauucugacgaagccagaggucucagaagggaccgaggugacagugaagugugaggcccacccuagagccaaggugacgcugaaugggguuccagcccagccacugggcccgagggcccagcuccugcugaaggccaccccagaggacaacgggcgcagcuucuccugcucugcaacccuggagguggccggccagcuuauacacaagaaccagacccgggagcuucguguccugugugaguggggcugcuggucaauggccccuaucccccaaggcccaaucucccugaaggucccauaaggucuugccuccaaguccugcccccacccaccuccaugucaucucaucguguuuuuccagauggcccccgacuggacgagagggauuguccgggaaacuggacguggccagaaaauucccagcagacuccaaugugccaggcuugggggaacccauugcccgagcucaagugucuaaaggauggcacuuucccacugcccaucggggaaucagugacugucacucgagaucuugagggcaccuaccucugucgggccaggagcacucaaggggaggucacccgcaaggugaccgugaaugugcucugugagugagccggcgggcagagcugggugggggcaggggccauggaccuaaugcaauccucaccgccuguuguauccuccccacagccccccgguaugagauugucaucaucacugugguagcagccgcagucauaaugggcacugcaggccucagcacguaccucuauaaccgccagcggaagaucaagaaauacagacuacaacaggcccaaaaagggacccccaugaaaccgaacacacaagccacgccucccugaaccuaucccgggacagggccucuuccucggccuucccauauugguggcaguggugccacacugaacagaguggaagacauaugccaugcagcuacaccuaccggcccugggacgccggaggacagggcauuguccucagucagauacaacagcauuuggggccaugguaccugcacaccuaaaacacuaggccacgcaucugaucuguagucacaugacuaagccaagaggaaggagcaagacucaagacaugauugauggauguuaaagucuagccugaugagaggggaaguggugggggagacauagccccaccaugaggacauacaacugggaaauacugaaacuugcugccuauuggguaugcugaggccccacagacuuacagaagaaguggcccuccauagacauguguagcaucaaaacacaaaggcccacacuuccugacggaugccagcuugggcacugcugucuacugaccccaacccuugaugauauguauuuauucauuuguuauuuuaccagcuauuuauugagugucuuuuauguaggcuaaaugaacauaggucucuggccucacggagcucccaguccuaaucacauucaaggucaccagguacaguuguacagguuguacacugcaggagagugccuggcaaaaagaucaaauggggcugggacuucucauuggccaaccugccuuuccccagaaggagugauuuuucuaucggcacaaaagcacuauauggacugguaaugguuacagguucagagauuacccagugaggccuuauuccucccuuccccccaaaacugacaccuuuguuagccaccuccccacccacauacauuucugccaguguucacaaugacacucagcggucaugucuggacaugagugcccagggaauaugcccaagcuaugccuuguccucuuguccuguuugcauuucacugggagcuugcacuaugcagcuccaguuuccugcagugaucaggguccugcaagcaguggggaagggggccaagguauuggaggacucccucccagcuuuggaagccucauccgcguguguguguguguguauguguagacaagcucucgcucugucacccaggcuggagugcaguggugcaaucaugguucacugcagucuugaccuuuugggcucaagugauccucccaccucagccuccugaguagcugggaccauaggcucacaacaccacaccuggcaaauuugauuuuuuuuuuuuuuccagagacggggucucgcaacauugcccagacuuccuuuguguuaguuaauaaagcuuucucaacugcc

SEQ ID NO: 192023 - RNA, 16686 nt, Homo sapiens
cagggugaaagacacuaguuagucuguucuuuauuuuccuuggaaaauuacaggguuacuuaucaacaaaauaacuguccauccgguggggaagugccauccgguggcuucuauguacaggcccaucccugggaaccacauuuccagagggggccucccccugaggcccccauuggcccccucccagguauccaagaauaaaucacauggugacagcugccggcaugggugagugggacccaggccuauuacccggccagaggguuugggggccucucuccuggaagccugcucuuuccacacccccuuucccagccaggcugucuuggacacucccggggcuccgcugaggggcacaugauucccgcuuuggacuucuuuugagaugucauuuuaacacugaggcauccuggccucccuucccggaagauggguuauuugcagugcugucuuuucuuuuagucccgguuuuuguacaaaaacaaugauacuccccauuggacuguauuuuugcccaagaaacaaaagugccucaacagguacaguucugcuggucaaucugcuuccggcagggcuccauggugacagccacgcccaccccacuccggcccgaugucauucgggucaccucgcuccaggugucuguaucugggucguaacacuccacacuguccaggaacgugugaccaucauagccuccugcgggaagaacagaagggauggucaccaccugucacaccacauccaagagcaggggacagaaagagagagaugcagcugugagaugcaaaagcaggccgggcgugguggcucacgccuauaauccuagcacuuugcagggcugaggcaggaggauugcuugaggccaggaguucgaagccagccugggcaacauagcaaaaccuuagucucuuacuaaaaaaaaaaaaaaaaaaaaaaaauggccaggcuugguagcucacgccuauaaucccagcacuuugggagacugagguggguggaucacuugaguccaggaguuugagaccagccugggcaacauggugaagccccaucucuacaaaaaaacauaaaaauuuagccaggcuugguggugcgcgccuguaguccuagcuauuagggaggcugagguggggaggaucaguugagucugggaggcagagguugcagugagcagaggcugcaccacuguacucuagccuaggcaacagagugagacccuaucucaaaauaaauaaauaaaaauaggaaaauaggccacucgcgguggcucaugccugcaaucccagcacuuugggaggccgaggcgggcagaucaccugagaucaggaguucgaggccagccucgccaacagagugaaacccuguaucuacuaaaaauacaaaauuagaugcgauuggugaugcacgccuguaaucucagcuaccugggagacugagguaggagaaucgcuugaacccgggaggcggagguugcagugagcugagauugugccacugcacuccagccuggugacagagcaagacuccaccucaaaauaaauaaauaaauaaauaaacaaaaaauaaaaaaauaaaaauaaaauaaaauaaaggccgggcacaguggcucaugccuguaaucccaggacuuucggaggcugaggcagguggaucaccugaggucaggaguucaagaccagccuggcuaacauugugaaaccccgucucuacuaaaaaucaaaauuggccgggcaugguggcucacaccuguaaucccaucccucugggaggccgaggcgggcagaucaccugaggucaggaguucgagaccagccugaccaacauggagaaaacccuucucuacuaaaaauacaaaauuagccgggcgugguggcgcaugccuguaaccucagcuacucgggaggcugagggaggaaaaucgcuugaaccugccagguggagguugcagugagccgagaucgagccauugcacuccagcaugggcaacgaaagugaaacuccaucucaaaaaaaaauuagcuaggcgugguggcacgugccuguauucccagcuacucaggaggcugagacaggagaaucacuugaaccugggaagcagagguugcagugagccaagauugcgccauugcacuccagccugggcaacaugagcaaaacucugucucaaaaaaauaaaauaaaauaaaauaaaaauaaacaaaaacauuaagcugggcgcgguggcucacaccuguaaucccagcacuuugggaggcugaggugggcagaucaccugaggucaggcguucaagaccagccugaccaacauggugaaaccccaucucuacuaaaauacaaaaauuagcugggcauaguggcaggcgccuguaaucucagcuacuugggaggcugaugggggagaaucacuugaaaccaggaggcggagguugcagugagcugagaucgugccauugcacuccagccuggcaacagacugagacucugucucaaaaaacaaaacaaaacaaaacaaaacaaaaaacaaaacaggccgggcgcgguggcucaugccucuaauccuagcacuuugggaggccgaggcagguggaucacgaggucaggaguucgagaccauccuggccaacauggugaaacccugucucuacuaaaauacaaaaaauuagccuggugugguggcaugugccuguagucgcagcuacucaggaggcugagacaggagaaucgcuugaacccaggagguggagguugcagugagcugagaucaugccauugcacuccagccugggcaacacugugagacaccaucucaaaagaaaaaaaacauuagccgggugugguggugcgcgccuguggucccugcuacuugggaggcugaggcaggaggauggcuggagcccaggcuguugaggcuccagcgagcugugaucacaccacugcacuccagcugggcaacagagcgagaccuuguuucuaaaaaaaaaaaaaaaaaaaaaaaaaaggaaagcaaaagcaaaagcaguccacaaaagaugggcuagucaggacucuuccccgcccccagggccucaccaaggacguagauucuccccugguggacagugauccccagggcacuucgccggugcuucaugggggcuacgaaaguccacgucucuguuuccacaucguagcgcuccacgcuguucagcugguccugaccaucauagcccccagcagcauagauacaguugugcaggacgcagacgccuaaagggcaccaugcagagaaggugacucugggggucuggcuuugggaaccccagccaucaccuccuugagggagaccuuuccucucuccucucccuucucacccucagaaaugaagcggggagagagagaagcuuggacucuaucagaauccagggcuucugugguuaccccagcaugaggguugcaacagggggucucucccaggccuggcucaguuucaccccaggaugguaggggguguuccugggugcuccccucccuaccguccccacccaccugccccgcuucggaugguguucauugcugugaucauucgccacucguuccucucuggguaguaacacucagcugaauuaaggcgguuugucccgucaaagccccccacggcauaaaggagacgauugaggacagccacgcccaccccgauccuucgugucagcauuggggccaccaagugccacucaucccgcucuggcucauaccugcaagggcguaagaaaaauggggacaauggccauuauagcugaccuucguggaauacuuaagggccagauacucuuuuuuuuccuuuuuuuuuucccccuuaaagagacagguucauccggcgcgauggcucaugccuguaaucccagcacuuugggaggccgaggagggcggaucaccugagcucaggaguuugagaccagccuggccaacaugguaaaaaccugucucuacuaaaaguacaaaaauuagcugggugugauggcagaugccuguaaucccagcuacucgggaggcugaggcgagauaaucacuugaaccugggaggcggagguugcagcgagcugagaucaugccacugcacuccaaccugggcaacagagcgagacuccaucucaaaaaaaaaaaaagaaaaaaagagacagggucuugcuccguuguccaggcuggagugcaguggugcaaucacugaagcuucaaacuuuuuuuuuuuuuuuuuuuuugagauggagugcaauggugagagcauggcucacugcaaccuccaccuccuggguucaagcaguuauucagccucagccucacaaguagcugggauaacaggcacccaccaccacgcccggcuaauuuuuguauuuuuaguagaaauuggguuucgccauguuggccaggcuggucucaaacaccugaccucaagugaucugccugccucagcuuuccaaagggcugggauuauaggcaugagccaccacacccagccugcagcuaucaacucuugggcucaaggaacccuccuggcucagccuccugaguagcugggacuacaggugcacaccaccgugcccaccuccacucgaacucuagugcuugcaguuguucuccaaggauugagguaucagcaacuccauuuuccaaaugacaaaacugagccuccuagccaucaauugcucaaguucaaaaacacaucugauaaaccccuaguggcucagccagaucccccacuucacagauaacaagauaacaucucagaaaggagaaaucacacauucagcaucacucuuugaugcucaaagaguccuuuagguccggcacaguggcucacaccuguaaucgcagcacuuugggagguugaggugggagaaucccuugaggacaggaguucaagaccagccuggccaacauggugaaaccccaucucuacaaaaaauacaaaaauuaaccaggcguggugguggguacuuguagucccagcuaccccagggucugaggcaggagaaucacuugaaccugggaggcgagguugcagugacccaagaugcacuccagccugggcaacagagcaagagagacagggucuuacucuauugcccaggcuagucuccuggacucaagcaauccucccaccucagccucccaaagucccugauuauagguaugggccacagugccuagcccaacaauuucaaacugauggaacauuuuccaacuccgcacaaaggaaccauauggguuugugacaguccccuaagcauuucccagccccaggcacagaaucaaaggucacugacuagaacucuccaaggagcuuagcuucauccugaggccuccacucccugaagacaggaagaggaaacagccucaggaagaauacccggaucucagugucuugggacuugccaggagcaggacccuccgagcccacccccaggcccugccacucaccucuccacacuguugugguggaugcagccgugggagccgccgacggcauagauguggccaucgaugacccccaccccgaugcgguuacggggcacgcucaugggggcgcagggcgaccacugauuggucaugggguuguaacaguccagggcgcuggagucgguguugccgucgggcgaguuguuccugccgcccacggcguacaacagcccgcccaccacgcagccggccaggccgcuccgcggcaccugcagguccgccaaccggagccaggugccgucacugggguuguaagccuccagguagcugagcgacugucggaaguagccgcccgcgguguagaucaggcggcccaccuugggcgcccggcagggcaucaccugcgugggcuugugcagggugagcuccucgaagaucuugaccagguaguccuugcagcgggagucggacugcaggaucucgcacuucugcagcugcaucugcaggaaguucggcgucaacgaguggcagcgcacggcccgcagcagcgccuggacguagaaccgucgcuguucgcagucguacuugacccaguugaugcaggcguggaagaccucggacucgcagcgcacguucaggucgucccggcugaugagggucaccaguuggcagugggacagguugaagaacuccucuugcuuggccaccugcagagggcgacagugggacgggcugacucuccagucacccccacaccucaccaagcaggaccgggacaaguaacuuaucacugccgcugacagucucagcuuccuuaucugcuaaauggggauucaaauaauaggaaccgcguacauugugaugacuaaaugaguuaauccugccgggcgcgguggcucacgccuguaaugccagcacuuugggaggccgaggcuggcggaucacgaggucaggaguugagagacaagccuggccaauauggugaaaccccaucucuacuaaaaauacaaaaauuacccgggugugguggcacacgccucuagucccagcuacucgggaggcugaagcagaagaaucgcuugaacccgggaggcgggaggcggagguugcagugagccgauauugcgccacugcacuccagccugggcgacagagcaagacucugucucaaagaaaaaaaaaaaagaguuaauacuaugugccaaguaugucaucaggacucaggaaaaugggcaaagacucaguagaucguguacccugggguaucauuuggcuuugguuuuugagacagagucucacucugucacccaggcuggagugcaguggcaugaucuaggcucacugcaaccucugccucccagguucaagcaauucuccugccucagccucucaaguagcugacauuacaggcaccuaccaccaugccccguuaauuuuuauuuuauuuuauuuuauuuugauauggauucuuacucuguugcccaagcuggagugcaguggugugaucuugcuucacugcaaccuccgccacccagguucaagugauucuccugccucagccucccaaguagcuaggauuacaggagugugccuccagagcagcuaauuuuuuuuuuuuuuuuggagacagucuugcucugucgcccaggcuggagugcaguggagcgaucuccgcuugcugcaaccuccgccuccuggguucacgccauucuccugccucagccucccgauuagcugggacuacaggcgcccgcgaccacgcccagcuaaguuuuuuuguauuuuuuuaguagagaugggguuucaccguguuagccaggauggucucgaucuccugaccuugugauccacccgccuuagccucccaaagugcugggauuacaggcgugagccaccgcgcccggccauuuuuuuguauuuauuuuuaguagagacggaguuucacuauguauuuuuaguagagauggcauuucuucauguuggccaggcuggucucaaacucuuuuuuuuuuuuuuuuuuuuuugagauggagucucgcucuuuugcccaggccggacugcaguggcgcuaucucggcucacugcaagcuccaccucccggguucacgccauucuccugccucagccucccgaguagcugggacuacaggggcccaccaccgugccuggcuaauauuuuuuguauuuuuaguagagacggggugacuguguuagccaggaugaucuugaucuccugaccucgugauccgcccgccucggccucccaaagugcugggauuacaagcgugagccaccucgccuggccagucuugaacucuugaccuuaggugaucugcccaucucagccucccuaagugcuaggauuacaggcgugagccaccggaccuggccuguuuuugcuuuugagacacaguuuugcucugucaccuaggcuguagugcaguggcacaaucauagcucacuguagccuugaacuccugggcucaaacgaucuucccaccucagccuccugagucgcugggacuacaggugugugccaccacgcacagcuaauuuucauauuuuuaugguagagacgggguuucaccauguuggccagguuggucuggaacuccugaccucaaguggcccacccccuugccuuccaaagugcugggauuacaggcaugagccaccguguccggccguuggucuuaaacucuugagcucaaaugauucuccuacuucagccuccugaggauuacaggugugcaucaccauaccuggcuuggcuuuuuuuuuuuuuuuuuuuuugagauggagucucgcucugucgcccaggcuggagugcaggggugcaaucucggcucacugcaagcuccaccucccggguucacgccauucuccugccucagccucccgaguagcugggacuacaggcgcccaccaccacacccggcuaauuuuuguuuuuguauuuuuaguagagacgggauuucaccguguuaaccaggcuggucuugaacuccugaccucaggugaucugccugccucggccucccaaagugcugggauuacaggccugagccaccgcgccuggccucugaguuuucuguuuguuucuuuuuuuuuuuuuuuugagauggagucucgcucugucgcccaggcuggagugcaguggcacgaucuugccucacugcaagcucugccauccagguucaugcgauucuccugccucagccuccgaguagcugggacuacaggugcccaccaccauauccagcuaauuuuuuguauuuuuaguagagacgggguuucaccauguuagcuaggauggucucgaucuccugaccucgugauccgccugccucagccucccaaagugcugggauuacaggcgugagccaacgcgcccggccucuuuuguuucuuuuuuuuuuuugagacagagucucacucugucgucaggcuggauacaguggcgugaucucggcucacugcaaccucugucuccggguucaaaugauucuucugccucagccucagccuccugaguagcugggacuacaggcacgcacaaccacacccggcuaauuuuuguauuuuuaguagagaugggaugucugaguuuauuuuuuaagagacagggucuugcucugucaccuaugguggagugcagaggugccacuguaaccucaaauuccugggcucaugugauucuccugccucagccucccaaagcacugagauuauacgcacgagccaacucacccaucuuguuuuuuaaaaugaaaucauuuucuaaaauggcaaauagacuaaaaaaggaaaaaauaagcaaucacaauagaauguuguggaaaaaaacaagugacagcucugggccagcacagugguucccaccuguaaucccagcacuuugggaggccaaagcaggcggaucaccugaggucagaaguccgagaccagccuggccaacacggugaaaccccgucucuacuaaaaacaaaaaaauuagccagcugugguggugggcaccuguaaucccaguuacugaggaggcugaggcaggaaaaucgcuugaauccaggaggcagagauugcagugagcugagauugugccacuguacuccagccugagcaacagagugagacuccaucuccaaaaaaaaaaaaaguggaagcuccgaagaaaccagcaugaguuggaauuuugauccgaccacuucguagguguguaacuugggcaaaucucugaaaugcuccaugucuugguuuuccuccucuguaaaaugggauuauauuaauggccaccucaaaguaaggcuacuucuaggguauacagagcccuggauaaauauuucuuguagccaggugugguggcucacgccuguaauccugguacuuugggagaccaaggcgggaagauugcuugagcccaggaguuuaagaccagccugggcaacauagcgagaccucaucucuaccaagaaaagauauaaaaauuagccaagcaugguagcucacgccuguagucucagcuacucaggagacugaggugggaggaucacuugagcccaggagcuggaguuugugauaagcagagaucgugccacugaaguccagccugggugacagagugagacccugucucuaaaaaaagaaaaaaaaaaaaaaaaggccaggugcgguggcucacacacguaaucccagcacuuugggaugccaagucgggcggaucacuugaggucaggaguucaagaccagccugaccaacauggugaaaccccaucucuacaaaaaauacaaaaauuaucugggcauggugacacaugccuauaaucccagcuacuugggaggcugaggaaugagaaucacuugaacccgagaggcggagguugcagugagccgagaucaugccacuauacuccagccugaugacagagugagacucugucccccacccccaaaaaaaaaaaaaagggggcuuggcgugguggcucaagccuguaaucccaacacuuugggaggcugaggugggcggaucacgugagguaaggaguuccagaccagccuggccaacauggugaaacccugucucuacuaaaaauacaaaaauuagccagcgugguggugcaccccuguaaucccagcuacuucggaggcugaggcaugagaaucgcuugaacccaggacauggaggcuugcagugagccgaaaucuugccacugcacuucagccugggcgauagagccagacucagucucaaaaacaaaaaaggacugggcgguggggggcgggcgugggcgcagugucucaugccuguaaucccagcacaguuagggaggccaaggcaggcagaucaccugagcucagggguucgagaccagccuggccaacauggugaaaccccaucuguacuaaaaauauuuuuuaaaaauuagcugggcauagugguaggcaccuguaaucccagcuacuugggaggcugaggcaggagaauugcuugaacccaggagauggagguugcagugagccgauacagugccacugcaugccagccugggugacagagugagacuccgucucaaaaaaaaaaaaaaaaguugucaggcacucgucuauguaaucaguuuuaaucuaguaccccauguucauacaaacacaagaaagaaacacuguauauguuucuccuacuguauagaccacuuuccuagaagcugcaggcccuaggacuaacgccagagaacccuggggcgucugaucaaccccacauguaacauagaggguaggaaagaaucuaucccugaaggagagaaauagagaucaguguaacauccaucccagcugguaccagccagugggggacuuagaaaauuuccaggaaggaacaccaagacaugggacucccgaaggcuuagggccuggggcacugcccugcuugccuaggcugaaggguaguacugccucauaggacaguugggaacagucaaugaugcaaaggacauaaaucacuuagaacaggggcuggcccacagcaagugcucaauaaacacuucuuggccugguguugguauggugcuucauaccuguaaucccaacacuacgggaggccaaagccagaggauuguucaaagccaggagguucgagaccagucucagcaacauagcaagacccugucucuacaaaaaaauuuaaaaacuaaaaaauuagccaugcguggugcugcauaccuauagucccagcuacucaggaggcugagauaggaggccuccuugagcccaagaguuggaggcuacagugagcuaugauggcaccacuguauuccagccuggggacagagcaagaccucaucucuucaaaaacuuuuucuuuuuuuuuugagacagaguuucgcucuuauugcccaggcuggagugcaauggcgcaaucucagcucacugcaaccuccgccucccggguucaagcgauucuccugccucagccuccugaguagcugggauuacaagcaugagccaccaugccaggcuaauuuugcauuuuuaauagagacgugguuucuccauguuggucaggcuggucuugaacucccgaccgcaggugaucugcccaccuuggccuuccaaagugcugggauuauaggcaugagccaccgcgcccaggcuuuuuuuuuuuuuuuuuugagacagagucuugcucugucgcccaggcuggagugcaauggugcgaucucggcucacugcaaccuccaccuccccgguucaagcgauucuccugucucagccucucgaguagcagggacuauagucacaugccacuacacccggcuaguuuucuuuuuuuguauuuuuauuagagaugggguuucaccauauuggucaggcuggucucaaacuccugaccucaggugagccacccgccucagccucccaaagugcugggauuacaggcgugagccacugggcccugcccucucuugucaauuucuauagauaauuuccuucacugagaaaugugaaaacgaaaccaaaaacaguauaaggacauuguguggaccaaagaaaacaugacuaagguucagacuuacagcuugcagccugucacggguguccaauaaacauuugcugacugcccgaaaggcugggcuacccuaggauuuggcugcuguucacugcacucugccccacuuugaccccagagaaaccagggagcccagagacauaugaagaccucaccuuccccagcuguucaccagucuccccacauguguagacaaggaacucagaaccccaguuguuuuuuaauuuuuuuuuuuuuugaaacugagucuugcucuguugcgcaagcuggagugcaguggcucgaucuccacucacugcaaccuccaccucuugguucaagcgauucuccugccucagccuccugagcagcugggacuacaggcgcccgccaccaggccuggcuaauuuuuauauuuuuaguagagauggguuuuagcuaugugggccaggcuggucuugaacuccuuaccucaggugauccaccugccucggccucccaaaguguugggauuacaggcaugagccaccacgcccggccccaguuguuuuuuguuuguguguuuguuuguuuagagacagggugucauuauguugccugggcuggucuugaacucuuggccugaagcaauccccccgccucagccccucaaacuguggagacuacaccaccauacccagcccagaaccuccuuuuucuccaguuuccugccuugacaucucaaggggagacagugaugagcacucguccaucccugguccuucuccugacacugcccccagccccacuuccccgcucaccuccccaaaaugcauguagauguacucccgggcacgcuggugcaacuccacacagccaaucugcucagcgaaguuggcgaugccgauggcauugcugggguccagcugcugcaccaggaagucacugcaggcacggacaacgcugucgaucugguacaugacagcaccguucaugacguggaggacacacuucucgcccauggagauggaggccguguaggcgaauucaaugaggcgcuccaugaccuugggguggauacccucaauggacaccaccuccaugcccugcucccgcagcccguuggugaacauggccuugaagacagggcuggaugaggccagcaccaccuugugggccaugaacugggcggccggugcauccugguacuugaccugcagugugacgucacacagcugcuggcugagccgcagcucguucaugaugccaaaggccugcuugguaugauccuccaggguguagcugaaggugcgguugccaugcugggagggcgucaccuccgccuugcacucaguggaggcguacaucaccgcguccccugcccccucagggcacugugacugcaggggcaggaaucggcagcaggccccagccccgcuaggccugggaucuggcugcaugggguuccagaagauaagcaacaccaccaccucuggcacucagggaccuggaggggagagagcacagggcagagggcagggguugggacugggccagcaccugccgggccucguuuugcaagauaaagcaauuccuaggucaguuuuccugcaaaguaggugaagcagaauccauuugcaaacuugcaaacuuccccgaccugaucaaccugauuggcccaagagcccaucuuaaaacauacaugaagucaugucucuccccugcucuggauccuccaaugccucccacaguaccuaguaaaacugaacuccucaacagccugcaaagcccuacgcaauuagccccugccaccucuucccuuugaucacucugcuucagcaaucuggcggccuuucccuuucuagagcauguugagcucauuccuucauuugccucaccauuuacugggcaccuacuguaugccaggcacugaucugggugcugaagacacagcagugagcaaaauacaaaaauccuacccugccagagcugacaacugcagggaggagcaaucauaaacuaaaauaagcaagaccuggaaaaacagcuucaugaagaaaauuacaacagcauugugacaacgugagaaucgggugcaguuuguuugcuuuuuuuuuuuuuuuuuucagauggagucucucugucacccaggcuggagugcaauggcucgaucuuggcucacugcaaccuccgccucccggguucaagcgauccuccugccucagccucccgaguagcugggacuacaggcguccgccaccacacccggcuaguuuuuguauuuuuagcagagacuggguuucgccauguuggccaggcuggucucaaacuccugaccucaagugagccgcccgccuuggcaucccgaagugcugggauuacaggcguaagccaccaugccugacccggggugcaguuuuuuaaaaucuggcagaccaagccucuuugagaaggugagguuggagcugagacaaggaugaaaauuauuauaaagugggaggcuggggaguaguuuuccaggcagaggaaacaguaagugcaguggcucagaggcugagacagucaaucuggagaauugggaaggagugcagugagagcuaaggacuuaaggaaggguuucauggaaaccccuggauccuggagggccaggagaugaguuauguguuuuguguuuuguuuuucgagacagagucucgcucuguugcccaggcuggaguacaguggugcgaucuuggcucacugcaaccucugccucccgaguucaagauauucucgaccgggcgugguggcucacgccuguaaucccagcacuuugggaggccgaggcaggcggaucacaaggucagaagaucgagaccauccuggcuaacauggugaaaccccaucucuacuaaaaauacaaaaaaauuagccggguguggcggcgggcgccuguagucccagcuacaugggaggcugaggcgggagaaaggcgugaacccaggaagcagagcuugcagugagccgagaucgcaccacugcauuccagccugggugacagaacaagacuccaucucaaauaaaacaaaaaaaagauauucucauacuucggccuccugaguagcugggauuacaggcaccagccaccacgaugggcuaauuuuuuguauuuuuaguagagaugggauuucaccauguuggccaggguggucucaaccuccuggccucaagugaucccccuccucgaccucccaaaaugcugggauuacaggcauaggcugcugugcccagacgugaguuacguuucaaaaggagugggggaucuccaaguggcuccccacaaguggaucugcaaguucucacuccccucuuucugggacucaacucaaagucuccucuucccuguuuuauugucaucacugcgcuugucaggaacugaaaugaccuccuuugcuugucuguugaucgacugucucucguccccggccccagcgccucaaauggcagggagaccuauguaggucggcgucgggccaacccucuccugugccucucgccuggggccuggcacugcgcaggggucaauaaacgggugguuggcuaacugcccugccaccgugccugccagagcggccuccuccacccucccugggugccacucggcccccacucuggugccaaggcccuggguuugccucuuggucuuuggccaaucggucaacaaugccccuugggcaccgggcacuucccccacccuacaaagcggcaagugggcgacugcgcaugccccuccugagccuccaccaggcccagugaggcgaggaagugaccccaccgcggccucucggcugccaaccccagaacgcagaucgagccccucaacgccucggagcccccgggccuccuucugcgcagcgccuccugguucucucgcucgguuuccgccgcucccgggccaccccaagaguugcgccguccaacaaaaauauccacccaggucgcgcccuccuggcccuccgaguccuggcggggaacucggaggcgcccugggccguggcgcccguuuuccuggucuccgggcacggccgcaggggcgcucgcggcccgcgaugcccgcagcccgggcacaucccgccucacucaccccgccauggccgcgcuccggcuccgccuccaccgcccgagccccggcgccuccaucgcugcgcgugggggaggcgcggagcgcgcgcaggucaccaugacuaagcaga

SEQ ID NO: 192024 - RNA, 12942 nt, Homo sapiens
aaagauacaacacuauuuauuuuuuuauuuaugucaugucgggugugggaucuugagcucuggcagugaugaugguacuuccuguugucagccccucaagcccagcugcaaccagucuggggccauucagccagggacagagcccacagagcccauacaccugucucccaccagcggggcccuccuggcaggguagggaaggaggaccccgggcaccccccucagggccugacucacguacuguaguuugcacuggacgcccgggcccucccugucccaaagcccccuugggggaacuguggcugcugggggccaauaaagcuguguaacuugaucguggguguggcugggcgcagcguucugaggggauguggggucugggaggugucucgaggugagagcuccaagucacgggaaguuuaagucagccucaguuuccacauccauaaaaugggacgacuuccuuacccacagcuacacguguuuuuuaauuuuuuuuuuuuuuucaagagacagggucuugcuuuguugcccaggcuggagugcaguggugcaaucauagcucucuguagccucaaacucauggccuuaagugaucuuccuuccccagccuccugaguagcugggacuacaggcaugugucaccacauuuuguagagauggagucucgcuaaguugcccacgcuggucuccaauuccugggcucaagugauccuuucaccucggccucccaaagugcugggauuacaggcgugccuggccacagaugagaggaucucugcagcagauaguacuugugggugcgagaccuguccagggcuugauuugaggagaggagccugaggccccugccugcucccuggugcucaggagcuguucuugggccccuguuguuuccuccgcugccggcccagcuggcggaagugcagccguuugggguugaggccaaaggccugcagucucuggcggcugaacucgcauccaccaagcaucacaguggggcccagcagccgugccuucuuggcccuccuccgcuucuggggggcuggcuucuuguggggugauacaggggcuuccucuuccugugcugggggacucuccggccccaucaagcugccaucaagggcuggcagcugccucugugggccggcuucaucucucuguggcuucccuguggcuuccgcaggugucucugcccugagggagaaaagucagggcucagcccaggccugucaagaucaggcccauucuugagcacgcaugccccauuuuacagacagggaaaggaggggcauagugaagcagccgcacagcgaccgagggccugccugggauucagaccuggguuucaggccaaagccagcgcuuuucuacggaacccaaagacuagauugugaggcugaggauucugguauuugugccugggccugcccuaagcuagucacaucaauuaacucauuuuagccuuuuucuuccuuagagacaaggucuugcugugucgcccaggcuggagugcagucgcguuaccauaggucacugcagccuccaacuccugggcucaagcgaucuucucgcuugagucucccaaagugcugggauuauagguuggagcacacaccuggccucauuuuagcucuaaauaaacugugugcaucuaucaccccugccuucuagacugggcgaaagcaauccuaauaacagcuaagaccuauggggcauuuaccauaucuuaaucacuuuacgagaauuaacucauuucauccucugcaacuugauaaggcagaaccgucucuaucuccaucuuaugagaaagaggcccagagagggguagcgacuugcccaaggucacacaacguuggugcccauauaggauucgaacccaggucucagagcggggggcgcugcauucccaaagucaugcaacaagagguugacggagccaagacucaagccugggccugacaggcuccccacccacgcuuccccagccagcacugcuuacucuucucggcagagugacuugaagaccugccgcuuuuuccaugaguucugggccuucuggcuguacgcccgcuugucccgcagcuccuccugcucugaccugcagacagaugccccuguguugggugcucugggaagugcccgaggcugcccgcccugcccccugcgcauguggccccgccgcgccccgccccaucaccuguacaugcaggucuucuuuagggagcaccaccgguucagcuccuuaucgucagcagcgaggaucugcgugggaagggagaguggggaccugcugugauauugcccaggcggggccuucccugagccuaagucaugucauuagucaaaacgguaaugccgcuaccacccagcaggguugccaugauggccagagacagcugaucucuacagaggccaaugauuuuuguagaggucagcagaugggguaacugaggcucagagaacggauccuugcccuaggccagauggcugggaaguuggcugaauugauuccaguuugagccucagggcccuugagcugucacccauacccggccauccccaaagccucagaacgggcaggggucgcugccaaccaccaggcuuccuaauuacauaugaaacugucauucccagccucuaggccuguuuccaaaccuacuggaaggccaucagaaagaggaagugauugaaugccgaugguauaagcuuaguacacaucggcuauuuuuacugaccaugaaaauggucgugcaccuucagccgucaucagucaggcauaguagguacccacagccugccaggugccacacacuuuggucucauuucuguuccuuccauagucaccaaaguuggggugcuaucaauuauugucucacuuuacagauggggaguugaggcacagauaggggaaucauuuguccaaagacucagcuggugagcagccaagccagggcuugaacccaccuaggcccccugguuccagaggacaccaagucuuuuguugagacagggucucacuaugucacccaggcuggagugcaguggcaggcucacagcucacagcagccucaaccuccuggacucaagcaacccuccuaccucagccucccaaguagcuaggacuagaucucccuauguugcucagguuagucucagaacuacugggcucaagugauccuccugcuucagccucccagaguacugggauuacaggugugagccagugugaccagcccugcuaccaagucuuaccagccagacugcugcuaauacauacugacaggaauaaaauaauauuggcugggccugguggcucacaccuguaaucccagcacuuugggaggcugaggcaggcagaucacaugaggccaggaauuugggaucagccuggccaauaugguaaaacuuaucucuacuaaaaauacaaaaauuaauugggcaugauggcacaugccuguaguuccagcuacuugggaggcuaaggcaggagaaucauuugaaccugggaggcggaguuugcagugagcugaguuugcaccaccgcaugccggccugggugacagagcaagacacugucccaaucaaccaaucaaaaaauaaacaaaaauaaaaaguaauauuggcugggugugguggcucacacgcagaaucccagcacuuugggaggccaaagcaggaagcuuguuuaggcccagggaguucgagaccagccugcacaacacaguaaaacaucaucuguacaaaaaauauuuuuaauuaaaaaaaauuaauugggcaugguggcacaugccuguagucccagcuacuugggaggcugagguaggaggaucaauugagcccaggagguuggcaccacugcacuccagccugggugacagagcgagacuaugucucaaaaaaaagaaguaauauuuacggggcgugccauaggugaggcacuguuuuaagcccccaccuuguagaagguaguaauauuaccuuugaggugagguaauguuauuagcacugucauuaggacuauuagcauuucuuuuuuuuuuuuuuuggcgcucugucaccuaggcuggagugcaguggugcaaucucggcucauugcaaccucugccuccuggguucaagcgauucuccugccucagccucccaaguagcugggacuacaggcgccugccaccaugccuggcuaauuuuuuuguauuuuuaguagagacggaguuucaccacguuggccaggcuggucucgaacuccugaccucaggugauccacuugccucggucucccaaagugcugcgauuacaggcaugagccacugcgcccaaccgaauauuaucauuuucaagaugaagaaacagccugccauguuguggcauuucugagcaacagagauugggacucagggccagcuuucuaccccuucggcauaccuggugcccccugcagugucccugccugcccggggccccuaccuccucagugcugaggccaaagucacagggcaccacugugcgguacuugaagcgacagggcaggucgucgaugauguccucguaguccagccgguaauacucauccagguacuccucgaacgucuuguccccugcucgagacagagccaggcugcugggcuaugccaggccccgcggugcccccugccuacccacggccugcccaccugggccucaccggguucaaacacgggcuucuccugccccacggccgcggcgaagggcgacuugcgcuucuucuugcccgucaagggggccucgcgcuuuuucuuccucggcuggcuggggucguagucggcguccaucugccaggacgcacaggucagaucccaccagccccccgucagggccccugggacucccucaacccgugauaccuacguugaaguugggguccucacagugcagcuccugcuggcuccagucucccuccugcucaggcccgucccacgugucccaguuccagucgucuggaugcagggagaacagacagguggggccagggugggaccuugggcuucagucccaguccccaguccccaauccccagcccagugccccagcugaucucaccuucaagcccuucuucuuccucaaauuguggcuucuccuccuccacggccccguaguacucguccccaaagcacuucugcagggucagggcuggcgguuaccagagcccacucgagacauaggagcugagcccccuacgaugccgccaaugacccccuccuuggcaacuuuacuccuacagcuagggcucccuacagcccucccagcaccuagcuccugaggugggaggcccugcauguccaggauccuccgccaacuccccugcugucuacccugugauguacuggccgccauucaguuccacauauccacaguucuucgccguccuacccaccuucgccccuguggugcccaccaccuggugcacuacucaggccccaggucuuuuuuuuuuuugaaacagaauuucgcucuuguugcccaagcaggagugcaauggcacuaucucggcucacugcaacccuugccucccgguuucaagcgauucuccugccucagccuccggaauagcugggauuacaggcaugugccaccacgcccggcuaagaucuuuuuuuuuugagacagcgucucacccaguagcccaugcuggaguacaauggcgagaucuuggcucacuacaaccuccaccucccggguucaagcgauucccugccucagccucccgaguagcuaggauuagaggugcacgccacuacacccuggcuaauuuuuuguaucuuuaguagagauggggauucuccauguuggccaggauggucucaaucuccugaccucgugauccgccugccucggccucccaaagugcugggauuacaggugugagccacugcacccggccaggucuuuuuuuuuuuuuaaaacagaggcucccucugucgcccaggcuggaaugcaguggcaugaucucggcuuacugcaaccucugccucccggguucaagcaauucuccugccucagccucucaaguagcugagauuacaagcauacaccaccacaccuggcuaauuuuuguauuuuuaguagagaugagguuuuaccauguuggccaggcugaucucgaacuccugaccucaggugaucugccugccuuagccucccaaagugcugggauuacaggcgugagccaccguggccagugagagccauguuugugugaacucagcgucauguugggccgggaugagggccgcaccugcaugagcuggucgugcugggcagggucgaagucgucuucaaggucccccuccucgaggcccagcaucucguugccuguuacuuuccgcagcuucuccagcuuggccagaaucuccuuccucuucagguucuucagcugcuugagcucuuccugcuucuuugcuuucuccugcaggcccaggcagagagggggagggcaugggcuuuccuccagggcugggggguccuccccagcucaccccccacacucacccucuucuuucgcucccgagucucuucccucuucuccuuucugcgcucauccuuacggcgcacggaggacgcgaugcugcguggguaggucuugaccuaggcgcaaucagaaaagcccacaagggccgcagagaugaugugggguucccugggccugaacccugggggcugaguccuccccagccccagccacacaccgaugcugaguccggcuccucgaaacggaaauuguacuucuguucaaaguccuccuguuucuucagaaacagcuccccuucgucugaggagucguccacagccagcuggacugggggaccguggacccugaggggcaagauguggugaugccagggggccagccaagugaggucgagccccccuuuccugcacgccuggguacgaagcguaugaacucauuuaauccucacaagaacccuacaaggugcacgcugcuauuguccucauuuuacagauggggaaacugaggcaugaaagucuugaagccgaaccaggauuugaggcagugccaccuggcuccagagccuauacucuguggcucugccuuacagaagacuaacucugccaccaucugugaaaaaaauacacacauggugcccucugccuccuggccagugccgccugggaauacuucaugaagcgcacccaaaaucuagguccuggggagaugcaguggcucaccccuccucuuccuccauuuccucuucaucuuccuccuccucuuccuccuccucauagcguuuguugaggauguaaucccgcaggaaccgcuccccuucauccaacucagggucguuccaguauuccuugagaugcgucugggggugacaggagacaggacucuggucaauggaggacagggaaggagggcaggcaugcucaccacauggaccucacagccagccucuggaguaggugacauuagccccauuuugguuucuuauuuuuauuucgagacagggucuuacucugccauccaggugacaguacagucgugugaucauagcucacugcagacccaaccucccgggcucacaagauccucccaccuuagccucccaaguauuugagacuacaggugcaugccaccaugccuggcuaauuuuuucauuuuuuuguagagccauuuugcuauguugcccaggccagucucaaacuccuggccucaagcaauccuccugccuugaccacccaaagcacugggauuacaggugugaaccacggcacccagccuauccccauuuaaagagauguaggagcugaggcccagagauguacauaucccaucuucagaggguuacuuucuguaaauagguuggauggacgcggaacacgcggucuacuccaucagcgaccaugcgugagaacucaccaguuccuucagggaaucuggguuccgaaucucuuucugucccuucagccacucgauguagucggccuccuccugggccugggggaaagcuagcacugagcauccgcagaugcccagccacccgccacccugucccccagcaguccagucaggccccaguacccaccuucuccugccugguuuuggcacguuucugcagcaaacuggagccgcccuccccagcgccguccucguccucacuguccuccacaaaugcccggaagcugcccacgagagaaaacaagccucaggacaggcaggcuggccccugucugcugccccaguauuuauuuuauuuuguagagcuggggucucacuauguugcccaggcugaucuugaacuccugggcucaagugauccucccuccucugcccaccaaagcccugagauuacaggcaugagccaccucaccuggcuggcugccccaagauuaaccccauuuacuaagcccugagcucuccucucaacaagcucagagcagugcugugauguuauuaaccccguuuaacugaugaggaaacugaagcacauagaaagugacagagcucaauuugaacccgugccuauccaacccccgagccucaacuuuccuccauugggccauucccgcccacccagccucaccuuuccuugagcuguuucuguuccuccacauaacuuugcgacgaugucuccugcagagagggccauaggucucaggccagccccaggccccucagccccccgacccagccuucaccccacccaccuggagucugugauuggaagucuccccgucugaguucuccucaucaacauauuugcuguaaaggaaaaguggggucuucagaauauaucuuccagggcccgccuguccccaugcccaugcggagcagcuauuccaagcaacagcuggcgggggucaucggagggcuauggaaucacugagacuccugcucucagggcuaucugcgauucuggugaguuuccagcguuuuuuuuuuuuuuuucuuuuccaaucaugggugacagcauuucuuuuuuggagccagggucucgcucuaucccucaggcuggagggcaguggcaugaucucggaaaacugcaaccuccaccucccagauucaagcgauucuccugccucagccuccccacguagcugggacuacaggcgcccaccaccacaucuggcuaauuuuuguauuuuuaguagagacgggguuucaccauguuggccaggguggucucaaacucuugaccucaggugaucugcccgccucagccucccaaggugcugguauuacaggcaugagccaccaugcccggccuuuuuucuuuuugagacagggucuuauucuguugcccaggcuggagugcaguggccugaucauagcucacugcagccuccaucuccuggcucaauccuccugccucagccuccugaguagcugggacuacagguacacaucaucaugcccagcuaauuuuuaauuuuuuuguagaggcgggguauguugcccagccuggucucaaacuucuguccucaagcgauccuauugccucagccuaccaaagugcugggauuaugggcaugagccaccaugcccggcccaggcugccagcuuuuuucccucuccugccccuaagacccccauagaccugacagggcugggaaccaggggguggggauguaggccuucuccauacccugccuucuccaagauaaccuuccucucguaguccuucagguacaugggccgcacuuucuucugcuucuccaaggcuucuggguccuccucacugucugaugacgaugcuguuaacccaccaaagacaccugccaucacccacaacccccuucuuugccguggcagagaaucccacagggcagggccaggguuagacagaggauucaaaucccaaauccaccaauucccagcuguccaagaguauugugcuugucaccaucuggugggguuggggucauucagucaguaauuccugcuuugauuauuauuauuguuguuauuauuuauuuacuuauuuuuuuuugagguggagucucauucuguugcccaggcuggagugcaauggcaugaucucggcucacugcaaccucugccucccggguucaagcuguucucaugucucagccucccaagcagcugggauuacaggugcccaccaccgcgcccggcuaauuuuuauauuuuuaguagagaugggguuucuccauguuggucagguuggucucgaacuccugaccucaggugauuugccugcaucggccucccaaagugcugagauuacaggcgugagccaccgcacccggccauuauuauuauuuuuuugagacagagucucacuccguugcccagugcauggcgugacuuggcuuacugcaaccuccgccucccagguucaagcgauuccccugccucagccuccugaguagcugggauuacgggugugcaccaccacgcccagcuaauuuuuguuauuuuuaguagagaugggguuucaccauguuggccaggcuggucucgaacuccugaccucaagugauccucccgccucaaccucccaaagugcuaggauuacaggcaugagccaccaugcccagccugauuaauuauuauaauuaauuuuuuugagaguuggagucuuacucuugcucaggcuggagugcagugucaacauccuagcccacagcucacugcagccuugaacucaugggcuuaagcaauccucccacuucagccucccaaauaccugggacuauaagcgcacaccagcaugcucagcugaguucugaaucuuuuguagagauggggucuugccgccaggcacaguggcucacgccuguaauccuagcacuuugggaggccaaggcggauggauuaccugaggucaggaguucgagaccagccuggcuaacauggugaaaccccaucucuacuaaaaauaacaaaaaaauagcugggcgugguggcacgcaccuguaaucccagcuacuccggaggcugaggcaggagaaucgguugaaccggggaggcggagguugcagugagcccagaucaugccauugcacuccagcuugggcaacaagagcaaaacuccgucucaaaaaaaaaaaaagaaaaaagaaagaaaggcuggcugggcgcaguggcucacgccuguaaucccagcacuuugggaggccagggugggcggaucaccugaaguugggaguucgagaccagccuggccaacauggagaaacccugucucuacuaaaaaucccaaauuagcugggcgugguggcgcgugccuguaauuccagcuacucaggaggcugaggcaggagaaucgcuugaaccugggagacggagguugcagugagcugagaucgucccauugcaacccagccugggcaacaagagugaaacuccauuucaaaaaaaaaaaaagagaaauggggucuugcuauguuggccaaacuggucucaaacuccuggccucaauugacccucccaccucagccucccaaagugcugggauuagaugcuugaaccaccugcccagccugguggaguuggaaucauucagucagcaauucccaccuugaauagugccaaggacacagucauuaacuccaccaccagguaauaaccuaggcucugcuaaggacuugugacuugugaagcaauucauucaauagucaaaacagaugaacuguguaaacuggguaaaucccaaucuauccuuaaaacagcccugaggggagaugcuaccguuagauauacuuuacagacaggaaaagaggcucagagaagucaagucacuucucugaauccacagucaggaaaggaccccggauucugcuccagaggaaggagagguuuagacaggaguggccccggaccuguucuguuauagaagguggcaucuuucugauaaaugcggggguccuucuucuucaacaaggagagcguuuuguaaaagucccgcuccugcuggggaucaaauuccuagggcaggaaaaggguuggggauagauuucagaagggagauaauaagagcccuggcgccagcaggugagcucagcguagggauuaggauggagggggguggaucuggcuggggaggucaaacagguggucaaacagcaggagggagaggggcccucuuggggugggcaggggcaggccacagguagguacaggauauggguagaggaaggugaggggcaaggagaagguaauuccuggggaagacaaagacuugacaaggggcaggugggcugagggcacaagagagacagcggggaggggcugggccaggccgcacaguggggccaggaucagggcugaugugagaaguugggcgccccacguggcgcaaggaguacacuaaaaaauggcuagacucuugaggaugaaagaggaaaggggggguucuugggggacagagucgccccacacaucagagugggcagguggggaucguggcaggggagagaaaauaacggggauuuggcuccccuggggagagggggggcacugucugucccucaugggauggggagcggaggaugggacgcucccgcagggcgcucugggguuggggguucccccccgucuacaucggggucggggugcagaggggggcuuggacgccuccgcacguccaggacggggcggggacgcgcaccacgcgcucgucgcuugaguccgacucggagcuggagucgcugcugcugucucgguccccguagcgauccuucacugcgggacacagacgggaugcccccccccaggucagccggcggggccacucgacuccccacuucccaaccggccggcgcgcgcaggcucccgcgcgcaugcgccccgcacucacgccgcugcaguuccucgcgcucccgguagcgguuguaccgcgcggcaaacgccgcguucacccgcagcugcgacgacccgcgcgguuccggcauggcgguucuguggcccauugcgcacgc

SEQ ID NO: 192025 - RNA, 113858 nt, Homo sapiens
cagcagccaccagcagcgucuucccuuuauuuuaguuuauuaauagaauacagagugcaggcacuuacaguggucaaacugagcgaggagugggugaggucuccucagagagaggccgcccugggcccacccaucagggaggcaugggcgggagcugagaggcccccaagaccccccgccaccaccacccacauagcccaagcccagccacccugggggacccaggaggaggaggaggagaggaauagggcaaggccggcccgggccaacggcuccgggccuagcaaaggcaccucuggcagccgaggcugggccaggcucaggcugugugguuaauauggccgggaaggacuauguacaccucaggccugccagcugggcacuaccgagcccacugggccaggcuugccgcuggggagcuccugcuaaugggaaguugauauaccccugcaccccagcaaggccuggggauguaggcgcccuuggugcccgcacuuauagaaggccugcccuacaugggcuuucccagcccaagaagaccuugguagagucccccccaggcuggaccccucauucaggauggugucaaggguucugguccccccucugccacccugagacuccaucccccaaagugcaacaccccagcgcccccugccuggagcuccagggccccuuugcgcagugcgguguccagccaggcacaggggccggcccuggaccggggccagcguuaaggaagaggccagggcugcccacugggagccuggucccagcauaggggcggcggagggccccagaccacugaagcuccugcgccgcgggugcgugaggcccccccgagagcacgccccccucgaggccuagucgagcagggauggcucggcugggcggauaauggugggccggcugggcgcagcagggggucuucugcugcaaagagaauaaagacagguggggagggggagacggcagugaggccgggagcaagaggcaggccuggguugaggacccagcccccacccacacaccaccccaggguguucccaggcugaccuccgcaagccaccagggugucgggcaggagugccaaaccuaggcaucaacucgccugcuguuugacccucagugagcccccugcccucccugggccucagcuuccccaccggagaaguggggagaauaaagccuggcccacgguagguugaggcaggcaggagcaggaaggagaagaagguaaacagugggaggaggugcccagugugaggguuccccagcugccugguggcacaccccaguaggcagagggcaagcugggagccccggagucaccagggcuccgcuacucugugacacugaacaagccucuuggccucucugggccuguuuccucgcaagccaaauagggaugaggacgauuccuccacuccagcagcugggcacguagugagagcucacugggaggaagugagacaggaggagagaccccagggugcaggcaguugggguggagggcaggggguuggccuuaccugggcacuccugggggaaucccuggggggauccgaacuggccgagaugggaucugaggcggggcugggaagaggucacuguuggcaaacacgcucugggguccaggccgggaugggauugggggcgccgagaaggaggcugcugcccccacgggaacaggaaucagggggggcccuggaguggggccccucacugcugggggccggccagggggguguaugcuggacaccggucggcgcuguggaguggggcugugaggaaggagagggugugagcuacagauacagauggaguaggagcccccgccaugccacuguggcugccagaaccugaggugggggcuggcuauggggacagcgcaggcgcagugggauccucccaccccaaccugagcgccagucccaccuucccuugcccucggcccccucaggcacuucccacucacagggcccccucaggccuugggccugggauccacccucacagccaaagacacuuccagaguccuccagaucaagcccuaauaucucuaggggccguggaaccugcaagcccuguccagacauccagauucccuccugggccucagucccugccaccugcaggccugggugcgauauccuccccuuaaggaacuccauggcucccccagggcucugcaaggcagcccccucugagguucccugcccgacggccucaauggacaacucaggggcggcagcagcucuggccacgccuugcguuugccccuccagagccucccaucugcccuucucugugcuccaggaggcucaucucucuccuguggcugcugccccuccagccucuuaccccagcuuccauuugggcugugccaauggaaggcaccagcagagggcaggcgggguauuuauucacaggguccugcccuagagcuguagggcuggcucgcccccauaccccuucucucccuccuccggccucagcagggcagcagcucccacagugcccagcccugggugccacccuugggcuguguccuguuuccugccaggacccugcaggacacacagggagggcaggaaccugcaggccgaaugcuugaggguaggggaaccaggcuuccggaccuguggcugcuggcgcucuggagccaggugucaucgacaggcggggguacaggcguggacacagugcuggugcugaugucaccgaugauguugagcgccuccuugagggcaugguacaugcgcagcaugucgucccgccgcugugccuggucagccgacuccuccaugaggcugcucuggucugccgaggaguauagguaggccagcagcucgugguggaugaaggccuucgucugcgggcagggguuggggagggucaggcuuguguaucaccccaacccagaacccacagugacugcuggaaaaacaucucucacagggcggggccacccccagacuuuuuugaaaaagagucuugcucugucacccaggcuggaguacaguggcucaauuucagcucacugcaaccuccgccucccggguucaaguaauuauccugccucagccucccaaguagcuaggacgacaggcacguugacaccaugcuuggcuaaguuuuguaauuuuuuuagagauaggguuccaccauguggcccaggcugguuaugagauucuuauucaacuuauuucuaguaucuugccucuuccauugaugucuuuucuccuguuuuagcuuauuuauuuauuuccuuaaccuuggcagaauaauccuguuauaucuuuuuuguuuuugcuuuuuuuuuuuugagacagucucacugucgcccagguuggagugcaguggugcaaucucagcucacugcaaccuccgccucccggguuuaugccauucuccugccucagucucccaaguagcugggacuacaggcgccugccaccacgcccagcuuauuuuuuguauuuuuaguagagacaggguuucacccuguuagccaggauggucucgaucuccugaccuuaugauccgccugccucagccucccaaagugcugggauuacaggcgugagccaccgcgcccagccaauccuguuauaucuuuauuuuuuugugacagagucucacucugucacccaggcugcagugcaaucuuggcucacugcaaccugcgucuccuggguccaagcaauucuugugccucaaccucccaaguagcugggacuacaggcgugccccccaacccccggcuaauuuuuguauuuuuagcagagaugggguuucaccauauuggccaggcuggucuuuaacuccugaccucaggugauccacccgccuuggccucccaaagugcugggauuacaggcgugagugagccacugcgcccggcuaauccuguuacaucuuccaccuggcuucuguucaaacacuacuaguuucuguucaugaauuuuauacauuguccuuucuggaaccuccuacuggauacagaaguuuuucaguuacuuuuuuuuuucuuuuuuuuugagacagagucucccucugucaccaggcuggaguacaguggcaugaucuccgcucauugcaaacuccaccuccuagguucaagugauucuccugccucagccuccagaguagcugggacuacagacgcgugccaccacgcccagcuaauuuuuguauuuuuaguagagggggguuucagcauguuggccaggauggucucagucucuugaccucgugaugugcccgccucagccucccaaagugcugggauuacaggcaugagccaccacaccuggccgucacaacuuuuuuuuuuuuuagauagggucucacuccuaucacucaggcuggaaugcaguggagcgaucuuugcucaccgcagccucgaucuccugggcucaagugaucuuccugccucagcuucccgaguagcugggccgacagauuuauuauuuucuuaaauaauaaaauauuuuuauuuuauaagagucuauuaaaaauggauaauuaugucccaucuuuggcugcuauaaaacaucauggaaaacaauaagcauguauaagcucacuuugcacgugggcaauugucucucuuagagaaguuccuaaaaguaaacuugcagggucaaaggauauaugcauuuuaaauuucauagcagaagaaccguauaugucuccgauccuaucgguauaugaggaaacauaccaggacaccaugaaacugugaacacugaucacuacugagaaugggagcaacagggugggagggcauggcacgugggagguguguguguguuuuaaauagggauggggucucacuauguuguccaggcuggucuugaacuccugggaucgagugauccuccugccaagccucccaaagugcugggaguacagaugugagccaccaugcccagccacacccugugugggaguuuuacuuagauccgcagguuucugugguugacauucauauacaaaacccaagacacuuuuuuuuugaaagagguuccugcuccaucacccaggcuggagagcaguggcguaaucauggcucacugcagccucaaccuccugggcucaagugaugcucuuaccucggucuucugaguagcugggacuacaggcauuugccaccacgcccagcuaauuuuuaaauuuuuuguagagacugggguauggcuauguugcccaggcuggucuucagcuccugggcucaagugauccucccuccucagccucccaaagugcugggauuacaggcaugagccacugcuccggccccaaagcugguuuauaaagcuuccugaguggcuagugccaugccaaaggccugauacacaagugcccugagcccucuagcagccugagcuggagauacuaucaguacagcugcauuucacugaagaggagcccagagcccugagagucuccagggaacccggggccaggcgggugacgcccaugaggaagaggcugggccccagaucauuaggacacagcggcugcccaacacaacccaaggguaugguugcaaccaggguaaacguggguuugaaucccacuucccacuuuccuaaggaacuuggggcagguuacuugaucucucuggccuuguuuucugucugugaaauggggaagauggccguucucccuccugcaguuauucugaugccagccuaaguuaauucagagaaggcgcacaccugcaguguucacuccaguuaguggacuugaugggacuauggacccaguguggcucggaaacccuaggguuucccaaagaggauggccgugcagauucugguguucaaaggguggugauucauucaaauuuguuguugcuguuguuggacacaaggucuugcucugucgcccaggcuggagugcaguggcaugaucauagcucacugcagccucaaccuccugggcucaagugauccuccugccucagccucccaaagugcuaagacuacaaacagguauggccuagggugccuggccuccuucucauuuuuuuuuuuuuuuuuuuuugagauggagucucgcucugucaaccaggcuggagugcaguggcacgaucuuggcucacugccaucuccaucucccagguucaaguaauuguccugccucagcuucccggguagcuggauuacaggcacccgccaccaugcccggcuacuuuuuguauuuuucucucucucucucucucuuuucuugagacggagucucacucugucgcccaggcuggagugcaguggugcacucuaggcuuaccacaaccucugccucuuggguucaagcgauuccccugccucagccuccugaguagcugggauuacaggcgugagcuaccgugcccggcuaauuuuuguauauuuaguagagaugggguuucaccauguuggucagucuagucucgaacuccuuagcucgugauccgcccgccuuggccucgcaaagugcugggauuacaggugugagccaccgcgcccagccuaauuuuuguauuuuuaguagagaugggguuucaccguuuuggccaggcuggucuugaacuccugaccucaagugauccgcccgccuuggccucccaaagugcugggauuacaggcgugagccaccgcacccagcuaccuccuucucauuuuuaguucuccacucacauuguugaucaugaggugcaugauggucuuuggcaugaggucgcggauggacuuguugaugauggccacguaugaguccaccagguugcgaauggucuccaccugccgcuccaguuggggguccauggagaagguguucuccugggccccauccucguuuucugccugcaagcgggaggggaggugcugaggggugacuguggccugggccaaguccugguucucuggaaaccaucugcccuauugucccaccaauaacugaccucaggcuggccccugacagccccacuggcaccagauaggccugcuugcccugggccagagcugcccaaacaauggggugacccuggcugaugcugggguggauccccucaccugggcauuggaacguuguuuuuuuguuuuguuuuuuuuugacacagucuugcuaugucacccaggcugcagugcaguggcacaaacacaguucaccgcagccucaaccucccagggagagcucaagugauccucccaccucagcgcccuggaguagaugggauuacaggggugcgccaccaugccuggguauguuuguauuuuuuggagagaaggguuuugcaacauugcccaggcuguuuucgaacuccugggcccaaaggaucugcccacauugccucccaaaguguugggauugcagguguaagccaccacacccaaccuugggacauuuuauuuuauuuuugagauggagucuugcucugucgcccaggcuggagugcaauggcgugaucucagcucacugcaaccucuaccucccggguuuaagcgaucuccugccuaagccuccugaguaacugggauuacaggcacguaccaccaugccuggcuaauuuuuguaguuuuaguagagacgggguuucaccauguuggccaggcugguuucgaaccccugagcucaaaugaucugcccaccucagccucccaaagugcugggauuacaggggcgaaccacccaccgugcccggcaaggcauuuuaauauuggggccaaggguggccauguucacucuaccucaggauggaaggggaaaagagaagagaacaaagcaagugggaccccauccccugugugccccggucacuggcuuccgugagggaacuuucugggcccugaugacaaaguacccccaauuucuccuuugcuugcucaagugggcaucugcuacaugauuucagagacuccuggcuaacauggccugaaaaugaccuguccuggggaaagccagcccugcuuccucucccaggugggggcucugggccuggcugcgcaggacggcuccucaccugguccuucucgggguagacgccagcucggaggaacgaggccuuccagcuguccacgucuuccugggagucacaggccagcucgaucugccgcagguccuuguagacguuucugcggggggguggggaaggaggggcacaagcuugacccugccaugggucuggcagacugccgagaggaaugggcucuaggggucuuucugacugaucaggaacccaaacccaacccaggcuucaccuggucaugcugaggggucaccgugagugacgccuacacagaagagcgcugugcacaagcucggcaagugucugaguuucuuuguuucuguuggaucagcugacucuucucuuuuccugggcccccagaggugggcaugugacccucgacaccaacuguggcugggaagcucccacuggggcauuuucaggaaagcccagagcagcacuguccaccagaacuuuauuauuauuauuauuauuuauuuuuuuuuuuugagacggaguuucgcuuuuguuguccaggcuggagugcaauggcgcaaucucggcucaccgcaaccuccaccuuucggguucaagcgauucuccugccucagccucccgaguagcugggauuacaggcaugcgccaccacaccuggcuaauuuuaguauuuuuaguagagaugggguuucuccauguuggucaggcuggucucgaacuccugaccucagcugauccgcccaccucggcuucccaaaguucugagauuacaggugugagccacugugcccgaauguguuuuguuuuguuuuugagacagagucuugcucugucgcccaggcuggagugcaguggcgcgaucuuggcucacugcaagcuccgccucccggguucacaccauucuccugccucagccucccgaguagcugggacuacaggcaccugccaccaccccagcuaauuuuuugcauuuuuaguagagacgggguuucaccguguucgccaggaugaucucgaucuucugaccucgugaccuaccugccucggccucccaaagugcugggauuacaggcgugagcccccgugcccggccuguguguuuuuuauaaaaaaaguuuuggcugggcacaguggcucacgccuguaaucccaacacuuugggaagcugaggcaggaggaucaacugaggucaggaguuugagaccagccuggccaacauggugaaaccccgucaauacuaaaauacaaaaaauuagcugggagugguacugcaugccuguaaucccagcuacucgggaggcugaggcaggagaaucgcuuaaaccugggagguggaaguugcagugagccaagauugugccacugucuccagccugggcgacagagugagacuauguaucaaaacaaaacaaaaaaauuuuuguaaaguuuaggcaugguggcucauaccuguaauuccugcacuuugggaggcugagacagggggauugcuugagcucaggaguuggagaccagccugagcaacacagcaacacccccaucucuacagaaaauacaaaaauuagcugggcaugguggugugcgccuguagucccagcuacucgggaggccgaggcgggaggaucacuugagcaugggagguggaggcuacaaugagcugagaucaugccacugcacuccagccugggugggugacagaggaagacuccaucucaaaaaaaaaaaaaaaagaaaaagaaaaagaaaaaagaaccagggucucaaagcugggagauaaauggaauggaugcuaaacagugcuugcagaugguggucuacaggccaggccccgugccacaugccacgcacauuuuccugucccacauccaggugugguuaagacagccaagcugcccacaaagccuuuaagugagaguuggguuuguggucagcaaguggcugccccgaacgaccucuggaugagguuguguggggagaggcaugcccuuguagcuccuccucuccuuccugcugcugccugggacaucaucacaauggcuggagucugggcagccauuuuggacaaagaaguagaagucgggguuuugggccaggugcaguagcucacaccuguaaucccagcacuuugggaggccgagguggguggaucaccugagguugggaguucgagcccagccugaccaauauggagaaaccccgucucuacuaaaaauaaaaaauuagccaggcgugguggugcaugccuguaauuccagcuacuugggaggcugaggcaggagaaucgcuugaacccaggaggcagagguugcggugagcugagaucgcaccauugcacucuagccugggcaacaacagcggaacuccguuuaaaaaaaaagucaggauuucauggcaggccugucccaccgcagagcucggcuucugcauaucagguggaauccugaggaacaugcagggccuggacccugaugccuguggagcugcuccacuuugcccgggauacuaaagucuggacuuaauuuacacaaaaaacuaucaaccaucuuaucuuguuuuugcagcuacuacucuggguuuccugaaccugcucuuaaaagauauaucagauaauauugucacccucccuguacaggaggcacacggcucagggaccugggacagcugccaggugucauauggccaggggcaagccuagaagagcuaugaagguuuucacggccagcugguggacaaaugggucucgagcuuuaggccagccagagcaaagcaggagggaaccaggagacucagcuggaguugguggguguagccaagcaguaggcaaggagguucuggggccagcagggaggacgucagugccugccuacaggucucaggguaccaccgggccuuuacugacagcuaaucccugacucaggugggcccugcuuccuggaugagcgugauugugugagcaugggaagagcccuccugccagcuggguuucuuccugagagcagugucucugcuaaagucuccagcuacgccucaugggacagauguacugugagcuuccuggggccucccauucuccagcuucacucuccugggagcucaucugguuucguuccuugaaauaccauccacgcaauggugacugcccaguucacaucccagacuggagcucguuccuggacaucacacuccucgaucuacccaggugccucccugaugcacccucucccuuggcauggccuaaauggagcucuuggcugucuccaggccuaccugccgcugccuuccccaccucggccaauggcagcagcugggcagugcaggagcucaggcccacguacucagggucacaauuggugccuuucucucucauauccaugcccaccagggcuccgccugacucuucuacccagaaucugcacccuccuucccuauggguucuggccccaucaucgcccacuuggacaaggcagcggccuuugcccucgucccccaucucucacccucucauacuguuucccucucagccaccagagggcuccugcaagcaccugagccagguccuggucacccugugcucagaacucuccauggcucccacugacucggagccugccuucauccucaucucugcccagagaggucaucucugacccagcacgggaagcaucccuggcauuugcuauuucucacgugacuccccuuucuaaaagcugggucccaagggcagggacugcugacagccaggugcucagugcucagugaagguuguggagugugaaugaggccauuggucuucaccccgagccauccccaggccccugggccccucaccucugcuccguguugaagauggcgaagacgugcuuguuggacaugaagcccuucuccacaucacggaucuugagguuguccagaggcagcauguacuucuucucuuucuccugaggguggagggaaaagagucacccugagcgguccacgugacaacucaggaugccccaggccagagcguguagcaugcgccaccaccagccccgggggcuucucaaugcuggucgcugcuguauaugagcccaucugccggcccuuccccguccgucacucugucccagccacgcugcccuccaugaugcucccugaguaucccaccuggguuccuaccccagggccuucggacgaccgggcuacugccugauccugacacuugcauggcucccuccugcccuaacucuacccgcacccuccccaccuccauccuccuuuucccucacacaacacgucacguauccugcgcuuguugaccuaggugccugacugccugugcuuauugaccuagguggcugacugccacuggacugacucaaguuucuccagggcagggacuccuguugaguucacugcugacauguggcugacggcacgcacaacacaacugccccucgccuugcacgaagugaauggaacuuuuaucugggcuccaucuuugaaacgagccuaggagugaguuaccucugugaugccauuuuacagaggggaagacugaggcagagaggagcagggcugggauuucaaccuuggccgcuuuaggacaucuuggggcuggauagguccugggccaggugcugcagaagccuuacucccuuucuuuauuauuaucauuaucauuauuuuaauagagauggggucucgcuauguugcccaggcuggucuuaaacuccuggguucaagcgagccucccagagugcugggauuacaggugugcaccaccgcaccugcccuaucacuugcuuucuaagguuggcccuguucaggaagcaccaagugccagccacggcuguccagacugcuagggaggcagcucagaggugggccccucggccaggggcaaggggcuggcgagucacggagcuggggguggcacccuggagucccacacucacccagugaugugugugcccacccgccacagcagcagcucuuggggacccaugccaugcacugcuuggucucaguucacggaucccuccuagcucagagagggaagcuggcugccgaaggccacacggcaggcagcgcaagccacagcaggacuucagaggccaggucucugugacccaaagcccaguccuccccacagugccccuggcccuucuucucccugggccgucucuggaaacuccucucauguccccucacugcgcugccccagcacaaagccuaaccuggcugccgccuccaaguucaggagcagccacagugacuguggagaaggcagcgggggcucccuggcaagugggggccagcugggacugucaggacuuugcaaggggagccaggaugaagcagugggcuuggcacaugggcucagccucagggcguuaggagcucagcaugguugaggugaugccagcccugcccuuuccuggccgugugcccucgggcaagccacuuccccgccaccucccauuucaucucaguuuccucaucuauccaaggaggauggaggagcuuggugcccacugcagagcuggugcccaugagcacccgggauuuucuuugguugcucuugugagcggcuccaggauuagccugccaggcucuaggcaaagaaguagggcagagcauaggaagaggggcccgguggccauggagggagcagagcauaggagaggggcccgguggccauggagggagcagagcauaggagaggggcccgguggccauggagggagggaugccgcugcggacccaagggagggaaggugaugaagaaagccugcacccgucaucccaggcaaggcuggguaacacagggccugggucccucccaccuuucggggaagaguuuugggggcuuuagaaggggcuaggggagggggcucugcagaagcccugcccccggcucggacguuugcccaagggccuuugcugcccugacccuaucauaucacgcggccggaagcuuccagccagcagggccaaguaacugagucacaggccauuccagcuaaugccacaucuggaacuguuuacagugcgauuccgccgagaaaucaguggccgccuuccuggugcugccggcacgcacgcgugcgcgcgcgcgcacacacacacacacacgugugugugcgccccuccuccccacccccgacccccaaagagucagacauuccuccugagcccagaagccacgaucccaaacccugccuccugcuccgccucccccacucuuuaggauuuccugaaaacccagaacuuucuccagaugcgagccggccccagccuugccacgucagaagggacagagcggaucgucucgggaagaguggugguuuccuuggcugcucagaggugcugaggcacggccuggccugguggccccagcgucugccugggggguucugcaggauggauagccggccccgccaacccaguguucagacuaccuguucaggaggcucucaauguguacaguagucugcacauugguuaggcugggcuugggugagcggcucgucgagacaggccccccaaacucgccggcaggugagugucauuuuccaccaccccguuucccacuguggcagagccucgcauagaagauucgagggccugggugggagaagaggcacuggggaaaggcagagggagccccgaggccggccgagggguuggaggcccuggcccuaucagucugccauccccaccccauggcuguaaaugucuuguuuauuuuuuaaauaaagagauauugaugucuugugucucacugaggcaucuaagaggguggccuccuccucagggguggcugccacgugugugacuccaagggucccugcugggauccuaacuugggugguggcgggggucagguuccauggcugcccccuccugaauggagccugcuuugugucuggggcucacacagggccccuuucacaggucggcuguuucucauuacggccggcgcccggcccuucucccacugcugcuccagacuccaguguggggcuccacgggagggucgggggcucuggcuuucaacucucagaugagaaaaacacgaagggccccucacgugaaggaagaggagaucugaaaacuagacuugcaaugcugccaggcagagagcugccaggcugagguucaggcccagaggcuccuccaaggcucgcugccccaggccuggcauucccacccaggggacccuggaagguccccacagcccugaacugaaaggcagggcaccagcucucagccggccugacagcccacacaccacagcgcaggcugguuucucacugcaaggcggaaagaggggagaaaaagagaaagggcacccuaccccaccccagccauuuugaggagccauccgaucuggacacgugaguuccuagaggugccugaggcggggagaaggcugcagaccacgccuggcuccacacuccucccacaucccaaccccaugagguucgcuggaucugagguucuggaagcuuccacagggaccccagaaaugcuuguaugguggcucagcagacuccaccacccuggguuuagaaacagcgccccagagucccgcagaagccucagggcuccugagguuucaggaacauuccagagaugagcgucuggccucauguggagcgggaugauccuuucacccccaauguccucagucaaggggacaucaggccugggcugcagcggagguguucggaugucgggcuggggugucccucaggucagggagcaugggcccgcagacgugcacuggggaagccuccaccccagggggacccucccccgcuccaugauguggggcaagucaccgcucagagccuuagaugggggugaccacagagccacccgaauagcaagcgugaggguuuccucacggggaguaggguucuccucagguguggccucagugggcucucuuagccaaugagcccagcacagagcagggguccauagccaagaggcccgccucucuuugcuucucccuggggccagccggggccccccagccugccuucucucuaagucugggacuuccaagcccaguccugccuauccuggggcuggguugggugccagcaaguccccaguggggggcacuccuacagagcauucccccaaacccaaggggaagagagccaggcagggcggcuccaggggccucaggcaaccccagccucuccacugagguugccuggacugaguugguggcugugccaucccagggaccauggggacuggccagcuggcccugcaccugacacagccuccagcuccuccucugugcacuggggguagguggguagguucccuccuacagagaggagcugggaggacuugaugcugguaguuaccaggacaaaaccugggacacaugcagugagccaggcacaguccugggcucaaguaccagaauucccccacugguucccgcaguccagaggggacaggccagaguccugacuuuauagguggggagacgagacacgaaggguugacaccacccaaccaauauccuggugacuuccgggugucaagccccagcugucacgcucagaaacaaccaauauccacuuccuucuuagaaagugcuagaacuguuagcuggacucacaguucccacacacagaggcccuucuuucccuucuugggcugcuagaggcuacauggugauggguauggggcagccauuuuaaacuaugaagggagcccuguguuaagguggcaacaggagacgcggagccaggcccuggacagccuugcagcacagggucaccaagcucacugagacgugagcaagaaacagacuucaucucuuuaagagccuucauuuugggccucuguuacagacgcaaauccauugcccacauaacacagccauggcucacaggacagccugcagucuucucccagagcaaccaggacaaugagaaaaacacagcucucuuugccagggacucuugaaagccaaccuggaccgcaucagaguagcaacaagcuaucacacagaaguggcuucccuuccaggccacuaagccaugguuacgucaagagaauuaagcaagaaacggguugaucagggccauagaaaagaaugagauccugucauuugcagcaacaugaauggaacuggaggucauuauguuaagugaaauaagccaggcacaaaaagacagaucuugcauguugucacucauacgugggagcuaaaaaaauaaaagguagaagagcggaucucacagagguggagaguagaaggauaaauacuagaggcugggaaagguggggacaaguaggggguaaagagaggugggguuaauggguacaaacauacaguuagagaaaaggcauuaacuucuauuguucaacagaagaguagggugacugcaguuaagacuauaguuaacaacaauugucugguguuuuuuuuucuuugagacacacuuucacucuuguugcccaggcuggagugcaauggcgcaauuuuggcucaccgcaaccucugcuucccagguucaagcgauucucccaccucagccuccugaguagcugggauuacagguaugcgccaccacgccagauuaauuuuguauuuuuaguagagacgggguuucuccauguuggucaggcuggucucgaacucccgaccucaagugaucugucugccuuggccucccaaagugcugggauuaauggcgugagccacugcgcccagccuguuuuuauuuuugagagggagucucucacucugucgcccaggcuggaguucaguggcaccaucucggcucccugcaaacuccaccuccaccucccagguuccggugauucuccugccucagccccccaaguaacuaggauuacaagcgugcgccaccacaccuggcuaauuuuugcauuuuuaguagagaaggggcuucaccguuuggccaggcuggucuugaauaccugaccccaggugauccacccaccucagccucccagagugcuaagauuacaggcaugagccacugugcccagccaacaaugcaacaacguauugucuauuucuucuucuucuucuuuuuuuuuuuuuuugagacagugucuugcucuguggcccaggcuggagugcaguggugugaucauagcucaccacagccuccaucuccugggcucaagugacccucccaccucagccuccugaguagcugggacuacagguaugcaccaccaugcccagcuaauuuuuuuuggguuuuaauagacacaggguaaugcuauguugcucaaacuggucuugaaccccugaacucaggccauccucccaccucagccucccaaagugcugggauuauaggccugaggcaccgugcccagccuuguguauuucaaaguagucagaagagaggaccugaacuguucugaacacaggaaaaugaggaauaccaaagugacagacaccacaaacacucugccgugaucauuacauacucuguacaucuaauaaaacaucacagggaccccauaaauaugucaaacauuauguaucuuuuucuacauaggaccaucaggagggaugcugggucagcauggagagcagaggccgguuggcaguauccuugcucaaggccugcccccucacucgcagugaacgagucccucccaugacucagcacucaacacugcucccugcagucaucacccaggggccucuccacuuccuucccauaaugacgagcauguggggaucguucugcacacuguggccaagcaccgcacagugggcagggaccauccuagaccacuucgcagauagaaaaacugaggcccagagaggcaaggggccugacugagguguaagugauggaaccccggugccccuggaggcuggcugcaugccugagccccugacccuugggcauggccccuucucuugagcacggggcagucacaguggcacuggaggucagggccuguuucuagccugcuagugacuccaucacccuccaucucccuuuugcacucuaggagcuggucccaugggggccagguacaauguaagccuuuuggcacaugguggcugcucuccagcccuggguuacgguuguuuuuuguuuguuuguuuguuuauuuugagauggagucucgcucucucgcccaggcuggagugcaguggcgcaaucucggcucacugcaaccuccgccucccggguucaaacgauucuccugccucagccuccugaguagcugggauuacaggcgcgugccaccacuccuggcuaauuuuugcaauuuuaguagagacgggguuucaucauguuggccaggcuggucucaaacucccgaccucgugaucuaccugccucgcccucccaaagugcugggauuacaggcgggagccaccgugcccggcgaguuacaguccuaauggugacucagggcagaguggcgcagugacugaguucugcccagagggagcgcccacccgcucuucccuggcugccccaccuaccccagcagcccugcucccgccugccacucaccuccucauccuuguaccaggacagugacucggcagucagcacaaaccaguacuccuuggagccgccuuucaucaggcugauguuguugauggucagccagccccugcggaucaccugggggaaagcgcgcagcuuagcagggaaccucgcuccgugccccagccaucccccagcgcagcagccuugcccacagcucagugggaagccagggaccgcaauagagacaccuccagccccaaagcccaggaaacccaguuccacccugucccaagcauuuccagcaggaaaccaacaugaggcgccaccugggcaggugggcggacagacagacucacugggccaggggcugaugggguauagacucacagaggccugauggaaaggggcccaugggaggagucccuggggcuuguguguggggcuguggcacaugaaaugugacaucugaggaacugcacuuguuugcgugagauaagguuccaaggguagcauccacacagagggcuagggucaaaggugugagcccaggggcccuccccaaggacauugaaggagcgcggcucaugucccaagcuggcugcaagccugguggucauccuuuugacugacacaucaggguuucaggcugggagaccccauggauggggauuguguggcuguagcugucaucugcgugggggucagaacccaggccugcgcagggacucaccugacaacuaacggcaggcagccugggggcugugcucccaugcucccuggccgcuggaggcaugugugggcagagccccccaccccacucaggacgagggcccugggagcugcaggaagcacacggaggcacgcacagggcggccugggacccaggcacugacagacuuggccaagcuacaaagggugggcugagcauggccauggacagcugcgaagggcuggccugcaucccccagugcagggcauggcagggcacggcacggcaggagcgccagagauggggccuccaggaaucccucuggggcccagaugcuguccuagucgggggcgguccucuggaggggcuucauccggacuaccccgacccaccccgggccugacauucugaaccagggccaccagcccacagcuccagcggcuccuugguggcuggaugugagugcuaagccccagguggccaugaagacggagguggcuaaagaguacccagggaccccuggaccaugcagaagucacugcccaggcuggggacagcaugagaugccaccgggcgccccuuguuaaggccaaggguacagacuuaucccucccugggaugagcagacaggacucucacaguuguuuggagcaggcagugaccccuggcaucuggccauucacgggcugccugguggugggugagggggcugaggccagcagccccugugaggucacagcauccccucugggaacgcagugacgagcucuuccuggucuguccaggacguccugguguuagcaccaaaggucuggcagucugggaaugccuccauucacccggggggagcggggugggggcacugccuugucucagcccagagcugggcacagaacgagugcuuaguagacccugguuccaugacugaaugacaaccaggugagggaaaacagggagacaggcugucggugcucccccagagaaaugugaggccuccauacuccuaggccuggcccgguuucuaaggagagggaugugcccgcacaccccucgguggccuggcucuccugccuccagccgggguuaguguuggucagagcuggagcacagggcccacgcuacacuuuggggugcauggccacagggccagggcacugaucggggccaugcuggggauggcacaccaagccuuggggcaggacgucuggcagaagcccugaggugcccuucuccacacggguucagagacaaaaucccacccuagggagcugcaagcuguggguggcaaacaaaggcccguuagccauccaccacuugugagccagagaaagggagcagccaggccucagcagaaagucagguuugcauccaagggacacaucccaaugggacugggcuuagaaggaaguaggggugggagagacagaagaggcggcaggccguugcgggcuagggugcacagugacaggcaggcaggcacauggggcgguauggguggcagggcaggcagggggcggcaaagcagggauccucuggcaggcugcuccagucucuuuccugggugaggguccuggccugagucucccggguagagaugggaaccacagaugggagacccagaggccacggccacgcucaugacggggcugggcuauguggccucugguaggaaaagaggaaccccuaaaccucuugggguacaagggagaagcagguuccuggucuuggccuggcaaauucaaagggacuggggggaacacaugaggaaccugaaaaccacaagcccgaggccaacuaauuccucccgucacugccccacccauggcccuaucugcacacccaggcccugggagcagcgaggcccuggcauaggaucggcucagcuacaagaaagacccugggauugccagaagagccccgccagagggcaguggcagggaugaccagcgccuugguggcuggcagugggagaauguccagcaaaagggagccccugcuaggacuggaggcccaggcugugcuguccaaguguaagagccgggcugaggccggcugccuagaggugagcuccuugagcuggguucaguucucagcuaugaguagcaggcugcuucccgcugggcugggcuggacugggccucacgcccaucucacgccccacacugggccccagcugaggguucugcacaaaggaaggagguguuacccacagcagggauggacagcaaauaugauucaucucgggagccaugucaaucgacugguacaagauaccugaagcacuguggugagaauucugggcguggcaggaaacggugcuaggaucaauuaguguugccugucacaggccaaggauaggagaaaggguaaguggaacagaagagccucaucaauuuaucuggaggacaagaggcagcaucuaggaaagaggcuccugauugacuagucaugccugccaugcauagagaagaggguaucauauagggagaaaaacaauaccuuaaucacuuagccacaucugcuauagaacaggagugcuggcaagcuuauuuggaaagaaugcuaggauugcuuagcaaugucugccaugggcgugugcuagaggagcggcacaaggcaaagagugcuagaucaacuagccaugucugccaugggcacaagagggcaagauuucugccauguggaaaaauaugcucugauccaugagugacaucugcauaggagauagaaggaggaggggcagugccaagaaugaauucuggucuggcuuaagcgagaucuuccacagccagggaugugaggggaggcaggggcgguguguaaguauuugccaucccugaccuacaggaaaccaggaaaaccugccaggaacuggcugcagaagugcgccuucaaggguggcgguccaguuagugccugugugagucgacuuauacccagggcaacgugcaguccagcgccggcugcggcaugggguuuccagguuagcucgauuuuuaguauuuuuguuauuuggaggggauggggaacagggaauauuaggggugggcggggucuccaucaccacuagauucucuaauguuugcuaccacacuaagcauguacuuaccaggaucucccccuuugaauaugcaaaguuaggguuguggguaaaucagggaagagcaggcaaaggaaaagagauggaagggacgugaaggggacaaagaaaaagcaggaaaagcacaaaaacaggagaagagaagagcaggggaaaaaacagcaaaagaaaaaaaauuacaugcuauuaaucauauucaugguguuaauauuuaauucauuauuaucucaagaaacaaaaaagcaacaacauauguauuaccuacggcaagcgcaaaaauaaaucaugcaaugguuacguucuuccuuccaguaggcucuaugaucgugcaagguacaugguggaguccccgcccccaccccugcccaauggggagaagggagggacauaggcagaaauuuugcgaagauuaugguuuccuuuucuuucuuucuuuuuuuuuuuccugauauggagucucgcucagccgcccaggccagagugcaguggugugauccuggcucaccacaaccaccaucuccuggguucaagugauucuccugucucaaccucccgaguagguggaauuauaggcacccaccaucaugccaggcuaauuuuuuguauuuuaguagagacgggguuucaccauguuggccaggcuguucucuaacucuugaccucaggugauccgcccgccucggccucccaaagugcuaggacuacaggugugagccaccgugcccguccagguuuucuuaaaaauuaaugauaaaggcuggcaugauaaucccagcacuuuguccgggcgaggcggguggaucaccuggggucaggaguucgagaccagccuggccaacauggugaaacccugucucuacuaaaaauacagaaauuagucaggggugguggcaggcuccuguaaucgucgcuacucagaaggcugaggcaggagaaucacacgaagcuaggaggcggagguuguggugagcugagaccgcgccacugcacuccagccuugguggcagagugagacucugucucaaaaaaaaaaaaaaaaaaaaaaaaaaaggcuggacgugauggcucacgcuuguaauuccagcacuuugggaggccgaggcggguggaucaccaggucaggaguuugagaccagccuggccaagauggugaaacccccucucuacuaaaaauacaaaaaaauuagcugggcgugcuggcgggcgccuguaaucccagcuacucaggaggcugaggcagagaauugcuugaacccgggagguggagguugcagugagcugaaaucgugccacugcacuccagcugggacacagagcaaggcuccaucucaagaaaaaaauaaaaaaaaauuagccugguguuguggugagcaccuguaaucccagcuacugaggaggcugaaccaggagaaucgcuugaaccugggaggcagagguugcagugagccaagauugcgccacugcacugcagcccaggugacaaugcgagacucugugucaaaauaauaauaauaauaauaagguacugaaggcaggcauugauacagccguucauauuucacaaggccucuagcuggguuaagaugucaagguacaacccuuuguggcucagggcuucuccagguguggggcuucaacuaucccaagcuccccugagcugcuagugacaauguaguuuccagcggcucucaccuaggggcucccaaucccuggggcuguguuggaaagcucaaagaggucacagacccccgcucaagggaaaaauucuuauuuauaucuuuauuauuauuauuuuuggagacagagucuggcccugucacccacacuggagugcgguggcgcaaucuuggcucacugcaaccuccgccuccaagguucaagcaauccuccugccucagccuccugaguagcugggauuacaggcgcgugccaccacgccugguuaauuuuuuguauuuuuaguagagaugggguuuuugccauguuagccaggcuggucucaaacuccugagcucaggcaauccgcccgccucagccuccuaacaugcuagaauuacaggugugagcuaucgugcccagccuauuauuaauuuuuaagaugaggucucauuguauugccccggauggucaugaacugcugggcucaagugacccucccaccuuggccuccuaaguagcuggggugauaggcaugagcccaccacucccagguaauuuuuaaauauuauuauuuguagagacagagucuuucuauguugcccaggcuggucucaaacucuuagccucaagugauccucccaccucggccucccaaaaugcugggauuacaggugugagcuacugugcccagccaagagucaaguucuaacccuggccuuggauggcacauagggccuucuggguggguaaaaugugcccacuaggcccugccagaguguuggcucucaggccaucucccagaauuaucaauuccuaaguggccucuagagagagcagauggccugguacugaggcugugggguggggcuuuacacaggccgagcuccaucacgggggcuuagcugucacuuagcguccucccgcccccaggguagagcgggagacugcagaggggugugcuaccugauuggggauggcucucuucuuguucagcugcgugcuccucugcugggcacugaaaccaaagaacagacaggguucacguggacaagaugccgggggggaagaaggggaagaggcgaauguggccguucucucccuggggaccaagugagcagccacagguagaggcagagagaagcccccugcacacacagagcugcgcaagggaaacggccugggcacacggaacaaguaaauguaucugguucaauugaggcuucuaggcccucaucucagccgacuuacuaaagcgcagguuacuuccagaugucacuagaaucccggaguuucuaaggggaagugugagaagguguugccuaagaugagugcaguggcgcaaucacagcucacugcagccuugacccucccgggcucaaguaguuccccugccucagucucccgaguagcuggaaccacaggugcauaccaccaugcucagcuaauuuuugauuuuuuguagagacgagguuucacuguguugcccaggcuggucuuaaauuccuagacucaagggaucugccuggcuccaccucccaaagugcuggcauuacaggcaugagccacugcaccuggcccuucuuccuacucuucucaucauuugaucccaacaccagccuguaaguggcucuaaccacagagccauccagucuuagacaucagacugugggacagcugcuggucaugaaaugacacauaucuugcaugacuccugacccaaauuuagaggacauccaaggucgacaggguguguuucuauaagguuccuuauucauccacaaucccagaucucuuuucuucuuuauccauccuacuuccuggcuaguucaugccggcauagacaaaucccacuauauuuuauauguggacaccuacuccaccaccuuacgguucuaauauauuuucuacucugacaaucauaucaccacuugcaaacaacauauaucuccuguuacuuauccaucauauuuucuugucuuuucuuauugcuuuggcugaaacuuucagaacaauauggaaaagcaagucagcuuggucaccuuccuuugcugacuaccucggggguuuuguuuuaaaguccaaguuggcuguaggauaagggagaaaguaggcuucuguuucuagaucaggaaaggcuggaaaacuaagaacaaaggcagaauuuuauccagugauauucccaacauucaguaaguuuauuauagggcuucuuaucugggcuauuuauuuacuuauuuauuuuugagacagagucucacucugucacccaggcuggagagcccuggugugaucauggcucagcacagccuugacuuccugggcucaggucauucucccaccucagccuccuaaguagcugagauuacgcaccaccaccaugcccaguuaauuuuuguauuuuuuguagagacaggguuucaccauguuucccaggcuggucucaaacuccugggcuccagcaaucgacccaccuuggccuccugcaaaguauugggauuacaggcaugagccacugcgccaggcuugggcccuguuuauaauauacauuuggagggcaaugggaagcccagaacauucaagcacaagaaggauuuucaucaacagcaucugaaggagguggcacugagcugagccaaccuccacagugauggcugggugacagugagguuccagaggugcuauuuccuaagggccuccuggcucccauccuugccagggcucccucaaauagcagcccacaagguggccccucuccugggccuggaucuaaucagaagcauccuggugucuugggggaaaauccaaaauccuccccuggaccugcagggcccuccuggcgauggggccuggccgcuggcucucuuaccucuaccugccuggucugguagccuuccuucccuggguccaauucucugggucccccuggcaucaccugacuucuucaggaagaucucuccaggccacauucccagcuccccuuucccauagucuauccccuacccucucuuccuacucucaucauccuugugacaauuuguuuaaggacuccaccuccccagccugcaggcucugaaacagcaggggcuacagcuggugcggucaagguccuggcccagaggcccagcacuggcccuggcucugagagagcaccccguagcucuucagcgggccccagggaugucccacccagggcuggggccacccagccagggcguaccccguucacacaccagggcaaaggcacacagcaggcaauacccaccaggucaccagcugcucaguauaguaacagcugggguaagugggaaggcccaggaauccagaggaaagaguggucaaaggaaaaacaggagagauugugagaaggaacuguggaugaagugugagaagcagagacaucaaggugaggaaaacagcagcaaaccaaagauggggaccagcgcugugagcccacacacacccggcggccgggagcacagggccgggggcugccacccacaggcaggggaggcccagucagggacuucggcucaucucuaggagggguucugaugaggcccucauuccuucguuuuccuuccucccuucuccucaccuaccuggugcccagcacggaacagauccucaaucagcuuugucaggugcaccgauaaauguuguaucuggugacuccauagccugagauuuggcucuagaggcccuccccuaggaagccugccugaccccucaaggcaaggcccaguggccgcccucuggacacccacaagcccugcacggccccgcccagcacuaagcacacuacaccuuaacgcccuggguccccaucgguucccugcauguggucuuccucugaggguggggagcuggguguggguuugcccacugcucuaucacagggcccagcgagagggcauaccagcggcaccacccggccugccucaggcaggaaggccugcgugagccucuccaacaaucugagugaggccuaagcaugccaaggggcugaaggaaucagcgggugaugccugagaccacgcacacugaaucgacauccugcugaaaucagggcuccccgaugugggcccucaucugggugccacggaagguucugguuuaaaucuacaguguaugccuugaagcuagggagaccccaggcagcauuucccaaagagcagcuuccggagcccugagcccaugagaugcuguccaugaaguggcagagucugggaaaagcugcacacuggucgcuaaaggcucugagaaguccugaaggagagggggugcagcagcuggcuggcuucccccucucccugcagaucugaacauagcacugcccucucccuaaacuaaccauggggaugccucacagaaggcguguugguuggggacaguggaccacuaucagcccaggagagcuuccagauauucucaguuggcucugccuucaccccaggacccccgacagagacugucugacaccugcccucucagagaaucccaacucagucaccuccuuggaucugagagugaggauuggugccgcccgaccagccagucucuaaaaguaccuacuuggcaaacccgaugaaguccucaugguucguguugauguaggacugcucaaugucgaucagcagaagaaucugggggagagcgggggucacugugaguacaaggccaagccuggcaagggggggcagcggcaagagcauuuccuggccuugccagcagggaaggcgugggaaccaggaggcuucccagacaggagaacaggggcuggcgucgcacuccccacacccucauaggcaacagagccugggacaacagagcacagccacgcagcccaaugugccagucacaggcagggccgcuguccccaaggucuggagucuugauugagccacuaauuggccgugugacccugggccucacguuacugagcuguggaauggggugacaggaggcccaacugccaaggguuuaauaaugugcaguuguuuuuuuuguuuuuuuuuuuuuuuucuucgagacggagucuugcucugucgcccaggcuggagugcagugggacaaucuuggcucacugcaaccucugccuccuggguucaagcgauucuccugccucagccucccaaauagcugggauuacaggugccugccaccacgcccagcuaauuuuuguauuuuuaguagauacaggguuucacugaguuggucaggcuggucucgaaauccugaccucaugauccgcccgccucggccucucaaagugcugggauuacaagcaugagccacugcgccuggcuuuuuuuuuuuuuuuuuuuugagaaaagaacuuacugucucccaggcuggagugcaguagaacaaucauagccucaaacuccugggcucaagcaacccccugccucagcgucccaagaugcuggggucgcaggcaugugccaccacaccuggcugauuuuucuuuuuuuguagagguggggucucacuauguugcccagacugguccugaacuccuaggcucaagugauccuccuaccuuggccucccaaagugcugggauuacaggugugaaccacugcaagccacugccuuguauuuuuuucuuuuucuuuuuuuugggagacagagucucacuguguuacccaggcuggcgugcaauggcguaaucucggcucacugcaaccucugccuccuggguucaagcaauucuccugccucagucuuccgaguagcugagaccacaggcgcacgccacaccaccuggcuaauuuuuuguauuuuaguagagacggguuuucaccguguugcccaagcuggucucgaacuccugagcucaggcaauccaccugccuuggccucccaaagugcuaggacuacaggcgugagccaccguguccagccuguaaagucuuuagcgccuggcguguucaaaguguugcauuaaaacugcgaagcuaauuuguccaauuaugaacacuaaaauaaaacacacacgugcacgugcacgcgcgcacacacacacacgcucaagcuaucaagcuagaaaggucucaugugaggagcagggcuuaugaguccacugcacuugcugaaacucucccucccucauccuucuugucuuuugcccaggaugaaguuggucuaugggaaccauggauccaggcagcucacuggcuugauucccauuuauaacaggccaggcugcuggggaggaggcgcugggaugcgcgucacuggacuccccuggcccuuggccagucacuuccccucacugcaccuccaaguuccugagaauaaaguagggcaaggcacucggaccugucgccugcuggaaaaugccagggugcuccaucugugggagcgagcguggcugguuuaguaaggccugagucuccucaacccagcgcucucagauccggccuggcagcauggcaggugggcaccaggggcuguggaagggccggcagcauucuuaccaacaguaacaacaaaaagaaucagacucuuccagacuuuugauacaauuuccaagcuacagcagcuaugaggcauagguggacuggugcccugagggagcaauuggccaaaucaaaacugggcgccucccugcaggacaaaugagcccauuucauccccaucaauggcaaggggagagggaccauuuuaaacaaagugacauagcaagcaagggcuuaauuaagcucugguuucaacaaacaguuguaaaaagaacacagaggacaacugagagaaagugacucaaaacagaucugggagcaguggcucacaccugucaucccagcacuuugggaggcugagguggguggaucauuugagcuaaggaguucaagaccagccuggccaacauggcgaaaccucaucucuacuaaaaauacaaaaauuagccaggcgugguagcucacgccuauagucccagcuacuugggaggcugaggcugcggcugcaggagaguauaaggacggcccagugcuucgugggugacagucucagcugagggguaggcagcaacuuggggugugugcuugcaugccuuugcaagaaagcguuaaauguuaaaaaaagaaaaagcaggcugggcgugguagcucaccccuauaaucccagcacuuugggaggccaaggcgggcagaucaccugaggucaggaguucaagaccagccuggccaacauagugaaaaucucucucuacuaaaaauacaaaaauuagguggguaaaguggcaugugccuguaguccuggcuacuucggaggcugaggcaugagaaucacuugaaccugggaaguggagguggcagugagucaagaucgugccacugcaccccagccugggcgacagagcaaaacucugucucaaaaaaaaaaaaaaaaacaaaaaaccacaacacaaaaagcaccccaaacacccuccagcaggcaaguggagguccuugcugugcuccauccauucccuggaagauugcuuaguaaucaaggcagcaaacuacagauacaacaaacaacacgcuuggcucccaaaugcagacgccgaggggagggagggagggaagaaggguggcaggaagggagucaagagucaaugggccuuacguugugggaguccacuugaaggacuguaggauagggagcgggcuggugguggccagggccuggggauuuccuuugcugcuucuuuuuuaagagacggggucucgcucugucucccaggcuggagggcgauggcacgaccauaacuuacugaagccuugaucuugugggcucaagggauccucccaccucacccucccaaguaacugggaccacaggcaugcgccaccacgccuggcuaauuuuuuuauguuuucguagagacaaggucuugcuauguugcccacguuggucucgaacuccugggcucaagcaauccuccugccugagccucccuaagugcugggauuacaggcgugaguuacuacacccagccuggccuguggguuuuugagagguugacuacaaaggggcauagggacagggauuuuaggaggugacggaaccgcucuguaucuugauugagguaaggguuacuuugccauaugcagcugucagcaugauagggacagggguuuuaggaggugacggaaccgcucuguaucuugauugagguaaggguuacuuugccauaugcagcugucagcaugauagggacagggauuuuaggaggugacggaaccgcucuguaucuugauugagguaaggguuacuuugccauaugcagcugucagcaugcacagaacaguacacuugacauuuacugcauguaaauuauacccaauaaagaagacaaaaggccaguaccugguccuucguucuccccucccguucccggauguaaguggugacgauucgcucugucuccucucgcaaccggggguaggaacugagcugggggaacaagcagaguggucgcauuggcgggguccucguggcacgggaagcaacaugaaccacacagguagaaaaugcggagggggguggggaaugagauaugagggggcccaccgagcccacaccuugcuccuggcccccagugaguccagcugggagcuaagagcagaagagugggggcaccguggaccggagacagcaggagagcagagcugcuuuuccagccagugaccggggggcaggaggcaggaggcaacaugaaagcagaaaagcaggggcauguuugccaugcagggcuucagggcaccccccucuugcccagcacugggugagagcaggaacccugaagggccucgccagcgugagugaguagcgucuguucuagaaugguaaggcggguaucugggccaucagccucgauaggaacuccuugcagagaaccacuccugaucacuguaucuguggcacacacucgccaaaugcccccaccuccccaggcuucaucugcagcaccaacuuaaccagaccucaugcacaggggagucccaucuucugcagugugggucaaguccacgagucggggaaaauggaaugguuacucucagguggccuagacugugagaacaugcagggcuauacagaugauguguuuccuguguuuugcuguuuuggugcuggcugggaaaccccuuucucuagggguuccaggaaagggcacugcuuaguaaaugcaaugcguuuggcaacaacaaaggcugaccgcccccacgggcagccacaacccacgugugaugccacuccccccauuccaucugccaaugcaagguggcgacaucucuaagugacaacugguaggcggaaggggguuccugccgaggcugaauuuuccagaugcucggguugagacuaacacauggagggggaggacggggacaaaugcggagaugagaacaaaaccuguuaccuucucggcacacuuuuuuaugaccguggccagcucugagaccacgagaucaacacacuucaaacucggcucuuugaguuuuacaaucuguuuuuucacaauggcuucaaaggccaugucgggggugaagagccccguccugggucaugcggagggcaggaugaggcagaaagacacccagggacagugcaggccacacacgcaggacaggagacagagagaagagaagaaacgagagucaucugauuaguccaugcaugggggagccugcgcccgcauuugccccggaagcugcuucggaucaaagaggucugggguuugggggugugggcucggucugggguguaguuacagaagggccacgggggguugucauugcacagacagacagccaaggugugcggaguccucuaacauucauguccaugacaccuggcucuaggacgagcguuuuccaaccuguuuggacuguuuucccccucccuuuucuaaucgaagaagcuuaagcagcaaaugugggcuuuuccagacuaagaacagaggggcucaagcagaaauucccuggcaacccggagcgcuggggacacuguggucgcgcaagcacagacugcccacugggaggcauuucagcugcuuggccaaagcgugcugcccugggaaccaggcccgcggcguuggcgcggguugggggagcccggcgcguccugcugaguggaggcaguggcucgucgagagcgcauagaggcacugugacuaaguggauccaaaaaugggcugccccugggggacagcguggggugcagggggugggcaggggcacuuaggaccccagcuggcucucaugaugucgcuggcauucaggccauucccggagcugagggacagagaagucgguggcuccagggaagucugagaaugccgggcauuggucaagaaggggugacagccagggagcuucaaggagcucagccuccagcaguugacgcggggggucccucucugcuucccaggaggcagcaaagcaacagcccagugaaaccccaauuucaucagacacaugcuaggcuugguaucagggucccagggacaacugugcaucugucuggccaguccaggaggccuggcacuccccugugugccugggcccaggccuacaugcuccugccccagccucuggggagaggccaaguucacggacacaaagcgauauggggagaaaaggcaccagugggggccaaugaggcgcugggagccugauaccaaacccccguacccccguuuccacaaggucaggagucacccugccgagggagcaauaccuuacugguacacugccuaacuguauugauuagcuccuggauaaccaggucgacacauuucagacagggcucuuucagcuugacgaccugcuuuuucacaauggccucgaaugccaaguccggggugaaaagcccgguccugaaaccguccagacccgggggcaggggagauaagucagagagaaacaaagcauggucagcaauuucauuggcccuggccggguccccaacaaggaaugaagguugugucauguguggggucggaugccugaguccacugcccggaaacccucagggugacccgaggaccccacggcgauggaagggcagacaccuggagcaacuaccuuuguuagaauaaggaggggacccaagaggcucacgaggaagccaugauggggacucaugcuggcuucccaaaacccugauucagugccgccccgccccuccccaggcaaaucugcagugagcauucuuaguuuagcaugagguucacaccaaccgacugggcaggaacuaagcccuauuugaucaggagcugcagacagcccugaagccugcaauggacgcaggacuaagacacauccacccucaugugcccuuggagacccucagggaggggcucgcagcuacagaaaaccauccaagagcccucuuaaggccuaacgauuagggacucagaggugugggugacccaauuagcuggggggucgcaccacggagaggaaggaacaguggugacucuccucguggaacuugccugacuccauggauguucuuaauggcauagcugaucucccgucguaaguccuucucgucaaacuccaucugagaagagacaaaccaagcacaugcauggaggcacccggggcgcccccguggcaggcgugcaucuggggaacguucucucccacguguggcuauauucacaaggcagaauauuuaacucgucaaaauuuuauuuaaaaaauugaaaacuggccagauacaguggcucacaccuguaaucucagcacuuugggaggccaaggcaggcagauggcuugagcccaggaguuugagaccagccugggcaacauagugagaccccaucucuacuaaaaauacaaaaauuggccaggugggcuggugcacgccuauagucccagcuacucgggaggcugaggugggaggaucauccgagcccaggaaggucgaagcugcagugagcugugauugcaccacugcacuccagccugggugaaagagcaagacccugucucaaaaaaaauaaaaauaaacaaacaaauuaauuaauuaaaacccaguuucagaaagcaugacaugacaccaacucucucaucauauuggugggaauauaaauucauguaaacuuagauuuuucagacuaucaguaugcaccaccacacccagcuuuuucuuuuuucuuucuuuuuguuuuuuuuguuuuuuuuugagauagggucuggcucugucacugaggcuggagugcgguggugccaucuuggcucauugcugcauccucugccuccugggcucaagugauucuccuaccucagcuucccaaguagcuaggacuacaggcacaugccaccacaccuggauaauuuuuguauuuuuaguagagaugggguuucaccauguugcccaggcuggucuugaacuccugggcucaagugaucaggcccccuuggccucccacggauuauaggcgugagccacugcauuuggucuugcuccucugauuuuaaaaaacuguuuguuuuuuuaauaaaaaaugcuaugugcucauuguaaacaguauaaaacuucaagcaaaucacacacacacacacacacacacacacacacacacggaaaaagaagucccaaauccuagcacccagggcugacauuuuugcaaacauccuugcaaauacaaagaaacacuuguagacagacauccauguucaguuucauacauaaggauguuguauauaucagcucagugcuauguugcacaugcuggcuccaaugccuauuuuuuccuucuucaaugacaugcuagggacaucuucucauguaaauuuaucuguauuuucuauguauuuugcaaagaauguauauuggcuuuugucagaggaaaaacacagggguuuucauauuguucugcccaaaaccucaaagcugagugucagaaaaggaagcccauggggacaccucauccaggccacacccugcccaccacaaguucaggccuagagguaggagcuugagaccuuauugccugggaggaggccuggcuugaggccagcaggagggugccugaccagagacgggagggcccagccccggggggcacuaccuucaccagcucaaaugggaaccgcucguggaagaugcgauugauucgggcgcccccggagagcuccagaguguccaccugaucuccugagcccucgauccucuucucaaaauccaccccaaacugcuggaccauccuaugaggaaaaggaaaaagcaagcaucaaaacggagguuuccacacuacucuggaaugauguuccaagucaagccaggguuuacuguucuuuuaccauuuuucagcagcaaaaugucuucugucuauauuaagacaaauaaaccaaauucaagagcucccaauggcaaaugcuggcuacgagucaggcucaagcuaagccuguuccgauuauucacccauucgaucugagaaggcccacuuauuccucccacuuugcagaagacaggagugaaguucaggggucaaagcucagcaccucugcccugaagcucaacuugauuuacaggaugcugggaaggaaagguagccacuuccccacaauucagguggcuuccauagguucccgccaccucccagccugcugggguugguccugacccaucgaugggaugugaggccuuggacaggacuuugccccucugagccuccgauuccucaucuacaaaauggguugaggguaacaacaucuaccuccuucguggagacugaagauguuuuuagaucucauuaccuccaagaagucacugauccuaaaaugcacuguuauuuugugugcccacaaaaaaagaaaaaaugcugccacuaaugguaauucugcaaagacaccugguuucacacaaguuaaaauguuuuauuggccgggugcgguggcucaugccugcaauauuagcacuuuaggaugcugaggugagaggauggcuuuagucugggaguucgagaccacccugggcaacacagugagaccacauuuuauuaaaaaauauauauauauacuggacacgguggcucacaccuauaaucccagcacuuugggaggcugagguaggcagaucaccugagcccaggaguuugagauuagccuggacaacauggcgaaaccccgucucuacuaaaaauacaaaaacgagcugggugugguggugcacguuucuagucccaguuaaucgggaggcugaggcaggagaaccgcuugaaucuggguggcggaggcugcagugagccgagaucgcaccacugcacuccagccugggcgagacagaguaagacccugucucaaaaaaagaagaaaaaaaagaaagaaaauuuuuguugguaaacaauugcucaucuaauggacaaaaagugguaauaacaugugucgccccuuagaacgggccuggcccuuaaaaagagucucucagcauugccuauuggcaucgugaauaguaaaaaaguaggaugaucuuguucacguuuuaguuuuccuaagcauuccuaauugcucuccuuaggguacugggcugucucccuucaucaguuucccucccaaaaaucaugaucuacugaaguaccuggggacuugcuccuaaaggggaacugcucaaauggugaccacugucagggccaccaaggcugggcugccaaagaaaggggggucuccuucauaccccaacugggagaggcaagcacaagcugcccagauccccaaaaucucuuuccucacaugaaguaaagggugugcacauuuaauuuccuuccaggagacacacaaaggccuagguuaaugcuucaccuggaauggggaauuuguuuuuuuuguuuuuuguuuuuugagcuggagucucacucugucgcccaagcuggagcgcaaugggacaaucucagcuuacugcaaccuccgccugccggguucaagugauucuccugccucagccucuccaguagcugggaauacaggugcccgccaccaugcccagcuaauuuuugugcuuuuaggagaaaugggguuucggcauguuggccaggcuggucucucaaucuccugaccucaagugauccgcccgccuuggccucccaaagugcugggauuacaggcaugagccacugcacccagccuggaauggagaauuugaauuguggaccaaaccaggaccaaggucagcaaaggcauagcacuaaacuaaugacagacaacagacugggcgacggggggagggggaggguuaggcaaggauggagacucuggggaccugcucucagccacaggggacaaagcacaccugggcaccagccuccugggggcccuggaggugauuuacaggcccaacccacgcugcacaaucagagcauucuggacaauugugaccggcuggucggugucccgcggaauucggguugaauccugccccccuguaccucggaauguacucuuauuuggaaacagggucacugcagauguaaucagucaagagaauaucacagggugugcucauagccaauauaacugguguccuuauaaaaagggggaguugggcugggcaugguggugcacuccuguaaucccaucacuucgggaagcugagguaggaggaucgcuugagcuaaggaguuugagacagccugggcaacauagugagauccagucucuagaaauacuuuaaaaauuagccaggugcuguggugcacgccugaggaucaggcuacucagguggcugaggcagaagaauugcuugagcccaggagguccaggcuucagugagccgugauugcaccagugcacuccagccugggcaacagaacaagagaccuugucucaaaagaauaaaauaaaauaaauaaaaauuaaaaaaacaaggccaggcguggugguucacgucugcgaucucauaguuggaaaguucaggcaggcgguuugcuugaggucaggaguuuaagaucagccuagguaacauagugagaccuugucucuacaaaaauacaaaaauuagcuaggcaugguggcgcauaccuguauuauucccagcuacucgggaggcuguggugggaggaucaccugagcccaaguggugaggcugcggugagccgggauugcaccacugcacucuagccugggcaacaaggcgagaccccguuuaaaaaacaaauacaugagguccgggcaugguggcucaugccuguaaucccagcacuuugggaggccgaggugggcagaucaccuaaggucaggaguucgacaccagccuggccaacauggugaaaccccugucuuuacuaaaaauacaaaaauuugcugggugugguggcgcaugccuguaaucucagcuacucaggaggcugagacaggagaaucgcuugaaccugggagguugcagugagcugagaucaugccacugcgcuucagccugggugacagagcgagacucuaucucaaaacaaaaacaaaaaaaaccaccaaauacauaaauaaaauaaaaugaaaaauuaaaaaucaauuuuaaacacguauguuccuuaacccaagaucccucugcuggggucuuugcccugcaggaauccuugccuguacagucacagaugaacuuacaagcaucgguuaaggccaaaaacaaacaaacaaacaaacaaaaaaacccuggguguccccaugggcacugggauacaugaacagucugugggcugcaccaggcggagacagaaggcuccaggcuuugcuuuaacaagaagagaaaagccaagugcagaauucaggcugggggaagucuauuaccguaauucccguucucuuguaaggcgugaaccgagaaagaccgcccaugucugcaugaggaccuuggacccucagauaaaaugcuaaagcaagaaggcccagcucuugacaggagacacagauaacaguggcgcuucuccauggugagagugccugggcagggagggcccugcaaggcaacugguuacaaaugacguaacgugcuaagccccgggggacagggacuguuugugaugggcauccccuggcccaguccugccauaggcuuaacaaguaguauuuaaauuuauuuauuuauuuauuuacuuauuuauuuuugagauacagucucgcucugucugcccaggcuggagugcaguggugugauccuggcucacugcaaccucugacucccagguucaagugauuguccugcuuuagccuuccaaguagcugggacuacaggugcccaccaccacaccuggcuaauuuuuguauuuuuucauagagacaggguuucaccauguuggugaagguggucuugaacuccugaccucaagugauccauccacugaagccucucaaagugcugggaauacaggcgugaaccaucguccccagccuaauuuuuuuuuuuuuucuuaauuucagagacaggaucccacuuuguugcucacgcuggucucaaacuccuggcuuuaagcaauccuccugacuuggcauccccaugugcugggauuacaggcaccuuguaaucugccaguuuguccccauggccaugugagaugacagcugcuaugacccucacuuuagaggugcagaaaaugaggcucagagagguccaaucaccugccuguggucacccagcaggcccagguccacccuuaggcugaauccuccacaacaacacuuccuucagucuaguaggcugaaucuuguguuuuguuuguuuguuuguuuguuucuuuguuuguuugagacagagucuugcucugucacccaggcuggagugcaguggcacaaucuuggcucacugcaacauccaccuccuggguucaagcgauucuccugccucagccucccaaguagcuagaauuacaggggugcaccaccauccccggcuaugaauuuccuccugaagccugcaaagggccacuaucugcucuguagaaaguguuuuguaacguagucaaggcugucugagcauaaaagcacucuggccccuuagcccacgaccaugcacuacugccuggcagaggggguggggggaugccagggcugugauggccagaggaggcgguguccuccuggugucccugugggaagugccucaugcauggcacugucugcaguaugagcuacccaggugucccugucaccugcucugguccagcuguuccagugccucaaggucccuuacaggccaaaagccaaaaggucagaggcagaagaguccccgagugagaauuugggauugugggggcacaccugcuucccaaucucacagcuaagcagcugcaccaaccaagucaugggguggaucuuaagaggccaagcuggagagggaccuaaccuagccaaggucuggcucccacccgcucucccaugucucuucucccaccacggcuagggagccugugagcaccugagucaguccugacucuccugcgcucagaacuguccauggcucccaccucacucacagcaaaagccaauguccucccugaggccccacaaggcccugcacaaccugcucuaucaccuccucccacuccccucacucacuccauccagccacagggucuuccucugacaugcccggcccaguccugccccagggccuuugcacuggccgggcuuaaucccacacggcuccugcccugcccucaccugcuucaggucuucgccugacacucaacuucuuuuuuuuuuuuuuuuuuugagacggagucuuacucuguugcccaggcugauaugcagugacacguucucagcucacugcaaccucugccucuuggcuucaagcgauucucuugccucagucucccgaguagcugggauuacaggcgccugccaccacaccuggcuaauuuuuguauuuucaguagagacagggguuucaccauguuggccaggcuggucuugaacuccggaccucaagugauccucccgccucggccucccaaaauguugggauuacaggcguaagccaccaccccuggccaacacucaucuuuuuuuuuuggagacggagucuugcccuaucacccaggcuggagugcaauggcacgaucucggcucacugcaaccucaaccuccuggguucaagcaauucucuugccucagucucccaaguagcugggauuacaggcaugugccaccaugccuggauaauuuugcaauuuuuuuuuuuuuuuuuuugagacagucuugcucgaucacccaggcuggagugcaguggcgugaucucagcucacugcaagcuccgccuccuggguucaugucauucuccugccucagccuccuguguagcugggacuacaggugcccaccaccgcgcccggcuaauuuuuuuguacguugaguagagacaggguuucaccguggucucaaucuccugaccuggugauccacccaccucagccucccaaagugcuaggauuacaggcgugagccaccgugccuggccuuuuuucuuuuuuuuaaacagagucucacucugaugcccaggcuggagugaaguugcgcaaucucgacucacugaaagcuccaccuccuggguucacgccauucuccugccucagccucccaaguagcugggaccacaggcgcccaccaccacgccuggcuaguuuuuuguauuuuuuuuuugguagugaugggguuucaccacguuagccaggauggucucgaucuccugacaugauccgcucgccucggccucccaaaaguacggggauuacaggugugagccaccaugcccagccuaauuuugcaauuucaguagagacgggguuucaccauguugaucaggcuggucucgaacucccgaccucaggugauccacccaccuuggccucccaaagugcugggauuacagacgugaaccaccgcuccuggccggccaaugcucaccuucuaaaggaggcuguucccgacaacucccacacuagcaccacuuucauauuuugacauuuaacacacuauacauuuucuuucuuguuuuuugucccauucgucccacuuccccccauucugagcacuccaggggcagggacggacaccuguccccuccacuggggcgaaugccaugcuuaggauggagccuggcacgcagaaggcuugcagcaagugucugcugaaucaaugaguggacgagugaugaguggugcccagccuagggggcccuguggcugauggaaggcaggggccagggugguggugguggugggugccgggguacauacugcagcagggcuuugguuuugcggguggggucgucgggccgaaaguucuuguacuccuccaccuccuucuccagggacagcagcuggcucuguaguuugcuacguagggccggcagcgacucccggaugugguuggucaguugcugcaggagagaggucagagaucagaaaggguggcaugggcaggauaccagggaguggcagacacacuccccccaaccaagggccaacaccagggugccacuaugcggccaccacaccacacagccuugagagacagcaacagauaaaucaagccacagacacacucaugucugggaacggagacggcacggagcugcccaugaguguaagaggcuacaaacagcccacggggccgacaucaggcacugggccuauccacgccuuggaggacaagcaacagcuugcaaggacaguccauccagaccacggaaacgggggccaaugaacacacauggggacaggcccuacaaacuaagauggaaagaucgccccugaaaagguggagaaugcacucaagaugagcuccccggcugcaucugcaucuacagagaaaagcaaggaagauucaaaauagacaaaugugggccaggcauggugguacacaccugcaaucccagcacuuugggagacugaggcagaaggaucacuuaagaucaagagaucgagaccagccuggccaacacaaugaaacccuguuucuaccaaaaaauacaaaaauuaucucggugugguggugggugccuguagucucagcuacuugggaggcugagaaagaacucgggagguggagguugcagugggccgagaucacacaauggcacuccagccugggugacagagcaagacucugucucaaaaaaaaagaaaaagaaaaacaaagccauaaaaucagccuauacuugcaaaguguaaagcagaguuuggccaucuguccuacaacagagaaagcugggugcaguggcucacgccuguaauccuagcacuuggggagguugagacagaucacuagaggauaggcguuugagaccagcccaggcaauauggugagaccuucucucuacaaaagauaaaaaaaguuuuaaaaauuagcuagguguggcagcacacaccuguagucccagcuacucaggaggcuaaggcaaaaggaucgcuugaguacaggaggcugaggaugcaaugagccguguuugugucacugcaauccauucuggacaacagaguaagaccuugucugaaaaaucaaaaaggcugggcaugggccgggggcaguggcucacacuguaauuccagcacuuugggaggccaaggcaggcagaucaugaggucaagagaucaagaccaucccagcuaacacggugaaaccccgucucuacuaaaaauacaaaaaaaaaaaaaaaauuagccggguguggugaugggugccuauagucccagcuacucgggaggcugaggcaggagaauggugugaacccgggagacggagcuuacagugagccgagauugugccacuguacuccagccugggcaacagagcgagacuccaucugggguugaggggaaggccgggauggguacaguggcucacgccuguaaucccagcacuuugggaggcuaaggcgggcagaucaccugagauuaggagacaagccuggccaacauggugaaacccugucucugcuaaaaauacaaaaguuaguugagugugguggcgcacgccuguaaucccagcuacuugggaggcugaggcaugagaaucacuugaaccugggagguggaggcuggagugagcugagaucaugccacugcacuccagcccgggcaacagagugaggcucugucucaaaaaaaaaaaaaaaaaaaaaaucaucaaaaaaauaaaaaauaaauacaaagugucuggcgagcuagaaaagaggcaugaaggaaccucacaucuauggcauggagcaagugggguaacccaaagaccuccgugaccaagggucccugcccugcagcccuggccaucgacccccgucuaugugggcugccuagaaaggcagggagcuacgcuggccuucccuuggucugugacaggauacuagggcacuuaagucaugagcaaauggagaggaaggggcgcugcugcucugggaagcaccccacguggaaggaggcugagcccccuccaggcucccuggaggccagcuggacuuuucacugcuggcucucaggaggccccagccagcugcggaguuuuacuucccuuccucucccuacucccguuuguaagcaccccagcuuccucuccuggagggccccucccucuagacacugacuucccucuuugcucuccugagcugccuucucuggguggcucuuuucccggcccccgcgccccuacuggauucuugaucgugcauuuaucuggcgguuuguugggugucagucucccccauuagaauuaugccuucuacaaggacaggaaccuacucucguguggacacugugucccccugauaugugcaugaaaagaugacugcuggagugcugcugaggcccugcugccacccuggaaggugcuagaaaacagcgaggaggagcgucuugccccugcuaccacacacuggcccacuguauagcuuuuaauaccauuucuguuuaugcaccaugugaaucaauuacuuacaagaagagaacgauaggccaggcaugguggcucaugcuuguaaucucagcacuucaggaggcugacacaggcggaucacucgagcucagaauuugagaccagccuggccaacauggugaaacuccaucucuacuaaaaauacaaaaauuagccaggugugguggcacacgccuguaaucccagcuacucaggaagcugaggcaggagaaucacucgaaccugggacguggagguugcagugagccaagaucaugccacugcacucuagccuaggugacagagugagacugugucuccaaaaauaaaaaauaauaauaauaauaauaauaauaauaauaaauaaaaaagaguuauuaacccccugucaccaaccccaggcaaugcauacagucuucuggguaaaugacugaauaauuacaaugauaauuaaaauuuugguaauaauaacagugaugguuguaauaguagcagcaccaagucacugaacaucugcucuucaccagacccugaaucaaguacauuucuuuuauuuaguuauuuaaguuuuugaaacagggucucacucuauugcccaggcuggagugcaguggcaugaacauggcucacugaagccuugauuuuccaggcucaagugauccuccugccucagccuccugaguaccugggacuacaggcaugugccaccaugcuuagcuaauuuuuucuauuuuuccuagagauggggucuccauauguugcccagacuggucucaaacuccuaggcuaaauguggacugaacccauuuugcuaaaacaagugcugcucuagccugaaacaagugccagugaggauugcagcuguugugcagugcacagccuaugccacugcacacuacgugcaaacccuugcaguaccugauucagcgucuucugcagauguggcgugcccaugcggucggccaugugccgguaggccgggugggagaggaagaacuuccucucagcugccagugcugcacggauguccuucuugcccucaauauccuucuggcugcgguucaccacgccaauguagccuguggggagaggcagucaggucaggggcaaagcuaggugagccaaguggaccuggcacggggaugggcaagauucaaguauagagauggauccugucccacgaggcacucacagcugucauaacauguuacucagaaacaacacagagggugcgaaugcacauggcagcugcgaagagcaacauuaaguauuuggaggaaggagagcucacauccagccugugugcgcagggacagaaaaaagcuuuggggcagaugaaaucuacaagcugagauucaaagauaggugagaaaaaaaucucggccgggagcgguggcucacgccuguaaucccaucacuuugggaggcugagguggguagaucacaagguaaggagcucgaggccacccuggccagcauggugaaaccccgccucuacuaaaaauacaaaaaauuagccgugcaugguggcgcgugacuauagucccagguacucgggaggcugaggcaggagaaccgcuugaacccggcaggcggagguugcagugagccaagaucaugcaacuacacuucagccugggcgacagaucaagacucugaauaaaaagaaagagaaaaagaaaaagaaaaagaaaaaaaaucucaaggccaggugcgguggcucacgccuguaauuccaacacuuugggaggccgaggcggguggaacgcuugagcccaagaguuccagaccagccuggguaacauggcaaaaccccaucucuacaaaaauauacaaaaauuagcgaggcgugguagcacacguguauagucccagcuaccugggaggcugagaugggaggaucaccugagccugggaguucgagguugcagcaagcuguaaucaccccacugcacuccagcccgggcaacagagcgaggccuugucucacaagaaaaaaaagaaauaacaucuuaaaaacaagagcaauagggaagagcuaaaauccacuaucaaacgaguauauuuuaaacaguuggguacaucaggguauucauguccagagagaucaauggaacugaaaagaaaguccaaaacuacaccgagaaggagguagaacugaaaguuaacgcuucaguauaugggggagaaaagcuggauaauucaauacacacuguugcaaagaauccaaguggaaugccuaccauugcacuccuggcuagguuuuuguuuugugggguuuuuuguuuugagacagaguuucacucuugcugcccaggcugaagugcaguggugcaaccucagcucacugcaaccuccaccuccugagcaucugggauuacaggcgugcgucaccacgccuggcuaauuuuuguuuuuuuaguagagacgggguuucaccauguuggccaugcuggucucgaacuccugaccucaugaucugcccgccauggccucccaaagugcuggaauuacaggcgugagccacagugccuggccugugcucccuuuucuuuguagugggguugugcauguuucucuugagaagcaagggagaggugccggucaucuauccuguagggucuugugggaugugacugcucuucauccucgccagaucucucuuggauccaagagggaggagggaaacgaagacaugccaaggugaggucacaguaggagacccaagaucugaaccuagaucccugugaagccagagucaccaucaccugugugacagcacaaagaaggaaacagcaggggccaguaaaaagcaucuggcuuggauuuggcuugauuuacuuaauuaagagauggagucucgcucugcugcccauucugcauugcaguggcacaaucauagcuuacuacagcuuugaacuccugggcucaagccauccuccggacucagccuccugaguagcugggaguacaggcacgugcaccaucacacacggauuuuuuuuuuuuuuuuuuuuuuuaaagacagagucucacucugucacccaggcuggaguacaguggugcaaucucagcucacuacaaccucugccuccuggguucaagcgauucucaugucucagccucucgaguagcugggauuacaggcaugcaccaacacacccagcuaauucuauuuuuaguagagcugggguuugauccacccgccuuggucucccaaagugcugggauuacaggcgugagccacugugcccagccuggauaauuuuuuaagagagagauggggucuugcuguguugcucaggcuggucucaaacucugggccucaagccauccucccaacugugcuuuccaaaauccugggguuauaggcaugagccaccacgccuagccuggguucccguaaaggaggaggaguugugagucauuaguacgccaggaaaaaggguccagugggagggcuucugaagccugaggucacaaaacgggagcaggccuacaagugagcugagaguggaagcgccuucguucuuagaaacaggaaggaaggcagagaagggcagcuguggacaucagugagucaggaggaaggggaagaggcccauaucaccaaauccucagccuggcuagugcccacagaccccaaaggcccuuaggauccaagauggaggccuaacaguguccaagggcagccgggucgggguggcuguaguagggcgugggguuggguagggucugcuuuccucucuagcaccagcaaauccuccccaaaccucagccagccacagauuugcuucucagccccggaucuucacagcuaaacaggguuuugaauuuagcccugacagcauuccccugggauccggggucgccucaccacucaauaucucagcagugcugggggaugcuggcaaccaaggucugaacuuuuccccacaucuaucucagacaucgagguggaaaacccaggaguaaaagaaaugcucuaaaugacugcggcuaagcaugaagggaaaggcaggaggugcccgcagcuuagaguagaugccagaggggaggaauggcuuuaaaaaaacacaaaagaaggcugggcacgguggcucaugccuuuaaucccagcauuuugggaggcugaggcggguggaucacaugaggucaggaguucaagaccagccuagccaacauggugaaaccccaucucuacuaaaaacacaaaaaucagcugugugugguggcgagugccuguaaucccagcuacucaggaggcagagguugcagucagcugagauugugccccugcacuccagccugggcaacaagaaugaaacucugucugaaaaaaauaaaacaaaacaaaauaaaaccuagccaggagcaaucgcacaugccuguaaucccaaauacuugggaggcugagcucggaggaucacuugagccugggaguuuaaggcuacagugagcuaugauugucccagugcacuccagccuaggugacagaauaagacaucgucaaaaaaaaaaaaaaaaaaaaaaaaagaaagaaagaaagaaagaaagaaagaaaaaaacuuauaacagcaagagugaacccugaugucaaccauggauguggggugggguggugacaaugggucaacgcaggcucaucaguucuagcaaaugcaccgcucugcugggcacguugaaagugggagagguuacagaugugugggcuauagggcugauaggaaaucucuguaucucccucucaguuuggcuaugaaccuaaaacugcugcuccgauaaaauaaaaugcuugaaaaauuuuucuuuuuuuuuuuuuuugagacagacccuugcucuguggcccaggcuggagugaaguggcgccaucucagcucgcugcaaccuccaccuccuggguucaagcgauucuccugccucagccucccgaguagcugggacuacaagugugugccaccacgccuggcuaauuuuuuguauuuuuaguacagacaacauuucacuguguuagcaaggauggucuugaucuccugaccuugugauccgccugccuuggccucccaaagugcugggauuacaggugugagucaccaugcccgacccaaaauauuuaaaauauuuuuaaaauaaaauaaaaaauacuuagguuacuccuaucagaagaucuguaccugaacuugaaccugaaccugaucuaauuaccagcuaacagagaacaauaauuggccaaaucccaaaugugggauguggucugguuucuuccacaaaugaaugguauagaaaaaaacaaaugggauggcaaggggaaguauuugaaaagaaauguggguauuuauguguaaaaugcuacaaugccuaggauuuauagaauuuuuuuuuuuuuagaggcaagaucuugcucuguugugcaggcuagaguguaguagugugaucauagcucacugcagcuucgaacuccugggcucaagcaaucuucccaccucagccucuuaaguaggugggacuauagguguaugccaccaugcccagcuaacuuuuuaaucuuuaguagagacagggacuugauauguugcccaggcuagucuugaacucccagccucaaggcauccuccugccucagccucccaaagcacugagauuacaggcgugagccaccucgcccagccagugccuaggauuuguguuaaaaucuuccaggaagauggccgggugcgguggcucacaccuguaaucccagcacuuugggaggccgaggcggguggaucacgaggucagcaguucgagaccagccuggccaacauggugaaacccugucucaauuaaaaauacaaaaauuagccacgcgugguggcuggcaccuguaaucccagcuacucgggaggcugaggcaggagaauggcaugaaccugggagguggagguugcagugagcccagacugcaccauugcacuccagccugggcaacagagacuccgucucauaaauaaauaaauaaauaaauaaauaaauaaauaaaaugaaaaaauaaaauauuccaggaagaaaauaauaauaauaaccaccgaagcuggggaagccauccacgaggauucuuugaacuuuuuuccacacuuuugggaauguuugaaaaugcucauaauaggccgggugcgguggcucauggcuguaaucccagcacuuugggaggccaaggcaaguggaucaccugaagucaggaguuugagaccagcuuggccaacacagugaaaccccgucucuaguaaaaauacaaaaacuagcugggcgugguggugcccacuuguaaucccagcuacucaggaagcuggggcaggagaaucaguugaaccugggaggcggagguugcagugagcugagauugugccacuguacuauagcuugggugacaagagcaaaaacuccgucucaaaaaacaaaaaggaaaaggaaaagggaagggaaggcucauaauagaaaguaauaaaaaaauuaauuaaaguuauaaacccuggggagcugggagcugcagauucaccaguggcugucugggggaaguguggcugcgggugaguuuaguuuccucuuucuauacacuuguuuucuaauguuucagaaaccagcagguguuaauugugcacuugaaaaacgaaugcauacaaaucagaagaaaaagauacauagcucaaagggaaaagaaagaaggaguuacggugaaauggagaagcaaugacuuccaggcaggcagggaacaggugcugggguuucaguaaugauaaggaccccacccauccuccugcuuccccagcacccccaaagccacaccucuucucaacgggagcaacuuguucuccaagacgucccuggcgucggugcccucguccaucaggucaagcuuggugaugacaccgaugguccguaggccugaaagagcccagaggucagaggucagaggcugccaccaggaaagagcaucagcuggcagcugcaagccaccugggguccaguuggcccugaaacuuccaggucacaucaccugggaaagccagaacgucacaggccuggaccccaguuuccgacaugucgaaugaagauggucacagcccugaucucacaggguggucauaagggugagccuggcacacggcaaauacucaacaaaugcuggccguuauugucauuuguguuauuaaggacaaccucugcugcugcaggcuuugggaaaccucacguaaacaugauuccugggccagauuuugaugcuggacuuuccaagugccggcaaagucccaagggaacauuugaguuugacacgacuguuuccaggacuaccucuugccugaauggcuaaaauuccacucuggaaaccaucccauccaauuccaccucuccacaagucauuccagagucaaggaugucuuucuagcaaagucucaccucugcagaucaacugcucccacgggggcugagggccuggcucugugcuaaccguguguguuauauguguggcaugugcaugagacacuggggacagauggaagccagagugaagaucucuggugggugccaauuugggcaucaagggggccacagcugugcccucccuggggccccuuccugcucacauucugcagugaggguucaguagaaggaucugacuagaggggcccaggggugucaacucgaagggaaauagacgaucucaccaugcaaagaucagaaacaacccaaaaguucaacaguccucacaucagcuaucuggguuaggacugaaguucccguucugacuaagaggggaccaugucucagggagcagaguaacagcuagaugggaccuaagaucgcaucugggcgauggagcgcugggcccuuccuucagcccuaggcuagcuucccacucuggcaacaugggcacugccauguccaaggaggaccguccaacugccacacagugacuucccaggggaugcccaccagcacugcugguucucggaggaagugccauguuccaggaggccuuuuccuacagcggccauggauuaaagagaacgccagugacuuggaaccaaggaugcugggcacaucccaugcucagaggcaccuggaagaggggacugcccuaggcucaggguuaccuuggggaucgacuuccuuggccagcuugagggcgucggaguuggccagguccauguuggcgggcgugacagccagaaugaggcugcucucccggcugaugaacugcaggaucauguccuugaucugguacucgaugucuggaggcuggucgcccacaggcaccuuggugauacccgggaggucgaugagggucaaguucaacacugggagggaaaccagaaggaaaggcauucagagccaggagaggggaggcacaaacaggcccgcagccacccagcugacuaccaaaguuccugcgcggggcucagacuugaggaugucgccugacacucugccugaaccacaccuuugauccaguaacuccccuucuaggaucccauccuacagauaccuucuaccuacuccauuucaauggcacaguucuaaaucaggacaguucagacuggaauagaccuaaaugacugaauaaauuucagcccauccauucagccaauaccaaagaaccauuacagacaaacagaugaggcugggugcgguggcucacaucugcaaucccagcacuuugggaggccgagguggguggaucacuugaggccaggaguucuagaccagccuagccaacauggcaaaaccccaucuguacuaaguauacaaaaauuagcugggcgugguagcacacacuuguacucccagcuacucuggaggcugaggcaugagaaacacuugaacccagaagguggagguugcagugagcugagaucauaccacugcacuccagccugggcgacagagcaagacugucucaaaaaaacaaaaacaaaagacaaauggaugaggccaggcgcggugacucaugccugucaucccagcacuuugggaggccaugauggguagaucacuugagcucaggaguucgaaaccagccugggcaagauggcgaaacccuaccucuaccaaaaauauaaaaaauuagccuggcaugauggugugcaucuguuguccuaacuacucaggagacuaaggcgggaggaucgccugagcccaggagaagaagugagccaagaucucaccacuguacuccagcuuggccaacaguguuaaacccugucucaaaaaaaaaaaaaaauaaauauauaauaaagaaacauucugagaggcauacaaaaaaaaaaaaaaagcauaggccaacgcaguggcucacaccuguaaugccagcacuuugggaggccaaggcaggcgaucaccugaggucgggaguucgagaccagccugaccaacacggacaaaccccgucucuacuaaaaauacaaaauuagccgggugagguggcgcaugccuguaaucccagcuacucagggggcugaggcaggagaaucacuugaacccgggagguggagguugcgguaagccaagauugcaccauugcacuccagccugggcaauaagagugaaacuccaucucaaaaaaagcauaagugauuuuuauguuaugcuaacaauuuaaggaaaaggagugauaaacacauacacaacauauacauagauacaaucacaauugcuuacauguuuuuugcuuacacauuuuuuuuaagauagagggucuugcuauguuacccaggugaagugcaguagcuauucacagaugugaucauagcucacugcaaccucgacuuccugggcccaagugacccuccugacucagccuuucaggcagcuugaaugacaggugugugaaaccacacccagcucauguuugcauugucaucugaagaaccuaaaauaugugugcaaaacugguugacaagguagguuuuugcgauauaccuuucuguaauuuuugaauucugagccacaugcaggugucauuuauugaaaaacaaauuuaaaacuuaucgcaaggaacccaucaugguagcaaucugugccucugggccagaggaugucuauggccccgggcugcuguuugaaugcagaguuuuaaaaucaggauauuuggcugggcaagguggcuaaaaccuguaaucccagcacuuugggagggggaugcaggcgaucaccugagguuaggaguucgagaccagccuggccaacauggugaaaccccaucucuacuaaaaauacaaaaaaguagcugaaugggcugggcgugguggcucacgccuguaauccuagcacuuugggagucugagguggguggauugccugagcucaggaguucgagaccagccugugcaacauggugaaaccccgucucuacuaaaaauaaaaaaaauaaaaaauaaaaaaaaaauuagccaggcagggugguacacaccuguaaucccagcuacucgggaggcugaggccagagaauugcuugaacccgggaggugaagguugcauugaguggagauugcgccacuacacuccagccugggcaacagagcgagacucugucucaaaaaaaaaaaaaaaaauuuggccgggcgcggcggcucacgucuguaaucccagcauuuugggaggccaaagugggcagaucacaaggucgggaguuugagacaagccuggccaauauggugaaaucccaucucuacuaaaaauacaaaaaauuugccaggcguggcggcaguugccucuaguccuagcuacuugggaggcugaggcaggagaauagcuugaaccugggaggcggagacugcagugagcugagaucacaccacuguacuccagucugggcgacagagcgagacuccaucucaaaaaaaaaaaaaaaaaaauuagcuggguguaguggugcaugccuguaaucccagcuacuugggcggcugaggcacaauaauugcuugaaccugggagguggagguugcagcgagcagagaucacaccacugaaccccagacugggcaacagagcaagacucugucucaaaaaaaaaaaaaaaaaacccaggauauuuuacagaagacugguucuggccucucuugaggcaccagcagaucuggcugccuugagccaagugguggcugcccuugguaaaagggggaaauggcugcaaucccccaccacuccaaacaacuucuuggcaugcucuuucuucaagcugagacagaggucuggguacuacauaccuagcacaagugggaagauacagaucaaggggcuaugugugugugaauaucaacuguuugugaaugggcacaugauacccaugaguggaaguacacaggcucacccauagcacuguccaugaacgaccagaaacggucagugauggguccccacccgugcugccuaccguguggcgaguagacucgaagguugaugggcacuggggagaugccuuuguugguccccgugacccugucggucucugcuucaaucuccugccggacuucaucaaagucuguaaacuuuuuggacuugcagugcaaaaacucggcauguucuagaaagggaagagagaugcugaaaaugagaaagagcugugggcagggugcgcauggacugcggggagaaaugcuuuguugaaugaaaguaaugacccaggcugggcacaguagcucacgccuguaaucccagcacuuugggaggcagaggugggcagaucacaaggucaggagauucagaccauccucacuaacauggugaaacccugucucuacuaaaaauacaaaaaauuagccuggcaugguggcacaugccuguagucucagcuacucaggaggcugaggcaggauaauugcuugaacccgggaggcggagguuguagugagccgagauugcgccacugcacucuagccugggagacagagaagacuccaucucaaaaaaauaaaaaaauaaauaaaauaaaauaaaauaaaauaaaaaagaaaauaaugacccaaucaucgucacucuaggaauuugggagugaaagauucguucucaugacaagggucuugggggaggcggggguuccuauagacugaauagacugagccucuuuccagauccugaagauuacguucccauguggcacuuugcaaacuguuaauauacgucaugacauauuaugaaucccccucccccaaaaauaaacagguagacauaaccaaugaccaaaguuucugggauuacaggcauaugccuccacgcccagccauuuauuuguugauugacugaugaacagaagaggaagcaccaggauacaucacccagagagggugaguccauuugauuaaggugaugcugcagagccucccuugcugugggucccagucaagggaguucgaugcccaaguccuuguggauucaugguccaccagcacauuccagcuccacaaaauccccagggguauuucucauggcacucacuuguccuucuuccccaaggagcccacaagguagagggaaggggcaccccugccgccuccucagagcuggucuugagucuuucuuucucccccugacuauucaagagggcccccuaccuagagacaaaucccccaggagaaauguuuucuggguauaacccugaguguauauaagacccggggguaucugaaagucacagcaagacugggaugaaggggaacaaaauaaguaauugacaagcagugugggucccaccaggaaacaagagaaauccagucccgaaucacagauugaggacaaagcaaauauaaggcauguucaucacggaagguggcugccgaguacacagguguccacuguacaaagccuugacguuuccagauguucgaauuuucagaguaaaauguuggggaggggauauccccaaagcucagagaucacagcuacuguagugaugcuaaaaauaagggggaaauggcugggcacaguggcucacgccuauuauccagcacugugggacgccgaggaggguggaucacuugagcccaggaguucaagaccggccugggugacacagugagaccccgucucuacagaaauuuaaaaaauuagccaggcauguuggcgcacaccuguaguuccagcuacuugggaggcugauauggucuggcucuguguccccacccaaaucucaucuuguagcucccauaauucccuuguguuguagcagggacccagugggagaucaaugaaucaugggggugggucuuucccgugcuauucucgugauagagaauaagucucacgagaucugaugguuuuaaaaacaggaguuucccugcagaagcucucucacucucuuugccagcugccauccguauaagaugugacuugcuccuccuugccuucugccaugauuguggggcuuccccagcccagcuguguggaacuguaacuccauuaaaccucuuucuuuuguaaauugcccggucucaaauacgucuuuaucagcagcaugaaaauggauuaauaucggcugaagugggaggaucauuugagccaggagcuggagguugcagugagcuaugaucuaugaucacaccacugcauuccagccuggcgacagagcaagacacugucucaaaaagaaaaacaaagaaagaaagggguaauaagucacacuggcaaagaggucagagaccugacccaccccggagaugcgaagaugcgcacugcccugucguuuuuaagaguaaaaaaaugaaaauggccucaacguccaccaggaggagaccuggcgacgugaauaacacagccaugccauaaacugccucaagcaaaggcaaaaagggagaugaacacccagccaggucuagaaucuucaaggcagaaagaagagugugaggaguuucaccgucccaucauggcaaccgaagaaacuacggcacucuggccaggcccugcguguggucccguugcgccucacaagucccuugacagguaggcaucucuaagauccccauuucaaagaugacaaaacugaggcccagagggguuaagggccuugggccaaguuccgugauggagcugggacuuggaacucagaaauucuggcuucagguaauggcuccuaagccagauagccuuugugaggccacuggaaggaacuucgccucuuugaaauucucugcagggucagggggagacucagugggcuccgaugacugaggaccguguccagcacaggcacuggccacccagaucagggcaaugaggacaucugcuggaggauucaggauccccacccccacccccagcccugcuaucagcugacccaguucccaaggacaguuacacuccagccuucugcagggacaaggggaaacacucggccgcucuuccuguagcagccacuaaaaauggaacagcucccaaccccccacagcaaaucucaguucucuucuggcuccaggaccccagcuuagccccaaaagagaccaucucccuucaaagagugcagggggacauggcguggaagaugggcugguggcaaggacacaggcccucucccuagcaggccucugucccaccaaguguggugucuacaaagcccagcccuaccuccuccuacucccaggucugccuggcuaccaccucucccaggaagacuucccugaguggggcaucuuggccucuuccucaucagagccagcucacuuuggauuguauugauggggccaggaccugcggcuccagcaccccagagcccagcauguacuggcagcacgcugugugcaguaaugagcucagucuguagucagagggccugcccaggucucagucuacugaucuguaaaaugcgcaucauaacaggcuguaugaggacucagagucaauaccugcacaggaagagcauagccagcacagcuacggucugagcagcuggugggcagaaguccccaaggaaugauguggcaaagacagcaccaggggcagugggcgccaucguucccccagcacacacaggcaggagcccagagagggcaagcuacucucucaagucacacagcauccccaccuccugcagaucucucuccccacagcagcugcuccacccagcccccuccuccccugccuucguuuccccauaacacuuacuaccaucugacaaagggugagaagaaaucuaauauagagagcuuuaccuugaauguccaugccaccagggaagggacgcccaucugccuuggucauugcuguguccccaagggcacacucacgcauguuaggugagaaauggagguucugccugcccggcugccacaggcuuccccagcaagcugaaucuaggugucugagcugcaaaagguucccccggaaccucaggccauuccccaacgcaaggaccaggaaacgggcccaggaaggaccaccugccccacccaaguccgcccagucaggggcagacacgagauggggcuggaaccaggcagccagacucacaugccagacuuuggagcacggcaccuuccccgguugucacaugcaggcugggaaccaacaggggaucagagaagacaggggcuguuuuuuuuuguuguuguuguuuuuuuugagacgaagucucgcucugucacccaggcuggaguguaguagugcaaucucggcucacugcaaacucugccuccuggguucaugccauucuccuaccuuagccuccuaaguagcugggacgacaggcgcccgccaccacgcccagcuaauuuuuuuguauuuuuaguggagacaugguuucaccguguuagccaggaugaucgcgaucuccugaccucgugaucuacccgccucggccucccaaagugcugggauuacaggugugagccaccgcgcccggccagcaggggcuguucuuugugaucucuccuccaagauccuucugcugucggccaaccccuccaugugggcgaaggauauggacagcaggugccagaaaaccguuucuucccuagugggucagugagcaacagaaccacaccagagaaaaaggcccaggcaccgaccaggucugccgcagcugccugccuuucuucacagggcucccuggcauggugaaaguaaaugcugaaugccaggucaacagagguuuuuuguuuguuuguuuugagacugagucuugcucugucacccaggcuggagugcaguagugaaaucucggcucacugcaaccucugccuccccgguucaagcuauucucauacuucggccucccaaguaacugggauuauaggcgcaugccaccacgccuggcuaauuuguauauuuuuaguaaagaugagguuucaccauguuagccaggcuggucucgaacuccagaccucaggugauccgcccaccucggccucccaaagugcugggauuacaggcaugagccaucaugcccagcccaauagagguuuaaaagcuuccaccaggccgagagcaguggcccaugccuguaacuccagcacuuugggaggcugaagugggagaaucauuggaggccagccugggcaacauagcaagauccuacauguacaaaaaaauuaaaaauuagcugggcgugguggcgcaagccuguaguuccagcuacacggguggcugaggugggaggacugcuugagccugggagguugaagcugcagugagcugugaucacgccacugcacuccagccuggaugacaaggggaggccagagacccugucucaaaacaaugacaaaaagagaaauagaguggagggccuagccugggccucuggaacgcugcaugcgcucaagugcuggagaugagaugauuuuuuuuuuuuuuuuaacaauccacuggcccaaagaaucagccagaggccuuaacacugaguucccugucaacuuguccacagcagcagcagccgaggcccagccaacaagccacugagccaccccuggcucugccugucccggucccugccaucaagcugcaccccacagccacccucugcagacaggcauuuccagauaccaaagccaguuccuguaauuccucggcaaacugcaaagcauuuugauagcuccacacacacccccacugucacccggcacccugagccaggagggcucccugggaggagggucagcccgggcccccucagagagguucgcagcuggcaugugaucaggcccuggggacucugagggacccagccuggcacacagcaggaguaaaggauuaaucugggcagucauccagcaaucacgcugccaaggccagggagucagccguccucgcccaccacagggccuccuaacugugggcccacugguuguacuugcggguuuuuccagagagagguucugccucccucccaagccuguguccccuacugaagcuggagcucugagagagcagagacuuggugugaucacaguucccccuagcaucucguauacagcagcugcuuaauuaaaauccaugaaaaaagaaucugugcucuaaccuaggaggacaucacucccaggaacccccaacuggggccccacugugcuaaacagucaauccccugcaccucaggcccuuugagguguccccagaagggagccacaggugcaagcugccaccuucucagggucagggggccugggacaugaagaagcagccccuugccagaggccacagucaccucuggccuggagacccuggaggucuucggagccuccuguuucaaaggagcuuguggagccccagagugaccgaaggcccuuggucagagaauggcccucccuaucuucaaagcacacuggucacgugcccgcuggcacuacuuaagaauuuugaaaugcccagguccugcugggaagaccugccuucagcccaacagaaaagacagcaggguuuggggaggugaggagagggagagagggaggagaguuuucggggugccucgugguuucacagccuagcgacacccagcuccggguuccuacccuucucucagcaccucaguuuccccaaaaugcaaugacacagaacccagugccggggcucccauaugacugcgaucaaaucccaucaggagcacaaacacggcucagcuguuagucucagggaacccucaggggcugggcuagggucccagugcuuugcacacuggggcucugcccuggaucuucucaccguucccccagcaaagaacacaaugacgaggcuggcccugaaggcaaggagaggagaucugccuuucccaaaccugcuguuggcaggcaggaccagggggaacaacuuggggaucugccaccaucaggagacccuagcuaccacgccagcaggcaggauccacucaugcaggacuuuugagagccuucagcagaccaagaagugggcacagcacacaacacuucccaugcccauuuagcccuugaguucucucuaauccgaggcaauacgcaaauaucucccaguccaggacaaauugccacugggaaggugucagccugggcaggcaucccagccagcccacagccugacgcacgccagcuuggucugcucucuagauacaaggcugcagauggaauggcagagugauggaccaggcucaccaggggaagaugcuugguaaaguaacccccaucacuucccgcccaguaggcaagaaggggcacagcaccagcccuuugagcucguucacucggccgugcaugcggagcaccugcucggcgccaggcccugugcugggcagagccgaucugcaugccuguucucgugugcuggcgcagagagaguccauuaagaaaaaacaggccgggcgugguggcucacgccuguaaucccagcacuuugggaggccgaggugggcggaucacgaggucaggagaucgagaccauccuggcuaacacggugaaaccccgucucuacuaagcauacaaaaaaauuagccgggcgagguggcgggcgccuguagucccagcuacgccggaggcugagacaggagcauggugugaacccgggaggcggagcuugcagugagcugagauggcgccacugcacuccagccugggcgacagcgagacuccaucucaaaaaaaaaaaaaaaagaaaaagaaaaaacaagaacaggauaacucgugcugccggggaccggggaacgaaggcggcaagugaccaggugcgggugagcagcagacaguggcagguagggaacagggcguuccaggcaggcagcacagugagcacagaggccaagcagugggaaccagcaagcugggccugagaaucaggagggagauggaugggggcaguggcuggggaccaggaggaggugaggucccagagacuggcaagggccacaaggccuugagaaggaggcucgauuugauucugaggccaaugggaagcccuggagccagguccugacaucucuuccuugguuccggugagcacaccaaaggccaguucaaggccaagggcgguggggaggggugguucacagggccucacugugcacauuccacacaggaacagucccaggcacucagaguuuacggggcugcuucccagugagggcaggguucacucaugggccaccaaacuuccuggugguuauggucuuagguaauguuuaaacuucuauggcuggaaguuaugguucacuggggauggcuggaaugagggcaagcugcgggaaccagaggggaacgugggcugcgcccugggggcccugucuuuggacaucagaccccacaggaagagacagcauaccacagccaauggggugccauggccacgauggcagcgccaccaucacccccauuuuacagaugaagcuaccaaggcacagagagggaagucacuuuaacaagucccgggccaguaaaggguggcagccugguucugaguuuggucacagagagccagcugccaaucccuaggagccacguggucugguguauaccccacaaggccccgccggccccagcaaucacugaugcccgcaauguguucauuuuccucuccucuuaguaaggcguccuaccucccacccaccucccccagcaagggugccuaugcugcuuaaugccuugccuggaagacagucuagacugccuggcaucugcccgcaccaccagggccaggcccccauugccucuugccuggcgccaugccagccucucugccacucccuaucccccacuccccgcuugcauucuggucccugacugucccuccugaacauggcagccaguggucucccgccaccaugcaugccaccccagcucccacugccugaauccucaacaugccuuccagucccagucccuccugccuucuggccccucccaagccucaccaccuccccacacugcuuugcuaaugcuguuucccuaccuagaauguucucucugggcccccaaccccaaggugaauccaacagacacucacaggcugggcucgggggcugggaccaugccaggugcucacgcugccucccuggagaucagcuaaggcccagcaccaagugggcaccuacuuggagcaauaagagauuggagccuggucgggcgcaggggcucaccccugucaucccagcauuuugggaagcugagaugggaggauugcuugagcccaggaguucaagaccagccuggucaauauagcaagacuucaucucaauuuaaaaauuugccaggcgcgguagcucauaccugcaaucucagcccuuugggaggccaaggugggcagaucacuugaggccaggaguucaagaccagccuggccaauaugguaaaaccccgucucuacuaaaaauacaaaaauuagccaggcuagguggugugcgccuauagucccagcuauuugggaggcugaggcagaagaauugcuugaaccugggagguggagguugcagugagccgagaucgugccacugcacccuagccugggccacagagcagaaccuugucucaaacaaaacaaaacaaaacaaaacaaaaaaggagacagagacugaaaaugccaugaucaggcggggcugaggggugcaagcugggaggcaggaaaaggccccacccaugugggacacuucuggaacucccuuuucaaccagcccaacaggaugcaacuaugcauccaccuccaccacagcugccacacccaucccccaccugcccccaccccuuccagcaccuacuccugccuccuccagggcacuggccucagcacuggccccuguggucccuuuuccaccaacagccacaggaucuggucaagucacaccuuggccuaaggccacauucccccaagagguggcuuaagggugggcuuuaaagacaauguucccaugugcccuaaggcaaguggucaggaagccuuggcucccuccucuguaagguggggacagacaucaggaacccaucaucguucauccgggucagguacuggguaggccugcgcucugugcucccuccuggccaaggcucucugccugcuucucuccccuccucccugacauguaguaaauaacgugugcuuuaaggcuaacaaggugguguuauugucaucacuguccagacaggaaacacagugguggucccucccuaggagcuggguugggaaccugggcagucuccgcuccaagccuaaaccaagcagggcaggcucucccagugguguggccagagacuggcagcaucaccagggacucauuaaaaaugcaguuuguggccgggcccaguggcucacgccuguaaucccagcacuuugggaggcagaggcgggcagaucauuugagcucaggaguuccagaccagccuggccaacauggugaagcucugucucuacuaaaaacacaaaaaauuagccgggcgugguagcucaugccuguagaugcucaggaggcugaggcaugagaauugcuugaacuuggaaggcggagguggcagugagccaagaucacccgccacuguacuccagcuuggguggcagagugagacuccgucucaaaauaaaauaaaauaaaaaugcaguuugcacaucuguccccauccugcucaaugagaaacagaaaacuaccaacacugauuucuauagugacucucaggacuuuggggcugcccauuccuggcacagcugauuggacgccugaacccagagguggcagcccauuggcccaucgguggcguacgaaauagcagagcucauaaagaagagguggugggcccaucggcugcugucucucacuggagacacgccuucuugccagguugggcggggccagaggacgaaagugaggagucuugggaggccaagcugagagcuggcguugaggucagaucugccuggaugcaggucccagaucuggggcccauuggaaaggcaggcagcauggcuaagccucaguuuccccaucuguagaaugggggugugugugucagcugccuucccagugugagaguauuuaaaagggccgcaagaagacauuaacacaaacugaguguugaacgcccagagcugauguugcagauuagcagggaaggggcacggagacccuuaccucucccgggucuagcuucugacccaagauccuucccaaggaggcccgaggggguuuccagcugggauauacgcccaccucaugucagccucgggugggaagaauagaaauacacugagaucagggaaggaaagaacaggaaaaaauccacacauaggccauacuauauucaacaggcugggucucccuaagagucaaagucugauuaaaaagcaaugguggccgggcgcgguggcucacgccuguaaucccaacacuuugggaggccgaagugggcggaucacgaggucaagagaucaagaccagccuggccaacauggugaaaucccaucucuacuaaaaauacaaaaauuagccagacauggugacacacaccuguagucccagcaacucaggaggcugaggaaggagaaucgcuugaacccaggaggcggauguugcagugagccgagaucacgccacugcauuccagccuggcgacagagcaagacuuugucucaaaaaauaaauaaauaaauaaaauaaaaaauaaaaagcaaugguagagggcuggugugaugguucaugccuauaaucccagcacugugggaagcugacgcaggaggauugcuugaggccaggacuucaagaccugccuggguaacauaacccccaucucuaccaaaaaaaaaaaaaaaaaucagcugggugugguggugugugcaccuguaauccuagcuacccgagaggcugauuggagaggauugcuugggcccaggaggucgaggccgcagugagcuaugacuacaccacugcacggccuggggaacagagugagacccugucucuuaaaaaaaauaaaaaaagugauuauggggaggcugcuuuaaugaaaagagaagaagagauuacaaaagaguauagcauuggauugagcagagcagcuauaaaaccagccagauaucugggggacaacuggcgacaugcugaguagaaacugggacguggaugacaugcgggaaugacucguucucuggggcauggugcugggacuuuguagacaggcgucuuuauugcauggggaggugcacuggggcgugaaggauggaugugucaccacgucugcuacugacuuugaaagcguucagcaaaaucggguuaucuauaacacaugaaaagcacacauggggccggugugguggcucaugcccguaaucccagcacuuagggaggccgaagugagagggucacuugaggucaggaguucaagaccagccuggccaacagggugaaacccugucucuacuaaaaauacaaaaaaaaaaaaaaagcuggccauggagggucacaccuguaaucccagcuacuugggaggcugaggcaggagaaucgcuggaaccugggagguggagguugcagugagccaagauagcaucacuguacuccagccugggugacagagugagacucugucucaaaaaaaagaaaaaagaaagcacacauggcaccuggcauucuggucacagcugagggcuugcaguguggguguguaaguguucacugagccguuuuucaauuuccucacacauguggaacacgugaauucaauguccaaugacagcccaggacccaaguuccacccuccgcccccagcaacuccuggcaaccacacauccacauccacuuccugcugaaccucaggccgccccauuuuaccuguuuuugagaagaugagcugcagaaugagaggccgccgggugacgauuccugaaccgcggggaaggaagucccugugagggggggagagggacagaaauuacucuugcguccggaucgaggggcaggaagugugaccacaugugguggagcaacucugucuugcaauuugggcgaccucagcaaaggcaccaaccccagcugggcccuggggaaugcucuggucuuggaggguccugaggccugaagagcucaggaagguaugcauggaaggucauagugaccagaaccauuucccucuggcaggcugugccccaccccccguacucccagggggcccauucccuggcauguauuuguuaaauuucccccauacccaggagaucaacacauuuccuauguguuuuaaaucaacacaaugccacauguauauggguaaaauacgaggaaaguuauugaugacaaaauaggauguguuucauguccagaaaagucacaucuacagaagcagaaggcagaucaguggauaccuggaugugggaacgggggugacugccaauggaggggaaggagcuuucuggggugaugaaaauguucuacaucuggacuauggugauguuuacuaaaauuaacuguaaaagccuggacaagauaguaagaccccaucucuacaaaaacuaaacuaaacuaaacuaaacuaaaauuagcugggcgugguggcccacgccugugaucccagcuacuagagaggcugagagaggaggauggcaugagcccgggaggcugagguuguacagagccaugacugcacuacugcacuccagcuuaggcaauagagcgagacucugugugggaaaaaaaaaaggacuguaaaaugacuaaagaccacuaauucugaaauggaucgauuucgcggaauguaaauuacuauucgacagagcuguuuaagaaaaguacauauccuggccgggugcaguggcacaggccuguaaccucagcacuuuggggaggccgaggugggcggaucacuugaggucaggaguuugagaccagccuggccaacauggcgaaaccccgucucuacuaaaaauacaaaaauuauccaagugugguggcacacgccuguaaucccagcuacucaggaggcugaggcaggagaaucgcuugaacccaggaggcggagguugcagugagcugagaucgugccacugcacuccagccugggcgacagagcaagacuccaucaaggaaagaagggaagggagggaagggagggaggggagggaagggaggaaagggaggaaagggaggaaggaaggaaggagggagggaaggaaggagggagggaaggaaggagggagggaaggaaggagggagggagggaaggagggagggaaggaaggagggaaggaaggagggaaggaaggagggagggaaggagggagggaaggaaggagggagggaaggaaggagggaaggaaggagggagggaaggaaggagggagggaaggagggagggaaggaaggagggagggaaggaaggagggaaggaaggagggaaggaagaaaggaaucaauuccaugucuuucacaauggaaaagacucaggcacaaccaccccagaagauagagggaguagccugcuccgacuuacagugaauacaccaggauuccagcaaggaggaagacaggaagucacccuguacacucagaaaggaaaaugaaagcuuuccagugaggacugaaguagaaacagugggcucgggguacauuaaaggcucgaaaggaaauucuguuguuucauacaaaauggugaaagguucuaggcacagggaauuucuuuuucuuuuuuuuuuuuuuuuuuuuuugagacagagcuucgcucuuguugcccaggcuggagugcaguggcucgaucucaacucacugcaaccucugccucggguucaagcgauucuccugccucagccuccugaguagcugggauuacaugcacgcgcuaccaugccuggcuaauuuuuuuguauuuuuaguagagacaggguuucacuauguuggccagaguggucucgaacucaaccucaggugaucugcccgccuuggccucccaaagugcuggguuuacaggugugagccaccgugccuggccaacacagagaauuucaaacagguuuugcaccuagauguuuggaucguugaaaauuuguacaggacacagggcaauugguacuguacagcugugcccuguacagaacgagacagcauccugggucccugagugagugucacuagcacuacaaucauucccagcuggcagguggcccuacccaugcugggaaccccugaugagggugcuggaggguuccagaagaccuguuucucagcuggggcugggcacuggaaauuccugggaauguauuacccaguggcuggcgucgggggggagaugugcucuuuccacacacccuggaugauggguucuagcccgucagccggggggcugucccaccacuucuggcugggugcagagacacagcacugacuacacaacaagucagcccaagcccucggcgggggcuugcagccuggacugcaugagaaaagggaucgugaugggcaacagggcuacgaagaccccccaggggcgcugcuggcagagcagggcugaaguuuuagaagcagccuccaguggucagcgcugggggguugaggguggcagugcuggggauuaugaugaggaggcuggucaucacuguuagagcaaugccaccagcugggauuuagggauggauuacaauaaauguuaagcuuuagccagauuauuaacaaauguaagcuuuuaaaccccccucuggcugaugcagggcagaggagagggcaggagcaggaggcaggugggggugaccgcugugguucaugugagugacaucaggggcgaaaccagagagauggcaggcagggguacggaggccaguggacaggccguaggcagauuccagggcaguuugggagguggauggucacaaccugagggcaggccggauagagaagagccagagagugggaggaggcaagacagaggggagcgcccuacagacacuugcaaggcucugggggacgagcccuggccucugcauccugucucugcagccacaggcagcacagucagcucuccaggccugggaugcuaccugucuucgagccacacuccugaggaugacaaagagcccgagggaccugccugccaggcacuaggccugucacgccacgugccccaguucaagcugaugccugagcucuaaucccuuuccgucagccucccauucggcugaugaggagccugaggcacaaacaggauacgagacuuggacaacaucacagcucauggcuugcaugaaaaggagcgaaccuuucucacuggcuccugagcacuuggggaggugcuggugacacuggcgccaacauucugacgggggugggugcgaggaagacauacugcaggggugagagggguugggggcugggauaauuggagaggguucucugagcagggggacugagggaacaagcuacaucaauugggaggcggagugaacugaacgagggaaacagcgagcgggcgcccccaugcaggugacagaccccaaagucaccucuuagcauggccccuugucuuuccgucacaguagucacaguggacaccaggcugucccaggguauuaaccucaugaacgccacaaguagccuuggcccuggcccuaccagagccccaggccaccuagcucacagguagggaccugaggggcagggacacuuggcaucuugcacaucagagacgcagugucucaggucaggcacaguggcucacgccuauaaucccagcacuuugggaagccaaggugggugggucaccugaggucaggaguuugagaccagccuggccaacauggugaaaccccgccuuuacuuaagauacaaaaauuaaccgggugugggggcgcaagcauguaaucccagccacucgggaggcuaagacacgagaauggcuugaacccgggaggcggagauuguagugagccgagaucgcaucacugcacuccagccugggugacagagugagacuccaucucaaaacaaaaacaaaaacaauacaaaauacaaaaaaaaaaagacaaaaaaaaacccuggccggguguggugguggacaccuguaaucgcaaccacuugggaggcugaggcaggagaaccgcuugaacuuggaaggcagagguugcagugagcugagaucgcgccacugcacuccagccugggugacagaacgacucugucucaaaaaaaaaaaaaagacaaaugcagcaucucagaaaccaugcggcgcuggcuagacacugaaucaccagcagcggcggugacagcacgugccccucacaacagugccccugcuccauccuuucaaugacuauuuuugaagugugcaaguggaagaugucaacgauaaaacaacacaggagcagcaugugaugcaaucacagacauccugucugcuucgugugucugacguucauuccuuuucguggucgaaucuguccauugcacugauggacuacagucuguucgucuagucaccauuggauggacauuuggggucuuccuagcuugaauuuauuacaaauaaagcuguucugaacauucucauaugcgcuuuuuguagacacauguccuuguuucucuugcugagucacaggguggacuugaacuugaaccggcaaagcuagucucuggagauagaaaucagggcagugguucccuuucgggaaauggacuagaaggggcaggagggacuuucugagaccaugaagaaguccugcaucuugaucuagccaguagguaccaagguacaaucauuuauuagaaaaucaaaacuugcagcaguggcucacaccuguaaucccagcacuuugggaggccaagguggguggaucacuugaagucaggaguucgagaccagccugggcaacauaacgagccccugucucuacaaaaaguaaaaaguaauucacugcggaugguggcauuccccuguagugucagcuacucgggaggcuguggcaggaggauuacuugagcccaggagacugaggcugcagugagccaugauugcgccguugcacuccagccugggcaacagagggagacugucuccaaaaaagaagaagaagaagacaagaaaaucaagguauauguuuaagauuuaugcgauuggccaguuguagugggucacgccuauaaucccagcacuuugggaggcugaggcgggcagauuaugaggucagcagaucaagaccauccuggccaacacgguaaaaccccgucucuacuaaaauacaaaaaauuagccaggcgagguggagggugccuguagucccagcuacucaggaggcugaggcagaaucgcuugaaccugggaggcggaggcugcagugagcugagauagcgccacugcacuccagccuggcaacagagugagacuccgucucaaaaaaaaaaaaaaagacuuaagcgauuaacuauaucuaacugaaaucucaggaaaaggucacaagucaaggagaacauguucgugaagauucagauacaaaaguacaggguggacauuccauuaaaauuugcccacagaauuguuacaacccuguuaguuucucaauaagacgaaaaauucagaucucaaagaauuuuaaagcccagcaacaggggacuaguuaaauauaaauuacguucaaccuaaggaagcugacugaaaauauguuuucuuuuugaaaacauauauuuucaaucaccuuauauauaagauauauugcugggcauaauggcucacgccuguaauccaaacacuuucagaggccgagguggguggaucguuugaggucaggaguucgagaccugcuuggccaacauggugcaaccccaucucuacuaaaauuacaaaaauuagccaggcgugguggugggugccuuuaaugccagcuacucaggaggcugagacaggagaaucgcuugaacccaggaggcagagguuggaaugagcugagaucgcgccauugcaccagcuugcacaacaaagagcgaaacuccgucucgggggaaaaaaacaaaacaaaaaccuuuaaaauagaauaaaauacguguauuuauauauaaauuauggccuauccaugcugcuaugcagcaacagacacacaaaaagagccuguccuuucuagacauguaacucccuuuuugguguacuaagugagaaaaaaagaaaagguuuguagugaucaguuuuacugaagaaagaaaaggaaaggaagaagagaaggaaaagggaaagggaagggggaaggggaaagggaagugggggggggaagggaagggggaggggggaaggggaaggaaaagguacagaagaaagucuguacuuugugacuaagacaaccaaagggaaacaaaacaggacccggggcggcuggggccugguggggaaggagccacugcauguuuuccgacaucuuugaauuccgcaucauacacacgcauuacugaguucaaaacauuagaguagcuaauagcuauucaacacugacucuaugccaagcaaggcauugagaacuuuucaugauuauuaaccuuuuugauuucuuuuuaaauagagacagggucucacucugcugcccuggcuggagugcagugguaaggucacagcucacuacaaccuccaacuguagggcucaagugauccucccgucucagccucccaaguagcugggaucacagguacccaccaccaccuuaaguuuuuugguuuuuuuguuuguuuguuucuuuaacagacagagucucacugugucacccaggcuggagugcaauggaguccaaagugcugggauuacaggcgugagccaccacaccaggccaccuuaaguuucuuguagaggcaaggucucacuaugguguccaggcuggucuugaacucccugcaaugaccccacugcaccugccuauuaacccauuuaaccaugacaggauccauuaaaaugggucugcuggcuccauuuuacagaugcaaaugaggcccagagggugggggccugcccagggucacacagcaucuggggguggcaugaacauggacugaaggcacagggccugagcugucuaaccaccagggcaccuggccuucugagcaaacacaucuuaggcagacccuccaguaacucccagccagggcccggcuuuggaccucugguguuugccuguggccugugcuguccugugacuccacuuugugucugaggcgccaggcacugugaggacaauggugaugccccagacgccaccagcgcccagcucagacaacggacaaucacagcuucagaacauagggcgggagugacgcccaagagaacacagagcugugggcacaggcaggagaaggugacuuucugggccugggguauuuguaguguggaauaugaugagguuucucuucaaacaggcugaucaaucuuuuaauucauaguaccccacacacacauacacacucuuuuuuccuuuuuccuuucuggcuuuguuagaugcccaggcacgccacaguaccaggcguuaccaguaccagcucacauuccuucccuuauuuacaaagaagacuaacuuucuaguucacuacagacaucccuuccccuuuccucucucuuuuacgugcccaccuuaucuacaaaaauucaaauguuuagccaaccaaaauugguuuagauuguaugacccgaccccggccaauggggagaggguacaggagcaggacuugcaucaggaauaaaggcucucgugucccuuuguucaggugugcucucauggcgacuggccaaggacaagcaccccucuguacagaaguaaaauugcuuugcuaaaaauccuuuguucgaguguuuaauuuccuuaaaauuuugaguguuauuccgaacaguucuaagucgggcacaggagggcacagccugggcgacggagacgcagcucucaggggagaguuugaggacagggcagggcaggcgcagagggccucgcaugccaggcugagagcgccaggagcccugggacuuauccgauuuugcuucuaaaaguucccagacugcugcaugcaaagggcaccaacauucacccucggccuggacugccuccgaaaugagccccccagaagucuccuaggagcuuggugagcaggggccuggcccuaaggguuuucugggacacagcagcaggaguacuuggagccuuccagaaaccaccucccaagcagcucugccuggaacacugacacuggccacuuagcaggaagugacuuuccagccuccgucaucuacuuccuccucguugaucccauccgcauucugagaguacugaaaucuaccuacuccucuccucucccuuugcugcugcuacagugcccucugugcacccaggcugcccugcauuccagucccugcuuggccaccucugugcugugugauccugggcgggcuuccuggccucucuggucuagguuucccgucaguaagacaggguaaccuugccaagcucagagugauuccgcucgaaugacauuuccucagagacuucucucacccccauucacaccucucccaccuccaccccccaugccucauuuuucucuguggaacuaacacaugcuaaaugucacuuagcugcauuuuguucuggcucacauacagaccccauacccccaucugagcuguguggggagcucacacacagcuccccaaggugggauccuccaacauuccauccccaaagcauagaguagggcuggcacacaggagaugcacaauuaaguaguuuauuaacuuuuuuuuuuuuugagauggagucuugcuuugucacccaggcuggaguguaguggcgcaaucucagcuuacuccugccucagccccccaaguagcugggauuacaggcgcccagcaccacacccggcuaauuucuuuguauuuuuaguagagaugggguuuugccauuuuggccaggcuggucucgaacuccuggccucaggugauccaccugccucagcagcccaaagugcugggauuacaggcaugagccaccgcgcccggccuuauuuauuuuagaggcaggaucucacucugugcccaggcugcaucagcagcacaaucacagcuuacugcagccucaaacuccaggguacaggcaaaccucagucucggccuccugaguagcuaugacuacagguauaugucaccaugcuuggcuaauuuuuuuuuuuuagagauggcaucuuccuauauugcccagucuggagugcaguggcacaaucauaccucacugcagccuugaacucccggacccuagugaacuucccaccucagccucccaaguaacugggacugcaggcacacaccaccaugcccggcuaauuuuuuuauuuuuugcagagacagggucucgcuauguugcccaggcuggucucaaacuucuggccucaugcaaucuucccgcaucggccucccaaagcaccgggauuacaggugugagccacugcaccuagccuaguacuauugcaucauuucaguaccuggccuccuauccaugggcccaggccaggccccaggguccuggcccaaccucccaccuuccccagugaccuuucuaaaaugaagauccugccuccaagcuucucucuugcagaaaccaagugacugguccuagcccguccuguccaguccuagucccagugcugaccggguuccccagccccacccccugcaccugccuccucugaguucucucuggcacugcuggccuucaggccuuugcaggggguguucccucugccaggaaacccucccauaggcccugccuaccuggccaugggcaggugugauggcuugcgccccucccucccaaauacacaccccuucccacucccagcaaaacggccucugaugaaggucuaguccugugacacgccaagacuucugcaccuggccuggucacugcuagauccucagcaccuagaacagugccugccagacagugugugcucauuaaguauuuguugaauggguaagaagaauccagacuguggagccaggcagccuggguucaaagucgagcuccgccccuccugggcuguguggcccuggacaggucucuaccccucucugggcacugacuuggccauccaugaaaugggaggacacuuccagucugccacagagggcccagccaccggcuuggccuggcucaagucacuucaccccaccagagcagguuucagagcucuaaagugggccaccucucccuggaaggggauaagcgcuccaggaaggcgguaggggacaggcagggaagggugcagcugggaggcagcacccagcagcgaugggagaggugccagguugaguccagcagaucagaagcccaggcuguuuauuuaccguuuuuugaacagaccacaaggcuccaccaggcgccuuuugacuuccagccccuaugaggguggggacggcuacgugcaggaacgaugcaggcucaaacccagagccuucccaugggagggagaaucaacagauaagcccacagagggugagucagcaguguggcccagagccagcaccccagggcaagccaccccucaccugugcagccuggugcuggcagggccuggccaggacccugggcugggaucccuuccuugucaccauaugcucagcacagucucuuugagccugaauguggcugggagggcucacgugacaccacagccagccuucagcauggcacuggccacaggaagaggcuucggcaggagcccacacuccagggccaauuuccacccuggccucuucucucaggacucugauaagagccacacaaggaacgcuggccacccaacaggcugucucuaaccccaucucgggcaacauagcggcaaauccucugacaaccccagagggguugaaagucacaaggaugccagggccaaaagucccauuucagacagguggacugagguucagucucaggacuugcccaggacgcucagcgagggaggagcagagccaggacacgaaugugggugggacaccaaugaggcagacccgcagucacccgcacccaccucaggggcuucucugucgcucuguuggagcagaaguggggacccaugcccagucuccucugcccaccucggucccugccucauccuuccaacaauagccauuggucacccagcaaggacgcccaagccuuacagugcucggcccacacaguguccgcagguaggugccacugcaucccuguggucaccccaaagggcagggaggggagaaaccccucacgaggcugcagaccuggggcuccccuggcccucacccacccgccuuguccagccgcgaguccugcugguuucaccuccacaucaggccugauucugcucaauucccuccacguccaaggcugucagcgugucccacugucaccugccuacaccagugcagucgugcccuugguccccacaaucugccucccacaaagcagccacaaggugccugugcacaccaugucacuguaaaccccuuuguuaugggcccuccuugggcucccgcuucacuuggaauaaaagccagacuuuucccugcagccccccaagcccugcacgaccuguccugucaccuuccuguccucaccucccccuacucucugucuugcuggcuuuacuccagccacauaugccuccuccauguucccgaaacacaccagacacuguccugccccagggccuuugcccaggcuguucccucagccuggaaccuucuuccugcagcauuaacagagcaggcgggcagcucccagcaaacugcacccucccuccccccgccauaggaagcugcuccccuucuuucacacaucaacccgcucaaugcucagugccacucacaacuggcaucuuccggguuccugauguguucacccagcugcagucugucccugcccccaccucaacauccuauuagaguggcagccucaugggcgcagggucccguaucggccccuucucugcucucuccccaguacccaacacacacccaggcaggaggcagaugaccaaugcuugcagaacaaugggccaaaucugccauuuuacagaugaggagacuucucacuuccacaauccacuccuggccucacuccuccccaacauucccagcccagcagccccucccugaucaggaauccugcagcucccggcucgaggcccgcccuuggcacucaagccguggcaucaccugcucccuggucucauccaagggacacaacaggcugggagcaaaagcaggaggugaccuguggcaauucgugaucguggcucugggacucuccaggcccuggcuggaauccaguauuuccuuucuggacaagaugggcaggucagguaaccucuuugugccucaguuucccaaucuguuaugugggaaugaugccaccugccucagagaggagguggaaggguuugugaaacucuuaccaugauacccaaaagagaacauucgccccaucgaaucaaaguaaaacucaggcugagcacagugguucgugccuauaaucccagcaccuuggcacgcaaucucuugagcccaggaguuugaaaccagccugggcaacaugaugagacccugucucuacuacuaaaaaaaaaaaaaaaauugguugagugcgguggcucaugccuguaaucucagcacuuugcggggccgaggcgggcagaucacccgaggucaggaguuugagaccagcuuggccaacauggagaaacuccgucucuacuaaaaauacaaaaauuagccaggcgugguggugggcaccuguaaucccagcuacucgagaggcugaggcaggaaaaccgcuugaacccaggaggcagaggucacagugagcugagauugugagaucaugccauugcacuccagccugggcaacagagugagacugucucaaaaaaaaaaaaaacaaaaaacaaaaaaaaagccggcacgguugcucacaccuguaaucccggcacuuugggagaccgaggcagguagaucaccugagguugggaguucgagaccagccugaccaacagggagaaaccccgucucuacuaaaaauacaaaauuagccagguguggugcaugccuguaaucucagcuacucgggaggcugaggugggagaaucgcuugaaccugggaggcagagguuacagucagccaagaucacaccauuacacuccugccugggcaauaagagugaaacuccaucucaaaaaaacaaaaaggaaaacucgauacaauguaagaacaugacccuccucugcucauaacauuugacgguuugacaguucccaagugccccccauggcccugucaccuccgugcccuccucccccaccacccccucacucccugccuccagccacauugguggucaagaaacagcaaaaaggccgggcgugguagcucacaccuguaaugccagcacuuuggaaggccgagguggguggaucaccugagguccagaguucgagagcagccuggccaacauggugaaaccuugucucuacuaaaaauacagaaaaauuaguggggugugguggcgugugccuguacuccuagcugcucaggaggcugaggcacgagaaucgcuugaaccugggaggcagagguugcagugagccaagaucaugccacugcacuccagcauaggucagagugagacuccgucucaaaaaaugaaauaaaaagaaacagcaaggaggccagacauugcugucgcagggccuuugcacaugcuggccuccugcuucgaaagaccaucucaucuccuccaaguauuuccacaauccuggcuaucuccgguuaccagggacucaacucagaugucaccuccucagagaggucuguccccuacugaugcccaccuccccuucauguugcccuguuuuccuucuaaacacagcacugcccacuaguugguacuuuucugguuuauuugcaccucuuuuuucagagacaggaucucacucugucauccaggcuggagugcagugaugcaaucauagcugacugcagccucaaacuccugggcugaagcgauccuccucccucagccuccugaguagcucggacuacaggcacuugccaccacgcccagcuaacuuuuuuuauuuguguuuuucuguagugauaugcugccuaggcgauccucccaccucagccucccaaagcccugggauuucaagcgugcccagccuaauugcucauuuaucuaacagucccaacuagaauaucaacaccuugagggcaggggucuuaagcgcccuuuccccagcacccagaaacauauuaaugcagugguuuggcaaggacagccgacucccugagggcaguacuuuguggaaugaaaaccgauaaugaccuaaauguccacuggcagggaacuggcuaaaucaaucuugggagcuaguccggggagcaaugcaggcugcagugccgaaggucaagugcgaugcacggacuggauuaugcgugggggaugauguccuccacuucggguuuuuuuuccgcacauccccauuuccuguguauggacagcaggcuugaggucaugugaggugugcaaaugaaaaacuugcuguuuuauagucuccaacgugauuugaaugucaggcuuuuauaacuuuuuuauaacugugauugcaggccaguguugaccuuguaacuuucagcaguacugagaaaccccaaagaaacuggccggcccagcagcauuuucaagagugacggggaaacugcucaaaugugggguccuggagcucacaacuccgcccuccuagggguguccucggugucauccuaacugcuccccacugcaagggguggccugaguaccccagccagccuggugagugccagcugugggaccuuguuagcaaagucucucccaucuugcaacagguguccugcucuguaaaacgguuguggugaggacuggaggagacaguuccaguugccagggcaaagugaacgcucacugugucugcagcccuuacaggguggucagccauguauggauuuccagcucuguaccacccugagggcccaagugaacuagaggcaggcagccgggcaccacccacagucugcauuccacagccagccuccuggagccccuuccuuccaggggaguagguagugaccuccaggcaaacacguucuaguucccuccaccccgagacucucccggggugauggggagccagcccauaaggaaauauccaggcagacucaguccacaaugucacaagugacaggaacagcccggacccguucuugaggucuuugucccacccccacagcguaucucucggcagauccugccuuggauauccagacccauccccuccuccucuguuucgcucuaauguccugaggccaagucucccaucucagggcaaagccucccccaggcucccugccccacaggcuuggaaaacugcaagucagaucacacugugugccugauuuuuaaagaauuuuuuuuuuuuuuagauggagucuggcucugucaccccagccgaaguguaguggcaggaucuuggcucauugcaaccuccgccuccugggcucaagugauuuuccugccucagccuccuaagcagcugggacuacgggcguaugcuaccacgucuggcuaauuuuuguauuuuuuuuuuuuuucuggaaacagucucgcucugcugcccuggcuggagugcaauggcgugaucuuggcucacugcaaccuugccucccgaguucaagcaauucugcugccucagccucccaaguagcugggacuacaggcgcacgccaccacacacggcuaauuuuuuuuuuuuuuuuuuuuuuuuuuuugagacagagucucgcuuugucacccaggcuggagugcaguggcgcaaucucggcucacugcaagcuccgccucccggguucaugccauccuccugccucagccuccugaguagcugggacuacaagcacccgccaccacacccggcuaauuuuuuguauuuuuaguagagacggaguuuuaccauauuagccaggauggucucgaucuccugaccuugugauccaccugccuccgccucccaaagugcugggauuacaggugugagccaccacacccagccacaccuggcuaauuuuuguauuuuuaguagagacgggguuuugcaaggcuggucucgaacucaugaccucagaugauccgccugccucagccucccaaagaucugggauuacaggugugagccaccaugccuggccgcaugauguuuuuucucacccgagcaccugugcuuccuucccaccccucaggcccccagcuagagcaucagcuccacaggacagggaucucgucugucuuguucacugcccugccuccagcacacuaucuggcacacagcagguguucagcaaaugcuagcugcacggcaaaagaagcuggcaucacggccgggcgugguggcucacaccuguaauccuaguauuuugggaggccauggcaggcggaacaccugagcucaggaguucaagaccagccugggcaacaugaugaaaccucgccucuacaaaaaauuagccgggcgugguggcacacgccuguggucccagcuacuugagaggcugaggugggaggaucacuugagcccaggagguugaggcugcagucagcggagacugagccacugcaccacaaccugcaugacagagggagacucugucucaaaaaaaaaaaaaaaaaagaaagaaaaacaagcuagcaucuccagggcacugcacaaagcuccaggcacacagggccuucuuccaccuucacagggcucuggccaacccuguuuugcagauggggaaaccaaggauagagagauuaagucauccggucuauuggcacacagcuaagagcagcccuccugaccaaugaggcaccaauccaaccugcgucuaaucuccaucugccaggcaccaucccggucaccacacagcacuuccaggggcacacaaggaaaggaaaccuuggacuccagagacaggaaggccaggcucagcuuccucauggggacaacugagcaagaucauugggugaagacucugcagccuggcagcucagccacagccucacggcaggaacugaaugaaggcugccacuuccccagcccucaguuucucuaugaaauugggauaacagcaccuacacuaugggguugucagcaggacaaacccagggucuagcacgcauaaggcccuauuccacaggacuaguucacuaguucaugagggugacgggggugggagugaaggaugucaaugccuggcaccacaacaggcacagacccuucuucuuggcaccccagcaaagagccuuggcacagccuuuccuggugggccuggcaacaucacucuaaauccacuucugaugcaacauggcacucccuugcaggguauccacccugagcauagcagacacacaagccugcggacccccaagucucuggcaggaggggaaaaacuagaaauaaccuaaaaauucaagggggagagugaucaguguuagugggaguaggcucgacccaggaauacuugcagcuauaaaaaagcacaggacucucucaugaugcugcaaucaagcaaaaacaaagaaagaaaaaaagaaagaaggaaaagaaagaaggguagaggaaaaagaaaagaacaagaacaaaaaggaaggaaggaaggaaagaagggagggagggaaagaggaagguaaagaggaagguaaagaggaagggagggaggaaggaaaaagcacagaacaaaagaaauauuggccaggcgugguggcucacgccuguaaucccagcacuuugggaggcagaggcggguggaucacaaggucaggagauagagaccauccuggcuaacacggugaaaccccgucucuacuaaaaauacaaaaaaaauuagccgggcaugguggcggacaccuguacucccagcuacuugggaggcugaggcaggagaauggcgugaacccgggaggcggagcuugcagugagccaagaucgcgccacugcacuccagccugggcgacagagcaagacucugucucaaaaaaaaaaaaaaaagaaagaaauauuggccaauuuggggcugagcacaguggcucaugccuguaaucucagcacuuugggaggccaagaugagaggaucacuugagcccaagaguucaaggccagccuggucaauauagcaagacccuaccucuagaaaaaauacaaaaauuagucggguguggcacacgccuguggucccagcuacucgggaggcagaggugggaggaucaugugagcccaggagacagaagcuacagugagcuaugaucaugccaccacguuuccagccugggagacagagcaagaccgugucuccaaaaagaaaagaaaaaagaaagaaagaaaguuggagacuucaauaccccacuuucaaucauggauggauaucagcauugguaucaggcaagaaaaauaauaauaauggauggaacaaccaaauaaaagauaacaaggaaauagaaaauacgaaaccaauaagaccugacagauguguacagaacacuccacccaagaguaaaauacacauucuuaucaugugcauauggaacauucuccaggacacaccguauucgaggccaagccauaaaacaugacucaauaauuuuaaagagauugaaaucauacaaaguaguuccuccaaccacagugaaaugaaguuagaaaugaacacaagaaagauguuuuucagaaauucucaaauauauagaaaugaacauacugcuaaauaaccuauguaucaaagaagaaaucauaagagaaaugagaagauaugcugagauaaaugaaaaugaaaacacaacauaucaaaacuuauggaugcagcuaaagcagguuuacagggaaauucauagauguaagcaacuguauuuaaaaagaaggaagauuuuggccgggcgcgguggcuuacgccuguaauccccacacuuuuaagaggccgagguggguggaucaccugaggucaggaguuugagaccagccucaccaacauggugaaaccccgucuccaccaaaaauacaaaaauuagccaggcaugguggugggugccuguagucccagcuacucaggaggcugaggcacgaggauggcgugaaccugggaggcggagcuugcagugagccaagaucgugccacugcacuccagccugggcgacagagcgagacuccgucucaaaaaaaaaaaacaaaaaaaagagaaagauuucaaauacuuucagauuucaauaaucuuccacuucaagaaccucagaaaaggaggguaaaccaaauccaaagagaaaagaaggaaauaauuagagaagaaauaaagagacuaaaaaaauggagagagaaguuaacaccaccacaauuugcucuuugaauagaucaaccaaacugacaaaccuuuagcuagauuaaccaagagaaaaagagauaagacucaaauuacaaaaaucagaaauaaagaggagacaucacuaccaaccuuucagaaauaaaaaagaugauaagggaauacuauucuaacaaauuaaauacacccuagaugaaauggacaaauuccuagaaagacccaaauuacugaaacugacucaagaagacacagaaaaacucaauagauguacaagaaauuuaauuaguauucaaaaaacgucccacaaagaaaaguccaggcccagguggcuucauuggugaauucuuuuuuuuuuuuuuuuuuuuuuuuuugagagagagagagagucuugcucuguugcccaggcuagagugcaguggagugaucucggcucacugcaaccuugccccccagguucaagagauucucgugccucagccacccagaguagcuggaauuacaggcaugugccacuacacccagcuaauuuuuguauuuuuaguagagaagggguuucaccauguugggcaggcuggucucaucaauuccugcccucaagugaucugcccgccucagccucccaaaugcugggauuacaggcgugcgccacugcacccaaccagcauggaugaaucuugaaaacaugaugcuaaauaaacaaagccacacacaaaaggccauauacuguaagauuccauuuauaggaaauauccaaaauuggcaaauucacagacagaaaggacauuaguggcuuccaggugcugggggagggaggaacugcuucauauguauggguuuaggggaaaugaaagugcuacaaaaucagauaguggugcugguuacacaacugugaauauacuaaaauccacugaauaguauauuucaaaaggauuagguauuaugguaugugaauuauauuucaauaaaaauauuucaggaaaauaaaacaguacaggaguuccccauguccccauagaagaacaagggaacacguccuucuuuuauuuauuuauuuauuuuugagacggagucucgcucugucgcccaggcuggagugcaguggcgugaucucggcucacugcaagcuccuccuccaggauucaagccauucuccugccucagccuccugaguagcugggacuacaguacaggcgcccgcuaccacgccccgcuaaucuuuuguauuuuuaguagagacgggguuucaccguguuagccaggauggucucaaucuccugaccucgugauccgcccaccucggccucccaaagugcugggauuacaggcgugagucacugagcccagccuuuuuuuuuuuuuuuugcgauggaguuuugcucuuguugcccaggcuggagugcaacggugcgaucucagcucacagcaaccucugccuccuggguucaggcacuucuccugccuuagccucccaaguagcugggauuacaggcacccaccaccacgcccagcuaacuaacuuuuuuuuguauuuuucauagagaugggguuuugccauguuggccaggauggucuucaacuccugaccucaagugauccacccgccucaaccucccaaagugcugggaucacaggcgugagccaccacaccaggccagguccuucuuaaagaguaacaaccgcugggauccccaggaagggccuggccuccaacuguggccaguccucaucccacccuccuguagcccucccuccccuguuuuuuuuguuuugucuguuuuuguugacaugaggucucacuauauugcccaggcugguaucaaacuccugggcucaagcaauccucccaccucagccucccaaagugcugggucuaugggcgugagccaccaugcccugccaccucgugcccuuugauacugaucucaaugaaagucuccacuuccuuuuuauuuauuuauuuauuuauuuauuuuuugagauggagucucgcucuuucacccaagcuggaguacagcggcgugaucuuggcucacugcaaccuccaccucccagccucagaugaucugcccaccucggccuuccaaagugcugggauuacaagcaugagccaccacguccggccuacuuccuucuguugugagacuaaugcuugucuccucugccaggccuaacuccucuugguggcaaccaggccuguuugacuccagaaggguggcaguucaggucagagccuggcacagagcaggcucagcagacauugcugagugggucuugcucagugauugacaaguacaucaaugagugcaucccgagagggagaugggugccccgauuaccuaucgcaugccaggcaccaugcaagggacugcgcuacagccaggggcaccgcccuaccauggggcauuccccuucuaguggggggagacagaaagagaaaucaaacaaauaggccgggugcgguggcucaugccuguaaucacagcacuuugggaggccaaggcuggcagaucaccugaagucagcaguucgagaucagccuggccaacauagugaaaccucgucucuacuaaaaauacaaaaauauacgggcauguugacgugcgccuguaaucccagcuacuugggaggcugaggcaggagaaucgcuugaacccgggaagcagagguugcagugagccaagaucgccacuccacuccagccugggagucagagcaagacuccaccccaaaaaaagaaaacaagaaaccaaacgcauagguggaacaaugacaggaaugacaagugguuccaagaaaaauuaagcaggggaaggggacagagagaacaggguggggcguuugagcagaguggccagggggagagccuuuugagaaggaggcuuuuaagcagaggccuuagaaugcugaugaaaugagccacaggguuaucugggggaagggcagugcaggcaguggaagcagcaugugaaaaagccaugagguaggacagcgccucaccugcaugagaacaucauggagccucagggacgacuucauuuuuacccugagggaacugagggccagggaggauuccaaguagaggaaggauauagggucucccucugucuccccggcuggagugcacugacaggaucacagcucacuucagccucaaauuccuggguucaagcaauccucccaccucagccuccugaguagcugggacuguaaguaugcgcugccaugccuggcuaauuuuuaaauguuuuguagagaugggggucucguuauguugcccaggcuggucucguacuccugggcucaagagauccuuccaccucggccucccaaagugcugggauuacagcguaagccacggcgcccagcuaggaaggauauucuuaacaggcucccucuguccacugcagggagaacagccugggggugaggacaagguuaaaggugcaagacugaggaggcagaaacuguacugguccuggggaaguagugacaguggauggaauaauacacaguuauaaaaaccaguaccagcugggcacagugguucacgccuguaaucccaacacuauuggcacaccagccugggugccagagagagacuuugucuaaacaaacaaacaaacaaacaaaaaacuaauaccguggcuuuccacguacuaauacacaaugaucuuuucuaugaaaucaacaagcugauucuaaaauauauauguggaggcaaaggaacuagacuagacaaaacaauuuugagaaacaagaaaaaagaggacucacauggccugauuucaagucuuacuauaaagcuacagcaauauagaaaugagugggcgugguggcucacgcccauaaugccagcacuguggaaggcugaggcaggagcaucaccagcccaguaguuugaaaccagccuaggcaacauugugagaccccaucucuauuuuuuucuuuuuuucuuuuuuuuuuuuuuugagacagagucucacucuguugcccaggcuggagugcaauagcgcgaucuuggcucacugcaaccuccaccucccguguucaagugauucuccugccucagucucccaauuagcugggauuacaggcacccaccaccacgcccagcuaauuuuuuuguauuuuuaguagagacggaguuucaccauguuggccaggccaguuucaaacuccugaccucaagugauccaccugccuccaaaguguuaggauuacaggcgucagccacugugcccagcccccaucucuaucuaaaaagagaagaaagauaugugguuuuggagaaaggacagagccauacaucaacgucacagaacagacaguucagguuggacccacacaaauauggccaacuaauuccagacaaaagcaacuuuagggagaaaggauggucuuuucaauagugccagaaaaggccgggcacagugguuaaugccuguaaucccagcacuuugggagccagaggcaagaggauuauuacaugagucuaggaguuugagacuagccugagcaacacagcgagaccccaucucuugaaaaaaaaaaauuagccgggcgugguggugggcgccuguagucucagcugcucaagcggcugaggcaggagaaucgcuugaauccgggaggcggaggucgcagugagccaauaucacaccauugcacuccagccuagaugacagagcgagacucuccaaaaauaaaauaaaaauaaaauuuuccaugaucccaaaggauagaguaugaaaagaagaaaacuaguaacuuuccaguggggaaaccuagcaagccuaccucagccaagagaucaaggucagcaucaucaguuaucacugucaauaauuuaucagucuuguugguauccuauacuccugauaagauucacagaagauggcuggacgagguggcuuacgccuguaaucccagcacucugggaggcagaggcgggcagaucaugaggucaggagaucgagaccauccuggcuaacacggugaaaccccgucuaaaaaaaaauacaaaaauuagccgggcaugguggcagccuguaaucccagcuacucgggaggcugaggcaggagaauggcgugaacccaggaggcagagcuugcagugagcugagaucgcgccgcugcacuccagccugggcgacagagcaagacuccaucucaaaaaaacaaaaacaaaaaacaaacaaacaaaaaaagauucacagaagagaggggcaccucaccaauggccuucuuccccaaaacucacaccccaggcucaccaugaagaauuccagauaagcccuaauugagggacauuccaugacuuaccaagguuauaaaaaacaaggaagggcugaguugcuucccagaccagaaaaaggcuuaaggagauccgacaacuagaugcaauguccaguccuaagacaggaaaaggggugauuuuguuugaaaaauaaaauuucucaguauguauacuuccagacagcaagacccccaucucgauaaaaaaaaaaaauuuuuuuuuaaauuagucucauaugggaaaaauugaagaaaucuguacauucuggcuuuggcuuuuuuuuuuuuuuuuuuuuuuugagacagggucuggcucuguugcccgggcuggugugcaauggugcaaucaucacucacugcagccucaaccuccagggcucaagugauccuccugucucagccuccagaggagcugggacuccaggugagcaccaccaggccaagcuaauuuuuuuuuuuuucuacacacgaggucucacuauauugcccaggcuggucuaaaacuccugggcucaagcaaucuagccucccaaagugcugggauuacaggugugagccacuguaccuggccucccuuccuuuuuuuuuuuuuuuugagacagagucccccucuguugcccaagcuggagugcaguggcuugaucucagcucauggcaaccuuggccucucagguucaagcaauucuccuaccucagccucccgaguggcugggacuacagguguauaccaccacacucaauuuuuuguagagacaggguuuugauauguugucuaggcuggucucaaacuccuggccucaagugauccacccaccuuggccucccaaagugcugagauuacagugugagccacaacaucccgccaggccucacuuaauaguaguauaccaagguuaauuucauucauucauuuuuuuuuuuuuauuuuuugagauggagucuccuuuuguuguccaggcugaaguacaguggcgcgaucucggcucacugcagccuccgcuucccagguuuaagcaauucuccugccucagccucccaaauagcugggacuacaggcacauguccccacaccuggcuaauuuuuuguauuuuuaguagagaugggguuucgcuauguuggccaggcuggucuugaacuccugaccucaggugauccaccugccucugccucccaaagugcugggauuacaggcgugagccaccauguccggccucauucauuuauuuuuagagaagagguuauguugccaaagcugggcuuuaacuccuagacucaagcaauccucccgccucagccuccugaguagcuagguuaauuucuugguuguaagaaauauaaaauuagaggacacuggugaaggauguacaggagcucucuguguuaucuuuguacuuucuguaaauuugaagcuuauuuauuuucucuaaaucuaaaauuauuucuaggcagggcguuguggcucaugcuuacaaucccagcacuuugggaggcugaggcaggcagauuaccugagcucaggaguucaagaccagccugggcaacauggagaaacccugucucuaccgaaaauaaaaaaaaaaugccggccauuguggugcgcgccuguggucccagcuaguugggaggcuguggugggagaaugguuugagcccgagagggggagguugcaguaagccgacaucaugccacugcacuccaaccugggugaaagagugggacccugucuccaaaaaaaaaaaaaaaaaccacaccagcccaggcgcgguggcucacacugguaaucccagcacuuugggaggccgaggaggguggaucaccugaggucgggaguucaagacuagccuggccaacauggugaaaccccaucucuacuaaaacuacaaaaauuagcugggcauggugacaggugucuguaaucccagcuacucgggaggcugaggcaggagaaucgcuugaaccugggaggcggagcuugcagugagccgagaucgcgccauugcacuccagccuggggaacaagagcgagacuuugucucaaaagaaaaaaaaaacagaaaacaaaagccaaacauucuuggaggcacuaaauauagcagggaccuggugcaagacagucacauucuguugagacuuuggacuguggagcgggagcguuuguuacuagacuuauaggcucacugguuggaugagucggggguagucacaccuagaaauauauauauauauauaaaaaaucuggcaagagccacagacugcuagaggucguucccaugcaaaggacacccagccuuacucugugcacuuccggacagggugaauuguuuuuccuuuuuuuuugagacggagucucgcucuaucacccaggcgggagugcaguggcgcgaucucggcucacugcaagcuccgccuccuggguucacaccauucucuugccucagccucccgaguagcugggacuacaggcgcucgccaccacgcccagcuaauucuuuguauuuuuaguagaggugggguuucaccguguuagucaggauggucucaaucuccugaccucgugauccgcccgccucggccucccaaagugcugggauuacaggcaugagccaccgcccggccuguuuuuuuuuuuuuuuuuuucuccacaacgaguaaacaguugaauaacuccuuuaacagaaaagaguuuaagggcgcgguggcucaugccuguaaucccagcacucugggaggcugaagcaggcggauaaccugaggucaggaguucaagaccagucuggccauggugaaacccagucucuacuaaaaauacaaaaaauuagccgggugugauggugcacgccuguaaucacagcuacucgggaggcugaggcagaagaaucgcuugaaccugggaggcggagguugcagcgagccgagauugcaccauugcacuccagccugggcaacaacagcgaaacuccgucucaaaaaaaaaaaaaaaaaaucaagccugugcaucaauuuucacccagugcugggagcacauuccagguggggccuccccaccucagaaagcagccugaccugagcuucccagcaaccuguccaggccaccagggcaggcaccacagaagccgggcuuccgucugacuggcuuccgcccagacaacggggaacucaguguugcaagacagagagauacaucaacccaaaccacaggaagccuucgucaagcugagccaguggcucguggccucucucagucacuguccccugauguugauguagaaaagaacaaccugggggccgggcacggcggcucacgccuguaaucccagagccuugggaggccgaggcggguggaucaccugaggccaggaguucgagaccagccuggccaacauggcaaaaccccaucucuacuaaaaauacaaaaaauuagccaggcgugguggugcacaccuguaaucccagcuacucaggaggcugaggcaggagaaucacuugaacccaggagguggagguugcagugagcugagaucaugcauugcacuccagcccgggcgacacugugagacucugccucaaaaaaaaaaaaaaaaagaaggaaaagaaaagaacaaccuggaaaggcaguguccugguggcugcaggauccuggcugcgcggccagcugguaggccucccggggguggaggcugugacccucuagaaggacccuguguauccauacaaaagacagaagucucauggccaggacagcugugucccucccugauccgcccugggggcuuuccccagggcuggccuggucgugccagggcguaucacccagcaggcagggucacccuggcuggggcugcuccugcccgcuugacuggcccgccaggaucgcagcccugagaagcucucaucaccgcgaaagugugucacagggcaggcuccaaguagccugcuccuccuucaccugggcauggaggugucaccagggccugggacagcucugcuggccucuugucuaccgccccauaggucugccaugggagcguguucagauuuauccaaaggaggucucuuguaacagaaagagcaguggugccugccccugccagggccacugagcagccaggcaggaagcaaaagucagagggggcaccccgcagguugccauacagggccucacucccacccuggaggggacgcugcuagccccaucuuacagcccucgaagccaacgcagauagacacccacgcugcccagccucagggucucagccuauuacuguuauuacucuuuauauagauggagcaaaucuccacuuccuccaaaggaagauguccuugcuucagggucccugcauccccaggcaggcugugagucuccaaaaccaagacccagggcuguccucugccugguccccuccaugacugugcagugaaauucacuccauucugguuuuuagcuacuuuuuuuuuuuugagacagggucucgcucugucacccacgcugcagugcaauggcacagugugggcucacugcaaguuccaccgcuacccuagcucaagggauccucgcaccucgggauuccaaguagcuaagaguacaggcaugcaccaccacgccugcuaauuuuuguauuuuugguagagacgaggucucaccauguugcccaggcuggucucaaacuccugagcucaagccauguugccucggccucccauagugcugggauuacaggcgugagucaccacuuccagccuuuagcuacuuucauucaacaaauauaugcacguggcugggagagguggcucaugucuacaaucccaguacuuuggggggccaacgugaaaggaucgcaugagcccaggaguuugagaccagccuuggcaacauagagaaaccccaucuguacaaaagauuauaaacauuaguugggcgugguggcaugugguuguugucccagguacucaggaggcugagguaggaggauggcuugagcacaggaugucaaggcugcagcgagccaugacugugccacugcacuccagccugggugacagagugagaccuguuccaaaaaaaaaaaaaauaaccacccauaauggugccacguauucucuauagguaccagcauguaccuaaguacagaaacaccagaggggucuggcuagacauacccugaagugacaguggugcucccagguagagcuggaggaagggacgggcugggcagugugcucuuccucaucuguaaugguuucccuuuuuccaagaacacugucuccacgcucuacuugcguaauucaaauuuagaaaagucggcauuccacgggcagcguccuaacucucacgugccuacugguccuuuccgguccgcagggggcacucagcgggccgggugugugcgaggccucugcaccugcuguuucccuggccugcgaugcuguucccccaaguccuggcggggcuauuccacugcaggacacccaucccaacaagccacaugugaagcagcccccugcagccauucccccacccaaugcaguacagggcaaaccgcuucucacucuucagaauauuuuuauuuuuguuuuuuuugagauagaguuucgcucuuguugcccaggcuggagggccguggcaugaucucggauuacugcaaccuccaccucggaucacugcaaccuucaaguaauucuccugccucagccucccgaguagcugggauuacaggugcccgccaccaugcuuggcuaauuuuuuauauuuuuuuuuuuuuuuuuuuuuuuuuugagacggagucucgcucugucgcccaggcuggagugcaguggugcgaucucggcucacugcaagcuccgccucccggguucacgccauucuccugccuauauuuuuaguagagaugggguuucgccauguuggccaggcuggucucgaacucccaccucagccucccaaaguguugggauuacaggcgugaaccaccgcauacagccuuuuuuuuuuuuugagaccgggucuugcugucacccaggcuggagcgcaguggugcaaucauagcucaaugcaaccucgaauuccugggcucaggagauccucccaccuuagccugcuaaguagcugggacgacagacaaguaccaccaugcucagcuaauuuuuguauuuuugguagagauggggcucgccaugcuggccaggcuggucucgaacaccuggcuucaagugaucugcccgccuuggccucucaaagugcugggauuacaggugugagccccugugccugccccagaauguucuugcucauuuaacuguucaccuguccugucugucccagucccugcugggugcccagcaacugguguagagugguugcugcuuaccacacgcaggcuggacacagagcugacaaccucgaugcauauccaaagccacgcguugcucacucccucuguaaucuuggcccaguccucagauacaaacgccauggugcccaccauucagcccugcucucaagagucaggcccacaccuucccacccaaagccgccauauguguggcucuagagggcccacauccaguucaagcuccaacuccucuguccuccucccugugugacuucaggccagucucccucucuggccucaguuucucuaccuauaaagcagggaugcuaagagcagcagcugccaccccugggcagagaagacacuggucagaucuugcacauguggcacacggugauucuccauaaacacuggcucuuaacaucauaaauguccagcagcagaugaaacugaaacagucauccagcucccgguucaagcuacgggugacgccacaggggaaaauuucccaccacccagcagggaccuaguuaccaauauucacagaaacccaaaacgcacccggaagcaggcgucuuuccucucuuugcaguccugcuucagacgcagggccacauuuucccuuuauucagauuguagcuaaugcccuauaaauaucucauuauuggcuuggauuuuuccaaagcuuuaacacaauaagggcuuaauuacagcuuguaguuggcaaucccaguaaauuacgguuuacaugauguucucacuuuuuuucagcagccgaggggccuauaauuucagcacuuucauucaaaucgggcagaaguuuggcagauguggcucugagccaaauauaaacgcugagagcgacagcgagacaggguuccauucaaaggccagccucuaccgccuaagccaacucugaaaacucuaaaucuaaccuaggccgggugccguggcucuugccuguaaucccagcacuuugggaagccgaggcaggagaaucacuugagcccagggguuugagacuagccugggcaaaaaauaaugagaccccaccucuacaaaaaauuucuuaaaauuagcugggggugguggcgcacaccuguggucccagcuaauugggaggcugaagugggaagaucccuugagcccaggaaguugagguugcugugagcugugaucacgccacugcauuucagccuaggcaacagagugagaucccgucucaaaaaaaaacaaaaaaagaaaaagaaaagaaaagaaaaccuccucucuaaaucuacaacuguccccaaggccaucuuccgcccucauccagaaacaauccagguuauuaccaggggauuucaauguuaugaaccuaucaagggcuguuauccgucaauaaguaacucugaaaaagcacuuggacagccuagagcgcagcuuuggagaaaucugucuuccugauuauaaaccuaauccccaaaccagcaaaaacaaaccaagaaucacauggggagacgauucacaugugggguuagggcagaguaugucuuuccggucuuuucacugagcaaauacaaucguuuuaaacaagacaggaucccacagcccauuucaucugguaccuaacaggucuugugcagcuuucugggucauuaaagauucuucuagaucccucugaguagcgaguugauagucgguugucuggacacgcuuaucuggccaaauccccuaucauugguuuuuguuuguuuguuuguuuugagacagagucucgcucuguugcccaggcuggagugcagcggcgcaaucucggcuuaccgcaaccuccgucccccagguucaagcgauucuccgccucagccucccgaauagcugggauuacaggcgccugccaccacgcccggcuaauuuuuguauuuuuaguagagaugaggguucaccauguuggccaggcuggucucgaacuccugaccucuggugauccgaugcugggcauuuuuucucccauuucucaucaccguacacaaaauguguguaaauaacucucacggccaauuacuuguuugcagccaugauucccacuuagaaaggaaccaggaacaacuucuggucgauauuucaggaucuggggaacagggcgugccugcauguccugguccuggcuguauccccagagcaagaacauugccugcacugauaggcacuccauuuauaucaacagaguaaugaugaguuccuucucuuuaaggaaaaagaaacuaaggccggguucggcggcucacaccuguaauuccaccacuuugggaagccaaggcaggaggaucgcuugggcccaggaguuugacaccaaacugagcaacaaaguaagacccugucucuaaaaaaaaaaaaauuuuuuuuuuuugaggcagagucucgcucugucgcccaggcuggagugcaguggcacgaucucggcucacugcaaccuccgccucccagguucaagcgauucuccugccucagccucccgagcagcugggacuacaggugagagccaccacacccaccuaauuuuuggauuuuuaguagagacaggguuucaccauguuggccaggauggucucaaucucuugaccccgugauccgcccgccucggccuccccaagugcugggaauacaagugugagccaucgcucccugccaaaaaaauuuuuuuguaauuagccaggugugguggcucaugccuauagucccagcuacucaggagacucaggugagaggaccaccugaacccaggaguuggaggcugcagugagccaugauuacgccacuguacuccagucugggggacagagcaagagaaaagaaacguacaccugucaucagaguccugaucccagauaaaaggagacaaaagccaaccaacgagaucacaaaugcugccuguuucacaacaauuugcuacgugauucucaguccacucccaguaggcagagaccaccauguucccauuuuccagaugaggaaacugaggcccagagaagugaggucacuuuuuugguguguggcagaaccaagccuuccauauucccacagaucccucuggacuguaccaauuccagcaggcccagcacugcagaccacccuaaccgagccuugcauggccuuuccuuuuuuccuuuuuuuuuuuuuuuugagauggagucucacucugucccccaggcuggagugcaauggcgugaucuccgcuuacugcaaguuccuccuccuggguucaagugauucuccugccucagccucccaaauagcugggacuaaaggcaugcgccaccacaccuggcuaauuuuuguauuuuuaguagagaucgggauucacuauguuggccaggcuggucucaaacucccaaccuugugaucugccugccucggccucccaaaaugcugggauuacaggugugagucaccaugcccggccauguauggccuuuucaagaugcaauuugucuuugcccaaaaggaaagucacuggaaacagaagaugucauuuccaaguggcucuaaacuaauaagaucuguuaaagggacaaaccagcccaaggaacacaucacgugccccuccaucugucagggacaggagccaacgggcauccgaugugcacuggugcagcacccacugaggcacaggcagugcccccgcggcucauccacauaucccuggagggacacaucaccaaaggccaaauaaaaacgcagcuggaaacgccagcauccccggcacagcugcuucuuauuaaaagaaaaauggcacggggcgccuacaugccuguggagucugcuuacugagaaaacugaguugaagcuggaaaucaaaggagagagcccucagcuuggccagguccagagggacagcaguagcgccaccagcuuuacuucccucugcucagacagccucccugcccacaauguuccuagaggccuggucccacccuaauaucucccagaucugaucucccuccacuggccugcuaaacuggccuccgggcauccucccacaucaggaccuuugcacuggauucucuucccgucuccagggguuccuuccucgccuccuucaaggcucugcucaaaugucaccaauuucccuauuuaaaauguacccccucuggccaggcgcaguggcucacgccuguuaucccagcacuuugggaggccgaggcgggcggaucacgaagucaggagaucgagaccauccuggcuaacauggugaaacuccaucucuacuaaaaauacaaaaaauuagccgggccugguggcaggcgccuguaaucccagcuacucgggaggcugaggcaagagaauggcgugaaccugggaggcggagguugcagugagccgagaucgcgugacugcacuccagccuggaagacagagugagacuccgucucaaagaauaauaauauaauaaaauaaaauguacccccuccaacugugaucucucccucauccugcuccuugauccuuuuuuccaucauacuuaucgccuuuuuuuuuuuuuuugagacgaggucucguucuuccgcccaggcuggaaggcaguagcgugaucagagcucacugcagccuugaaaucccaggcucaagccauccuccggccucagccuccugaguagcugggacuacaggugucaccaugcccagcuaauguuuuuauuuuuuguagagacggggucuauguugcccaggcuggucuccaacuucugggcucaagugauccucccgccuggaucccaaagagcugagauugugggccugagccacuaaguggcccaugcuucuccuuuauuugcuuccugcugaaaggccagcuccuccagagcagaaguucugguaacuugcucagggccauguccccaggcacacaguaaaaguacucaggaaacauuuuuuaaugaacgaacaacaccuaauguuuuaagcacuucuucuaugccaagcacuccaaacugucucacuuaaucccuauucaagaaagggaaagaagugcuauuauaacuccuauuuuaaagaagacggggcugggcgcgguggcuuacaccugcaaucccagcaccuugggaggccaaggcaggaagaucacuugaggucaggaguuuggaaccagccuggccaacauggcgaaaccccaucucuauuaaaaauagaaaaauuagccgggcacgguggcucacgccuguaaucccagcacuuugggaggccauggccggcagaucaccugaggucgggaguucgagaccagccugaccaacacgggaaaaccccgccucuacuaaaaauacaaaauuagccaggcgugguggugcaugccuguaaucccagcuacucaggaggcugaggcaggagaauggcuugaaaccaggaggggagguugcggugagccaagaucgugccauugcacuccagccugggcaacaagaaugaaacuccgucucaaaaaaaaaaaaaaaaaaauuagccaggugugguggcucgcaacuguagucccagcuacucgggaggcugagacaggagaaucacuugaacucaggaggcgagauugcagugagccgagaucgcaccacugcacuccagccugggcaacagagccagacuccgucucaaaaaaaaaaaagaaagggaaagaagugcuauuauaacuuguauuuuaaugaagaggaggcugggcgcaguggcucacaccuguaaugccagcacguugggagacugaugcaggaggaucauuugaggcgaggaggucgagaccagccugggcaacacagcaaggcccuguaucuacaaaaaaugaaaaauuagccaagcgugguggcacgugccuguagucccagcuacuuaggaggcugagagguaggagaaucgcuugagcccaggaggucaaggcugcagugagcagagauggugccacugcacucuagccugggugacaguauaagacccuaucucaggccaggcgcgguggcucacgccuguaaucccagcacuuugggaggccgagguggacggaucacaaggucagaagauugagaccauccuggcuaacauggugaaaccucgucucuacuaaaaauacaaaaauuagccaggcgugguggcgggugccugcagucccagcuacucgggaggcuagggugcgggaaugccuaaggccuuccuucuggccagccccugaggcuaaaugacaagggucaagagggagugaugcccuccuuucuccuuagggccaaaguucuaucugcuggugcaccgcagacaagccaggggucucaaacucaaagguuccagggccaggaggcuccaagcaaaaugaucuaggccugggugagugcuagggaguaguggggacuguggcagcuggaguggccacucuuagucugaugggacagugacuggugcuucugaaaucgaagccauuacugccacaagggacaaaggcucagcaacgccaggugaaacugauuacaacaacagccaccaugcguauaagacacaugcacucggcacgcaucacccaaucacccaucuaggccccaggguaccaguuaccacccucagcuuacagaaaaggaaucugaggcccagaacgccaaauccacguggccgagucgcacagccagacaugguggaaccaggccuuaggcccacagccuuugcaugacaacucagaacucuauagaucugagugucuuagagccacaagaaauccggauauugacuggaaaucuaacacuggaaagucuuauuaaaaacaaaagcuacgcagguaaaacaaaagacccagcaggcaggccuuggcccccagagccagugaucuggacuuccagcuauagggcugaacuaacugggcuguucccacucggaccacauccuuagaaaauccaggcucggcgcaauggcucacaccuguaauccuagugcuuuuagaggcagaggcaggaggauugcuugagcccuggaguucgaggcugcaaugagcuaggacugcaccccuccacuccaaccucggcaacaaagagagaccuuaucucuuacacccccccaaaaaaaaguaagccuuguuugagccccucauacccaaagagaggccuuuuuacaacuuuggcuuucagguacugaauuaauacucuuaacgaggccagccauggugguucacaccuuuaaugccagcauuuuggguggccgaggugggcggaucaccugaggucaggaguucaagaccagccuggccaacauggugaaaccccaucucugcuaaaaauacaaaaauuagccgggugugguaacgcgcgccuguaaucccagcuacucgggaggcugagguaugagaaucgcuugaacaugggagguggagguugcaguaagcugagauaacaccacugcacuccagccuggggaacagagugagacucgguguaaaaauauauauauaaugagcaacuccugcauugcaggauucuaggaggucgccacaggaaccagcuccauacuggccggcagcugccagacaccaugguagacaggagagaaaggcaagggguagagggacugaggagagguaaggaugggagagagacccagguucccaacccagaacaccuaacuccucacuuuacagccuccagugagaguguucugcucagcuaucugagccucaguuuccugcucuguaaaauggggauuauagcaaugccucccucauaaggcuuaaguguguaacgugaaagcacuuucauucugguuagcuuuugucccugauagcaaaggaaccagccagauaaacaacaauagccccauccauguagaccuacuaugugccaggcagugcguuagguaaguaagcacuuuuucuuuucuuuuuuugaaaccggaucugguucugucacccaggcuggaggguaauggugcaaucacggcucacugcagucuggacauccugggcucaagcaguccucccagggccagccuccugaguugcugggacuacaggugugggacuaccacccuaccuggcuaauuuuuuuauuuuuuguagaauggcaucuugucauguuacccaggcuggucuuggaacuccuggggcgaggcuugguggcucacaccuguaaucccagcacucugggaggccaaggcaugaggaucacuugagguaaguaguuugagaccagccuggccaacauggugaaaccccgucucuacuaaaaauacaaaaauuaguugggcuuggugguagacgccuguaaucccagcuacucgggaggcugaggcagaagaauggccugaaccugggaggcagagguugcagugagccaagauugcuccacugcacuccagacuggaugacagagggagacucugucucaaaaaaaaaaaaaauaaauaaauaaauaaaauaaaauaaacuuguuuaggagagucaaccaagacuuagagaggccaagacaaccugugcaaggucacaaggcaagugaaagagacagagcuuugcaaacaccccccacccccgucccagaagccugggcaggcaggaagauggucacucaaaggggcccacaccacaguccagccugagaucaggccaggcccagcuggcugcaaguccacaccuuuccaccacgguagacagaaggcaaugagcuagagacaagguagcaaaagaggagauuugugcugcuuggagcaaagccccaaggcucugggauggcagacacaaggccuuacgccagccuaguggccuugggugaucacagucccuucugagccucccagcucagcuaagguggggaugauaacacagccuccaccccacuccuuacuugggauucaagauguugaaucaagaagggacauuaucccuugacaaugauaacaacaauaacaaugacaauaaugacaggaggaggauguuaucauuuggcagccacaccaccacaaaugaguaguuccuggaauggagaaguggccgcccaucugggagacaagaaaggcaagagggguuggugggagggagagguggcugcacgggcuguucucauucauuugcuuccugaauccuggaaacagccccagagaguggaguuugcccacuggacagaugggcacaccgcggcuucucaaggcuguccagagaaggcuacaucccagcgcuagccacugaggccugaucacgcaagaagccccuucccaggcuccaaaggagggcccccaauuuguaggcuguagcugggaggcgggccccuguguucuagcacucggaaaggaauccugaaguaagguacccccagaguccuccuuccagcugagaggggaaguaggguccaaaccuccuccuucagcucuguucuccccucuacccuccuaccaccccuuuccagagccguugugccagacacucagggguagucaugggcagacuaggagauggccagacagacagaagaauucacacggaagagaggagccagcgcuagccaggaaucaagcuguaagagucagccagagagaaucaaacaggguccccuaggagucagcuagccagucagacaguagaggccagcuggugucacccaacagagggacugcucaguguuaaagucugugaggggcacggaugggcggccagacagcagaggucacccuggacagcuagccagacagcagggggcugccaggugggacuggacagauggacaaccaaauggugguggcagggaggcuugcccaggacagagagacagccaaccagacggcgggggcagcuccagauacaagaacaagccagccagaccgcagcggucgccccaauagauaucuagauggccgguuucaccucugauggacagcccgaaagagcagaagagggaucuaccccagacccacggccaaccagauggcagacuucacccacgaaagcugggaccagauggaccgcaggguuccagcgcaccuccuguccuacggcgcccuggcccgugacaccgccccuggggcccgggccugcuccggagccccugcagggaguccucugcccagggcgucccacagggcccgccuccccgaccccguccgguuccccgccgcgggcacgcaagcgccgcaguuacgccggcggcgcacggcgcgccauucccgguccgcccuccgcgcccuaggccgccacccgcccgcgaucccugccgcgcccgcucaccggcccacgaaguucuccagcaccgagcucuugccggcgcucuggccgcccacuacagcgaucugcggcagguccagguggcagcucuggccgauggagcugaaggcguccugcaguuuguugaccagcgggaucagcucuuccaucccgcgguugcccauggcgccggcggcccccggcccgagcgcccugcgcuccucgcccgccgccgacccucaacgaccuggccccgcggcgucuguagccguugcuccccgcccgcccgggccucggcaagacgcccgcucccggcucggccucacggucgccgccucauccgguucucaggcgacacccgacccgagcgaccuc

SEQ ID NO: 192026 - RNA, 8654 nt, Homo sapiens
caaauuugcgcggguuggagccuggcguagucauggccgccuuccgcgacauagaggaggugagccaggggcugcucagccugcugggcgccaaccgcgcggaggcgcagcagcgacggcugcuggggcgccacgagcaggugguggagcggcugcuggaaacgcaagacggugccgagaagcagcugcgaggugagggucggagcguggucgcgggcccacgggggaaggggcccgggugcugggagggggcgaccaggcccaccucaaaaccccuucucuccuggacucucccaucuccugcccuaugcccccugggacggcccccucugagccuuaguuucaccaucugagaaaucggcuuuaugacagcaaccaucccccaccccccagggguuuagugguaaauauaggagucuggagggguuggccccuucugagcucuccgugagcaggagcugggggucucaggguuugaacuggggcucaggagucaaagcuccggguuugaauccuagcacccauccccauguccgcugugagacuugaggugaguuucuuaaauucucugugccucagcuuccuuccuugucaaaugguugugacaauagcccaucccuucuuccugaaggcauucagauguuuuauggagcaucugcugcugccaggcccugggcucaccgcaaccuccaccucccggguucaagcuauucuccugccucagccuccugaguagcugggauuacaggcgcuugccaccgcacucggcuaauuuuuguauuuuugguagagacggggggucaccacguuggccaggcuggucucaaacuccugaccucagguaaucugccugccucagccucccaaaguacugggacugcagacgugagccacuguguccggcccaucuucacuaucuguaacugcacaguucaguggccuuaagcacauucacacugcugugcaaccaucagcaccaucauccaucuccagaacuuucucaucuuuccaaacugaagcucuguccccaugaaacacucacuccccauccccuucucagacccuggcacccaccaggguucuacuuucugucucaaauuugacuccucuaggaaccuuacgaggaauuguacaauaucuacccuuccuaguggaaucauacaauaucuacccuuuugugucuggcuuauuucauggagcauaauguccuccagguucauccaugucauagccuguaucagaauuuccuuucauuuuguguacuuacugugagacagagccucgcuccauuacccuggcuugaaugcaguggugugaucuuggcucacugcaaccucugccucccagacuuaagugauccucccaccucagccucccaaguagcugagaacacacuuaugcgccaccaugcccagcuaauguuuguauuuuuaguagagaugggguuucaccauguuggcuaggcuggucuuaaacucccagccucaagugaucgcccaccucggccucccaaagugcugggaugacaggggugagccacuacgccuggccagaauuuccguccauuuuaaagcugagucauauuucaugauauagaaggauggaccgcauuguguuuauucauucauccauccaugggcacuuggguuguauccaccuuuuggcuguguugaauaacgcugcuaugaacacgggugcccaaauaucucuucaagacuguauuuuuuuuuuccuugagacggagucuugcucugucacccaggcuggagugcaguggcgcaaucuuggcucacugcaagcugcgucuccuggguucacgccauucuccugccucagccucccgaguagcugggacuacaggugcccgccaccacgcccggcuaauauuuuuauauauauuuuuuuaguagagacgggguuucaccguguuagccaggauggucucgaucuccugaccucaugauccacacgucucggacucccaaagugcugggauuacaggcaugagccaccgugcccagccauauuuucuucuuuuuuuuuuuuuucccaggacagucuuacuccgcugcucaggcuggaguacagcagcgugaucucugcucacugcgaccuaugccuccuggguucaagcaauucuccugccucagccugccaaguagcugggauuacaggcacgugccaacaugcccagcuaauuuuuguauucuuaguaaagaugggguuucaccauguuggccaggcuggucucaaacucuugaccucgugauccgcccgccucggucucccaaagugcugggaauauaggcaugagccacugcgcccagcccaagacucuauuuucuuuuuuuuauuuuuuugauauggagucucgcucugucacccaggcuggagugcaguggcgugaucuuggcucacugcgagcuccgucucccggguucacaccauucugccucagccucccgaguagcugggacuacaggcacccgccaccacgcccggcuaauuuuuuuuuuguauuuuuuuugguagagacagaguuucaccguguuagccaggauggucucgaucuccugaccucgugauccaccugccccgaccucccaaagugcugggauuacaggcgugagccaccacgcccagccaagacucuauuuucaguucuuuuuuguauucagccagaagcagaucaaaugguaauucaaaguuugauuucugaggaaccgccauacgguucucccugacagcugcagugccagggguuucaggugccuuauacagucacauuuuaugaggaggccugggcugagccuugauuggccuauggagccaguccacgggguggcucaggaacgguguuccuggcagcguggauugcaaaugcaaaggucaggaggugagaaugaacuuggcaagcagaagaugagcucagcagccgccugacugccaggccuggagagugcccaggaggagucugaauauuauccugaaugugaugucccaagcaggcucuucccuccuucccuccuccuucuuccaccccuccauuaacucccccuccuuugauggcuugaggagaaagaugugacucggccagccuggcuguuagcagaauggaugaaucuggggccaagaaaacugagaaucaggauccagggauccuaggcuuugggucaaacagauccaguucacauccuagguuuggagcuauguaccugugggcgagucacugaacuucugucucuggaccuguuuuucaugucacagauguggggcagaggaguuaaaguacacccucaggcugggugugguggcucacgccucucaucucaacauuuugggaggccgaggugggugaaucacuugaggacaggaguuaaagaccagccuggucaacauggugaaaccuggucucuacuaaaauuacaaaaauuagcuggccguuguggcgcaugccuguaaucccagcuacucgggaggcugagacaggagaauugcuugaaccugggagguggcggcugcagugagcugaggucacaccacuguauuccagccuggaugacaaagcaagacugucucaaaaaaauaggccaagcacaguggcucaugccuguaaucccaacacuuugggaggcugaggcaagcagaucaccugaggucaggaguucaagaccagccuggccaacauggugaaaccccaucucuacuaaaaauaagaaaauuagccaggcaugguggugcaugccuguaaucccagcuacucgggagucugaggcaggagaauagcuugaaccugggaagcagagguugcagugagcugagaucaugccacugcacuccagccugggcaacagagcaagacugucucaaaaauaauaauaaaaguuuaaaaaaaaaaaaaggccuggugcgguggcucacaccuguaaucccagcacugugggaggccaaggugggcggaucacaaggucaggaauucuagaccagccuggccaacauggugaaacaccgucuccgguaaaaauauaaaaauuagccaggcgugguggugggugccuguaaucccagcuacucaggaggcugaggcaggagaaucacuugaaccugggaggcggagguugcagugagcugagaccgugccauugcacuccagccuggaugacagggcaagacuccaucccccccccccaaaaaaaaaguauccccucagcugugugagaauaugucagguaggagcaccuuauaaugaacagccaugggguagagauuacuacucagggaagaauucaagaagacuugguuguccuucgggagggcggacagacagcgggugggaaggcugugugagccagccagagccucagcuguccuaacaggaaaucagcaggccccauccgaaccagaccgaucaagaaauagcagcauaagcaaguuaacuuagaaauguggaggccagugccagagaaaacagcuaaaacuugaaaguggcugcuucagagggacggagaggcuuggagaagggugugugcguguguguucauguuugcagaaccauauacaugucauacucugauuaaaaauaauguaaguuucuaaaacuuaaacaugggcccuuugggaagcauuuuuuuuuuuuuuuuuuuuuugagacggagucuggcucugucgcccaggcuggagugcaguggcgugaucuuggcucacugcaagcuccgccucccagguucacaccauucuccugcuucagccucccaaguagcugggacuacaggcgcccuccgccacgcccagcuaauuuuuuguaucuuuaguagagacgggguuucaccauguuagccaggauggucucgaucuacugaccucgugauccaccugccucggccucccaaagugcugggauuacaggcaugagccaccgcgccuggccugggcauuuaaucugcauucucugaguuggcagguuucuaggaaggaacaguagccaucuuuguuuuauuuugguuugcuuuggguuuuugagaaagggucucucucugucacccaggcuggagugcaguggcacagugacagcgauuauggcucacugcagccucaaccucccugguucaggugauccucccaaguaggugggacuacaggugcacaccacaaugcccagcuaauuuuuuguguuuuuaguagagaugggguuuugccacauagcccaggguggucucaaacuccuguccaagugauccuucugccuuggccucucaaagugcugggauuccaggcaugagccacugugcccagccaccaguagccuuuuuucuuuuuuuuuuuuaagauggagucuugcucuaucgcccagacuggagugcaauggcgcgaugucggcucaccgcaaccuccgccucccagguucaagugauugucccgccuuggccucccaaguagcugggauuacaggcaugcaccaccacgcccagcuaauuuuguauuuuuaguagagaugggguuucuccauguuggucaggcuggucucgaacuccugaccucaggugaucugccugggccucccaaagcgcugggauuacagguaugagccaccacaccuagccuuuuuuuuuuuuuuuuuuuuuuugagauggaguuuccucagcccccuaggcuggagugcaguggcacgaucucggcucacugcagccuccaccuccuggguucaagugauucuccugucucagccucccaaguagcuaggauuacaggcgccugccaccacaccuggcuaauuuuuuguguuuuuaauauugacaggguugccgugcgcaguggcucacgccuguaaucccagcacuuugggaagcugaggcggguggaucacgaggucagcaguuugagaccagccugaccaacauggugaaaccccgucccuacuaaaaauacaaaaaauuagcugggugucguggcaggcgcauguaaucccagugacuugggaggcugaggcaggagaaucacuugaaacuggaaggcggagguugcagugagccaagacugcgccacugcacucuagccugggcaauaagagcaaaacuccgucucaaaaaaaaaaaaaaagacaggguuuuaccauguugaccaggcuggucucaaacuccugaccuuaggugaucugcccacuucggccuccgaaaguucugggauuacaggugugaaccaccaugcccagccuaauuuuuuuuaguuuuguagagaugggaucucccuauguugcccaggcuugaacucuuggccucaagcgauccucccgccucaggcucccaaagugcugggauuacaggcaugagccaccaugccuggccaacuauuuuguuauauuuuaggugugugaaggacgaggcuuuauuuuuaguguauuuaaauguguuuuggugaaacaguaguuguacaaguugccaguagaacucucuggacacagggcugcagacaaggggcauguuucuugccaguggaggcaaguggaaccaccuucucucugcucuccuuggggaaggacagacccuagggagccugcuucucuccacccugcagagauccucaccauggagaaggaaguggcccagagccuucucaaugcgaaggagcaggugcaccagggaggcguggagcugcagcagcuggaagcugggcuucaggaggcuggggaggaggacacccgucugaaggccagccuccuauauccuuuucugcuaggggaucagccuugcuagaaaacacgcauagggccaggcgcaguggcucaagccuguaaucccagcacuuugggaagcccaggugggaggaucacuugagcccaggaguuggagaccagccuggacaacagagaccccgucucuacaaaaauaaaaaaauuaggucaggugcaguggcucacgccuguaauccuagcacuuugggaggccgaggcagguggaucacgaggucaggagaucgagaccauccuggcuaacacagugaaaccccgucucuacuaaaaauacaaaaaaaaauuagccgggcguggucccagcaggagaauggcgugagcccaggaggcggagcuugcagugagcugagaucaugccacugcacuccagccugggcaacagaacaagacucugucucaaucaaucaaucaaucaauaagcugggcauggugguacacaccuguagucucagcuacuugggaggccgaggugggaggauuacuugguccugggagauugaggcuacacuccagaauaggugaaagagcaagacccugucucaaaaaaaaaagaaaagaccaggcgcgguggcucacaccuguaaucccagcacuuugggaggccgaagcagacagaucaguugaggucaggaguuugagaccagccuggccaauauggugaaacccugucucuacuaaaaauacaaaaauuagcagggcaugguggugugugcuuguaaucccagcuacucgguaggcaggggcuccagaaucacuucagccugggaggcagagguugcagugagcugaggucgugccacugcacuccagccugggugacaaagcaaaacucugacucaaagaagagagugugcguaaauagagccaagacccugggccucccagcugcaguuagcgcaggggcagcccucucucgaaagccgggguccuuaacgaccugcccuacucagcucaccagagagcuggaagagcucaaggagauugaggcggaucuggagcgacaggagaaggaggucgacgaggacacgacagucacaauccccucggccguguagguucugccaaaacgugugccugccugugccuccuugugcaguccggcucuugguugaaguuggugcuggguaacuuucuuuuuuuuuuuuuuuuuuuuuugucuuccuguacagguacguggcucaacuuuaccaccaaguuaguaaaauugagugggauuaugagugugagccagggauggucaaaggcaguauccuuuuuggggagccauuuuaacccuugugcacuguagguagggacauaaaauggugcauagcaggacccuguaaaaauuagccgggugugguggcgugcaucuguugucccagcuaccugggaggcugaggugggaggaucacuugaggccaggaguuugagaccagccuggguaucagugagaccccacgucuauaauaaauauaguaaaguauagcaggccaagugugguaccucacgccuguaaucccagcacuuugggaggccgaggugggcagaagaccugaggccaggcgugguggcauaugccuguagucccagcuacucaggaggcugaggcaugagaaucacuuaaccacuggagguggagguugcaaugagccgagaucgcaccacuguacuccagccuggccuacagaaugaaacuuugucucaaaaaaaaaaaguaaaggcaguauccuuuuccccgugggguugugugaggggcugugugucccgggcuuuccuuacaucugugccucaguccaucauggccccaguguggcccagcccauccaccuggacagcacccagcucuccaggaaauucaucagcgacuaccucuggagucugguggacaccgagugguagccaggagccucguggcugcgucuugcac

SEQ ID NO: 192027 - RNA, 15514 nt, Homo sapiens
uugggugggggaucacauuuauuguauugaggucacaggucaagucauucacuaguccccacuaggagggguggcagggacagggcugggggugguggggcgagucaccaagguggggggcccagggagggcaagcuccuuuacccaucuuugaaggcuguuggggccugggaauguggaccagccccgccugggccccagagcagggcacgaagccccacaaagguccugccgccacagaggagggcaacagagccacaggcaggcccagaggggcggguggacggcacugcaggggcuggcuucaugccuucuugagguucuggggcaagagaaagaccagauuagaaagcuggggacagcuggacauggugauguuugccuguagucccggcugcuugggaggcugaggugggaggaucauuugaggccaggaguugaccagccuggagaccuugucuauuuucucuuauuauuauuauuuuuuuuuuuugagagucucacucuguagcccaggcuggagagugcaguagcaugaucuuggcucacuccaaccucuaccuccuggguucaagugauucuugugcuucagccucuugagcagcuggaacuacaggcaccuaccaccacacccagcuaauuuuuuuguauuuuuaguagagaugggguuuuacaccauguuggucaggcuggucucaaccuccugaccucaagugauccgcccaccucagccucccaaagugcugggauuacagaugugagccacgacgccuggccuauuuaguuucaaaaguaaaaaaaucuuuuuuuaaaaagcaggggauggccagacaugguagcucaagccuguaaucccagcacuuugggaggcugaggagggcggaucacgaggucaggagaucgagaccaaccugguuaacacagggaaaccccaucucuacuaaaaauacaaaaaaauuagccaggcgugguggcggcgccuguagucccaauuacucaggaggcugaggcaggagaauugcuugcacccaggagguggagguugcagugagccgagaucgcgccauugcauuccacauuccagccucggcaacaagagugaaacuccauccaaaaaaaaaaaggcaggagauggccgggugugguggcucaugccuguaaucccagcacuuugggaggccaaggcagguggaucaucugaggucaggaguucgagaccauccaggccaacauggugaaaccccaucucuacuaaaaauuagccaggcaugguggugcacaccuguaaucccagcuacuugggaggcugagacaagacaauuguuugaacccgggagguagagguugcagucagcugaggucgcaucacugcacuccagccugggccaaagagugagacuccaccucaaaaaaacaaaacaaaaaagcagggaacauggggacacagguugauagaguggccauguggguccaucuuccucagggcccgccgccuccccuugcuggggcaggccgacgagacuccaccuccccgcccaccucugcgcccauccagcuagagcucgucauggucgucuucggugggugcuucaggcgguggcuccgggcaggcggcuggcgucaucagcuccaugagguacucgcagcgacugggcucuguggugcuggucaccauggucucuuucccgcacaggaggcgcaccuggggaugggcagacgggugcucgagaggguucggcugggccaggccugggucuccccgccccagcuccccugccuugcaggcacucacggugguggagcgguuggggcccugccagcagcccgugccuugcucauacuucauggcacugaacuugucguggucggggccaauccaugagccccaggugcugugagagacacagggugcugagggcugggccggugucggggcaccaggaggaggcagagggaaggggccagcccaagccacucacccaaggcuggugggagagcccccgaguuuggguuucugcgagacaagcuugaaggggcagaggcgguagacguaucuguggaggaccgggacauauggguuggggaacgcagggauuccagccuccucccacagccaccccccaccgccuccuccaguccccacacacaggguaccuccaacuccaaugaccaacccuaaaccuggccccuggcuucugcucccccucaauauggaaggcagcacucucgggccccacccgcagaugguuccccaaccaucaggaaacugccggugccacuuccggggccacccgccucccacccugccagugggggccccugcauuccugggacgcacucguugguggugagcucguagcacuggcuguacagguaagcaaacuccccguuggggccaaagucaaaagaaaucucuugcuccagguuccuggaaggggaggcggagcgguuaaggggcagcuggggacgccagugccugacccaggacgacagacacaggagggucuggcugagcaauggugcccaggcuguccucccugccaccucccagggacccucccugcagggaccaggcccagccugugguugccucagugauuccccaucaccagcuccccugggagucaaggagcagucgcugugggacagguguccccgcuccucagcccccgcuaccugauggacuccuccauguccuucagcgaccgcucggccuccucgaacuuguugcgggccuccugggcagcugggagagggguuggaggucagagauguccucaaccccauccaggaggauggggaacgggguuccauggauguggcugugugcucccauacccucauuuugcucuggccaaggacuucaccccgacagccuugagggccucaccagcuauagagcagccccgacuugcugcccaggcucccagcuccugagcgaguggggccaggagugacacaaacaagcugcggcccuuggggaggcagaagggccccuuggggcuggcgagggugggacuggcuuacccuaggcccccuuccuggacuccccaagauacuggggcuugugcuggccgagucagagcagggucuaagcucaggaucuucccucgaccugugccaccacggcaggaaacgcugggcccacccgaggagccuggcccccgcccacccucaccaucgaugaaggccugcgucugcucgucguagggcggcauuuugucuuccucagcagggcuggccggcugcgggggugacaguggcgguggggccuccuggggcaggggcagggucagugaguagcccuucccccacccucucugucuccacuucucccccaaacacggaccuugggcugcucccccugcaccucggaauccuccuccuccuccucuucuucagccucuucuuccuccuccuccuccuccuccuccuccuccucugugggcgacgagggcacuggcggcugcuccuccuugggcuccgucaagucaggggcagaaggugcuggaaggucggugggcagugccuggcgggugagcagugcggucgguguuguggacucaggguccacccacacccucaggcucacaccacagcccaaggggcagccucggugucucugccccuccugcggggccugcagggaggaccgacagcuggggucggggggucucgguggggggugcuggggccacccagcuggccaggguggccaggugccagaaccagaggcagcuccuuugugaggcggggugggggcaguguggugggaggaccaaguccccucccuucuccuccacugaccucggaccgguacuugucccugauggcggcccagacgcggucguagaaagagguggcgucugucuguguguccccacugaggagggccuguguguguuggggguggugucaagaucuaggccaccacgugucccccaucucggccaccccggcacccgggcugcggugccaggcacgggagggcugggccccgggcccugaugaccaggccagggccacgccagugaggcacugcggccaggagggggcagcacaggcccgugggaggggaggaggagaccaggggcuggagugguugggggcacugagacagaaagagagaagcagauggacaaacggacguacagauggaggaagagagagcccaggaccagagagggccaggcccuccaagggagaggccaaggcccaggcugcagauggagagggagaaacccaggggugggcagagaagggaggccagaagccaggggccacggggaaggaggaggauaggaaaggagacagacaggggacgagggugugggggaggaggggaauagggcaggacaggggugggggaggaaggggauugggugcucaacagcggguagagugggggcaggugcggggaaacgggcuccagcgcgaccuggcuccaucccggguccugccaggcgggaagcggcccugaguggcugccaucccagcucacccagaggaggcaucccaggccagcaaggagcuuuccuuggucccccuccugugcccugaggucacccuggggcaaugcucccuagaaguccccaaccaaggggcagccggggguaccugagcuuccgcuucugacaacgccccauccccaucuguguccagcuccgggugagucugcagcucagucaccgagacccugcgggggcguggcagaagcagacuggaggggugaggccccaguggcucucaguugggggcaccauguggcccaccuguucuucccugcagggccccacccuggaacuugcuucaggaccucaagguguaggggccuccccacccuccugcccccuccucaggacuccaugaccccaaaggagcucaaaguaaggggugggacugggagauaccuggacccccaaauguccgaugaccucucuaccaacucacccagguggcaccuccuuccaccccaggacccggcacauugaagcugccaucugccuuggucccccacccagcaaagcccacccccacccuugcccauucggucccucugaagcccccugcuccuuggcaccugacaucuccuaggcuccccgugugccucucagcccccaaaaguccacccuccaccagguaacccagcaagcucagaggcacagccaggauucgaacccaggucuggcuuuccccagagcguaguggggcugggaaaagccauccgaucacuagaugccuagacacacucccugaggcugagggucugugcccagcuccuggggagaggguggucccccuaucuccucgcccagggcauccuggaccuggccauccacgaguaagaggcggggucacacggggcuugggaucagccuggaccccacgccgggggaacccaaggaggaucuggcugguuucuagaggcgaggguggcggggagggaaacccaggcccacggaaaggugggcagcuccaacuaggggacacucacgucccguccaugucaucauccagcuccuugaaggcaucagccgccagcuccugcuccuguugggccuuggcagcagccagcugcucuguaaagaagccaccucugucacccccugcccacccaccggcucccaucagcccccgcaccccacagggucguuugccaccaagcgccuacuauaugccuggccccaugcuggacccugaggacacgacuguggaggagacaaaggucccugcccuuaccaggggagaacagacgaagagcaaggugaaugguugaagccugguuguguugggggagaccgggacaagguggggagugcagaggcaggagggccacugguggggcuggagcagggaggugggaacccagguggcagagggcagcccugucaggccacuguugggacagaggugggggcgagggcagaagccaggugauaacaagggcuggcccaggcuggggacugaggaagaagcacggagcagaggcagauucuggggagacgcagauggagugcgcagacggucagaggugggaggugggguuggggagaggagagcgaccacugagacuuuagguuuaggaccuggcagaggcaugucggggcagggcuggcaggaaugagacuucauggccaaggaugcugggagauggggaggauacagggagggagaccgguccugggggcaucuuggggguccccagggcugcucccaggaagaggggccagccggacagaaggggaccgagccucugucccaaaagucccuccuuugucugucgcuacucuaaccuaagcagagcggaaagcagccacaacagcggcuccaaugauuaacuuccuacuguauaccaggauucaguucccacuguauaccaagcuccagcuugguccucuacaaacagaauaaaaacagcugguauuuccucuagagagucuuaggucaccccaggacaucccgcaugucccaggagacccggcugacacuguucugagucucacagaugagggccugaggggucccugaccuuucugugggugaagggaccugcccauaaucaccuagccagugagagguguagccuggggcccaauccaggccaucuacccucggagcccuggcucagccccgccacccuuugggaaucugggucaaaacauggcgcuucccucugauuccacagcuccacacugagaacacauccugaggaaaaucaggccugagcuugcccagacccaagugaaaggaagcuugcaacacgacaaagauucaggggcagacagagccagacagugaauucccuuucuacaugcaauguggccuuaccaaaaaacaccaggcucuagcaccaaaaacaaaugaagaagggaaauaauaucuucaguugcagacagagcugggcaccguggcucaugccuguaaucccaacacguugggaggccaaagcaggccaccugaggucaggaguucaagaccagccuggccaacacggugaaaccccgucucuacuaaaacuacaaaaauuagccggcugugguggcaggugccuguaaucccagcuacucaggaagccuaggcaggagaaucacuugaacccaggagguagagguugcagugagcagagaucgggccauuggcacuucagccuaggcgacagagugagacuccaucucaaaaauaaauaaacuaaaaaaaaaucuucaguugcagacaaagggccaaaccccagauagaaaaagcucuuuauuauuuuuuuuagaugaaguauugcuuugucacccaggcuggagugcaguggcgagaucucagcucacugcaaccucugucucccggguuccagcgauucuccugccucagccucccaaguagcugggaccacaggcagaugccaccaugccaggcuaauuuuuuuuuuuuuuuugagacggagucucacucuguugccaggcuggaauauaggggcgcaaucucagcucacugaaaaccuccaacuuccugguucaagcaauucuccugccuuagccucccgaguagcugggauuacaggcacacaccaccauguccagcugauuuuuguauuuuuaguagagauggguuucaccauguuggcuaagauggucucaaucuccugaccucgugaucugccugccucagccucccaaagugcugggauuacaggcaugagccacugugcccggccauaauuuuuucuuuuaguagagauggcguuucaccauguuggccaggguggucucgaacuccugaccucaggugaucugcccgucucggccucccaaacugcugggauuacaggcgugagccaccaugcccagccacaaaaaagcucuuacaauuagugaagacaaauaccaaacaccugauaggaaaaauggucacuggauuaacuaaguccugcuaaagucauauaacaaaaucuacauugauguuaaaaggaaguaggcggccgggcgagguggcucaugccuguaaucccagcacucuggggggccaaggcagguggaucacuugaggucaggaguucaggaccagccuggccaacauugugaaaccccgucucuacuaaaaauacaaaacaauuaguuaaaugugguggcaggugccuguaaucucagcuacucaggaggcugaggcacaagaauugcuugaaccugggaggcagagguugcagugagcugagaucacgccacuguacuccagcccggguggcagagggagacgcuguuucaaaaaacaaauuauuuaaacaauuuuuaaaaaggaggcuccugacauaugccacaauccaagcgaaccucaaagcacacaaggcgaugggcagcaugaucaaaaaccugcugaaacugacaacagauaaugagcgggagacuccuaggcccagaccugcucccacccaggacugaaggugaguccuuggccauuucugccauaccuucccacagcuucuggugcugcucuuuggccucucucucuggcuucucagcuuccuccuucacuguccgcagcaucuccaccuggucuuccagagacuucuucccagccuguagcucaaugagcuuuuucugggugggcagaaggcaagagaccagcucuccucuguucugccuccuccucauugacuacuaccucccugccucuacuccacagggcagcagggagauguuccaaaacacacaccaagcugggucucucucccgagcugggguucccuguagcccucuggagagaagcccaaacgccucaauguagcccgcaagggcccagguaaucaggccccugccugauucuccagccccauuugccccaucccuaucuuacuaggauccagucgcccugacaacauucagacccccaaacgcucuucugccuccgguucuucaaacaugcuguuccuucagccuggaacacucuaccuggcuaacuccaaauuacccaacagauuucaugugagauagaggccuccuccuccaagaagccuuccuugccuccugcccccaaggcagagagggagaggaacugggcaagaagucucuaccccgaauuucccuuuguccagcagcccuggcuggcugucccucccacuagcaaugaaugccuugaggcaaauccaggucgguuuccagccuccugcccaguacacaggcaaggcagggagagacacacaccuagggaccccaaagcacccacccuauggaauuaauccagcugcuacuggcugacguuaucuuucuaacaucagaacuggggagucaucuggucaucagcccaucuuacaggcaauggcaccacagauccgggguacagagaagcaacccucccauccccaggaggcagagaggcccuuccagccugcuuuagucugaugcccgaggcccugauaaacaccuaagcugacagccucccccucgggaacuauuauacuuagccaaugacuaaacgccuagcacacaacugagaaagcaaagcuccgaaaggcagucacuugccccagaacagcagucaggggcaaaccccuccccagccuugcaagcccacacuaugaggccucaaggcccagaucacccuggggcagcccccgcggguuccuuaccugcuucuccucccgugccuucuuccaguccucaauaaggaucuucuucagacggaacccuucgcgggugaccucggccaucugcugcagggacucucucuccuuacggcccuucucucugcggugcggagacacacaggcaccaccaguggggcacuuaggauccaccaggucugccucuuccaaaauagcucaauccagcuguggccccccaccaagccaugcugggaaagaugagagcaagccuuccucccagguucucucaacaucagcauccuucauuccuguccuugaaagaggaacaguggguucuguaagccccuggggucagggaagggacuagggagugccaggagguggagcuagauaucaacucucaagagacaggagaucagcugggugcagugguucaugccuguaaucccagcaguuugaaaggccaaggcaggaggaucacuugagcccaggaguucgcaaccagccugggcaacauauaaagacccugucuuuacacauaauuaaaacaaauaaaaaaaccacagaagacagaacagaaaucaugacucccagacaaaaagacaaucugguuacuaaguguguugguuggcugggcgugguggcucaugccuguaaucccagcacuuugggaggccaaggcgggcggaucaccugaggucaggaguucgagaccagccuggccaagauggugaaacccugucucuacugaaaaugcaaaaauuagcugggcgugguggcgcccagcuacacgguguaaucccagcuacacgggaggcugaggcaagagaaucacuugaacccggauguggagguugggguaagcaaagaucaugccacugcacuccagccugggcaacagagcgagacucuaacucaaaaaaaagugugggccaggggcgguggcucacaccuguaaucccagcacuuugggagaccgaggcgggcagaucacaaggucaggagaucaagaccauccgggcuaacacggugaaaccccaucucuacuaaaaauacaaaaaaaaaaaauuagccagguguagcggcaggugccuguagucccagcuacucgggaggcugaggcaggagaauggcaugaacucgggaagcggagcuugcagugagcggagaucacaccacugcacuccagccugggcgacagagugagacuccgucucaaaaaaaaaaagaaguguguugguuguguucaauccaccuucuauuuaaaagauguggaauccagagaguuuuacaccaucugccaacaacugauaggacuuuguguuuuuuuuguuuuuuuuuuacuuuuuagcucacugcaaccucugcuucccaggcccaagcaaucuuccugccucagccuccugaguaccugcgacuacagacacgcaccaacacacccggcuaauuuuuuaacaaauuuucagccgggcaugguggcucacaucuguaauccccgcacuuugggaggccaaggcagguggaucaugaggucaggaguucgagaccagccuggccaauauugugaaacaccgucucuacuaaaaauacaaauuuuagccggguguggugguggaugccuguagucccagcuacucaggaggcuaaggcagaagaaucgcuugaacccgggaggcagagguuagagugagccgagaucgcgccacugcacuccauccagccugggcaacagagugagacucugucucacaaaaaaaaaaaaaaaaaaaagaaaagaaaaauuuuucugagacgggucucacuguguugcccaggcuggucucaaacuccuggguuaaggugauccucucgccuuagccucccaaagugcugggauuacaggugugagccacaugcccaaccaguaauuuuuuaaauuauaauuuccaauuuuuauuuuuacuuuuuaauuuuuuuuuuuuacuuuuuauagagauaggguaucgcuauuuugcccaggcuggucucaaacuccugggcucaagcagucuuccugccucagccucccaaaaugcugggauuacaggcaggagccaccaugagccgggucuuauuuuuucauaucagacagguaaugcgccaaggucgcaacaagguuuaagggaggcguaucucucacacgugcauaaaaaccuaaucaucguggccaagcgcggcggcuuagcacuuugggaggcugaggcgagcagaucaccugaggucaggcguucgaggccagccuggccaacauagugaaaccaucucuaccaaaaauacaaaaguuagccaggcgugguggggguacgccuguauucccagcuacuugggaggcugaggugugagaauugcuugaacccgaagggcagagguugcagugagccaagaucacgccacugcacuccagccugggcgacagagugagacccugucucaaaaaauauaaauaaauaaaaauaaaucaucaugccuaugaacuacaaaaggaucagcuggcaggaauugagaacagcuguuccccuagaugccacaauccccaccccuccguauugccucauacuuggccuccuucuguuguaugcuuuuuuuuuuuuugcuuuuuuuuugagacggagucucacucuguugcccaggcuggauugcaguggugcgaucucggcucacugcaaccucugccucccguguucacgccacucaccugccucagcccaccgaguagcugggacuacaggcgcccgccaccacacccagcuaauuuuuuguauuuuuagugagacggaguuucaccaugucagccaggauggucucgaucuccugaccucgugauccgccugccucagccucccaaagugcugggauuacaggugugagccaccgcgccuggccuccuuccguuguauacuuuaccugccuguggguguuuugguuuucaggaccugcugcagagcgugacaauggaaaguuuagaguccaagugccggcucugcuaucuccuaugugacccuggggaagucauuucccuuucuaaacuugaguucccccaucuguugaaucgggaaacaauccuaccugcuuccagacuagagggaaagguggggauuaggauucacaaggcaccuggcacagacagagaacccgauacagaaaagcagaagagagagugggcccgauucacuggguggagccaggcaaagucuugggguggggugaugggagggguacugucacccacguacuugcagguguucucacagaugacgccgcuguuguacucgucuguuccaucgcagcagucuguggcagaggcagaagccaagaucagaccuggcagugccuccucccucccucccucuaccaccuuuccagaauccuggugcaucuucacuuaccacaaacaccaucguugacccgguuggaggggauauacaggggcuuauagccaguguuggugcaguggaagcugccauuaggacaggcagccgugccugugaggaagaagggagggaagguuuucggagucagcucagggacagacaugucccauccauccacagauaagagccccugacccacacugcacacagcacaagaaaggaaaggaaaccaaaggaaggaaagaguuguacacugcacagccagggcucgaaauaaagcucuccagugccgccuccugccucuucucacugaggcccuucaaaacagggucuccaccuggcacgggggcucacaccuguaaucccagcacuuugggaggccgaggcgggugggucaccugaggugaugaguuugagaccagccuggccaacacgaugaaacuccaucucuacuaaaaauacgaaaaauuagccggaugugguggcaugugccuguaaucccagcuacucaggaggcugaggcaggagaaucgcuugaacccgggagguggagacugcagugagccaagaucaugccacugcacuccagccugggcgauaagagugaaacuccaucucaaaaaaaaaaauuaaaaacaaaacaaaacaaggccagguacgguggcucacgccuguaaucccaacacuuugggaggccgaggcggguggaucacaaggugacgagaucgagaccauccuggcuaacacagugaaacccuguaucuacuaaaaauacaaaaaaaaacuagcugggcgugguggugggugccuguagucccagcuacucaggaggcugaggcaggagaacggugugaacccgggaggcggagcuugcagugagccgagauggcgccacugcacuccagccugggaaacagagcaagacuccgucucaaaacaaaaacaaaacaaaacacacggucucauccaggcacgguggcucacaccuguaaccccagcacuuugggaggccaaggcaggaggaugacuugagcccaagaguuccaggcugcagugagcuacgaucaugccacuguacuccagccucagcaacaaagcaagacccugucucuucaaaacacacaaaaacaaaaagccagggucucccuucaccucugucuccugcuggauugcucuuggccccacccugucucccacuucuagggguuugcccguguugaccccuccaucugcagcaccuucgggauucaacugaaaccucaccuccuuggaggagccuucucugaccccgaggcuugggaggaggacgacucugggcuccuccagcugcccggggccauaacacugaccacugacuucugagcuuguuucugcccacucaaaggggagccagcagagguaguaucuuggucacacagacagggccuggcacugagcaguguucaauaaacaucugauggaugaacagagaaaaggcucaccuggcucgucagagccaucuuugcagucgcaauagucaucguugaccugaucaaaugggaugguggccgaaccguccaggcaggugaaaggcuuggacucaucguagaagugaugaucugcgggguacaggaagcucagcccagggcagguaagcgccuucuccaccaaauaccaccucuguccucccauccccaccagcggagcacuaccgggaaacugagucaaaaggcuguaaaugccuaucccuaaggcccaauguuggccccucccaccuccagccuggcgggagggugaacaggaggacucacuggugagggagacgccccggggccucuugaccuccacggcccagcacauggguagcagcagcagcagcggcaacagcaucucaccagacgcucugaggcccgaaacggguucugugggaggaagccuacagcggggagaugcgcugugucuucacgcugcaggaagaaagcggaucccggucagugggagagggcuacuuccagccaauuggauuccuccaucgcuuccaggcaaugaggccucacuuuguuuccgauaugggggcgaggggcagcgaucuccccaauccuggccagucucacuuugcucaaaucaauggcgaggaucucaagaucucaaaaccuccgcucccugugcccaauugugacccaauucccgccaacagaccaaagggauuaacagccuccgccguccacacccacacaugcacccuccgguugcccccuguaagaaacugaggugcccucccacccgcucguucacaccuacacgaggccggagcaaaggucaguauccaccgcaccccucuuguccagcagccgcgguuccugcugcagaaagaaagcggaaauuucuggaccccgucacuuccggucguacguuccgcaccgggaacggagacucagggucgccauguugggagaggcaggagugggggcggugccagagccgagacggccaucuugggcaggacugugaaaccuuagagaggauaguucugagggcuagcucuuaauggcggcgcagc

SEQ ID NO: 192028 - RNA, 29661 nt, Homo sapiens
ggacuugaacacacgggaccggacaggaccgaccgaggggcggcggcgaaaggcagagcgccgcgaucucugucgggaagcgcaaccuccccgggccccgcggggccgcgcagggggcguccucaaccccgcgcccgcucccucuuuccauccccugccgcccgcaggccaccccggggcccggccauccgcgcgcgcauccccggguucgggcccgucccuggcccucgagggagccgccgccuucaucgccacaucugcagcggccgcaccagaggccgcccgggcgggaccccagcgugagcaucgggcgccccccuaggagugcaccacccccggagccccccucaacacggaccgcgcccgccgggcacacaagaauggucacuguagguauuccccugucgccgaaagggaaucgggacggggaggaguugggcccaggcuccgcggagauugggcgggugcggcgggggggguaggaccaggccuagcuaggcccggguuggggggguaggaccaagccucggggccugagagugggcagggccgcgcccagagugcugagggcgcuuagagcuuggucugagagggccuuagggagacugacugcgauucgggaggcguccgacgccgcccuggaggcgggauugcccccucuccagcaggccugaugggggaggggccgcggcggcuaaggaugcuuccuccauccaggcccagaccccgcaggccgcccaggcaaacgcagggcccgaucacuggugcugggccaagccaaagcgacaaagcguccccgagagcccugggaaagcggguggcgucggaucgcgcgccccgggccucggccgcacccgggaggcgggcgucucguccucgagcccgucgaccuugcggcaagcggggaggggagaggagggggcgcgcccggaggccccgcgggcccgccgccgcugcugccgcgucccuuuguuucucggcgcuucuucgcgggccgcagccucgcgcgggcgccucgggcugcggggagggggaggggagaggagggcccgcggguugggggggcaccucugggcucccgggucuccgccccccgggagauggggugggaggccgagacagcccccuuaggccagguccaggcuccccaccucgccaaggcucugggccgcgaggugaccuugagcgcggcccgcccgccugcucgcccgcaccgcuagccccgcgcucggugcuuucagcagccacggagcuggucagcucccgagcgcgcagccccucccgcccugccacgcccugccuggccacgcccgggcacgcccaucuaggccccgcccccagggccccgggggcccggccucgcccgagcccucggauucccacucggcagcccgggcguaucccgggggcggggcuggccaguuauagccccaccccggcuccacccccgccccugccgcgcgacuccgcuccccgcgccgccgcgcguccuuugucuggucccggcgccugggccucccucuuccacucuuccuaucucuccgucucugcgugugugucucugugcauugugucucuuuccgggccccuuuuucgagucguggcuagcacugggggugggggcaugauuggcgcucccuccaugccuaagccucuccccuccuggacccugggacccgcccaccuggcucugagaaaugaggucccggaggccuggcucaccugcugugugaccucaggccguuccuuucccucucugggccucgugcuguucacccaggucugggaacuggaguguggccuccugaggaccucagaacucccgcaacaguccagcaucuccuaagcguccucugaucgguucucucauuugaaaaaggaaacuaaugcacaaagggaaagaggguguggucagaggucacacaagggccuugaggaccuagguucuccagugagcgagcccuggggcagagauguaucauggggacaggcugggaggaagagaggugacaaauuaagaccaggaggacccugcauugaagaagggcccagaaguaggaggcucagucagcaccacgugguagcccagccucaccaugcauagccacucaaugcccuauugucgccgguauccaggcaucugucacugugacuggggccaggggccgcagcugggggccgugggggucagacacaggagguuuuaagaaaaaaguggccucagguguguucacugcaaaacccauacgucagauguaugugcgaugguggaaaagaggaagagagagugaugaggccagggacacagaacgguucagagagagggcaggacaguggagaagagagggaaacagaggaagaaagagggagagagaaaccaaaagucgggggagacuuagaagaagcacuggagagaaugggaagcuucccuaacccuccaucuuuuaucugcccuccuccucccugacuuugccacccccccaucucugucuggggccagucgccgaagucccuuugaugcccauguagccaccaucccaggcugugcacuuacugcaggcuggggcagggcggguguggcuuccaucaaucugauccccauuaucagcucagccggcucagccacagaggaaacgagauacuggucccgcuaagcucuggcacaaaugggagggagaacgggugguggccagauuagcaggcuaggccucaagaaccugggucugaaccacccagucaccucuucacucugcucagguuggggacaccaugggaggggggcagccaguaacucuuucggcucuagggucaucggaucaggagucagauguugacaccauccccuccaccuccuccugucacccuggacaagucauaggucccugugacuaacccucaguguccccaucugagaaauggaggagacccuucauaccauucacugugguugugggaggucaaugaaaacuuugcacaugcucaguggaguucaaaaauaggaucuagcacgguggcucaugccuguaaucucagcacuuugggagcccaagguggguggaucacaugaggucaggaguucgagaccagccuggccaauauggugaaacaccgucucuacuacaaauauaaaaaguuagcggggcgcgauggugcacaccuguggucccagcuaccuggcugagguggaagaauugccugaacccgggaggcagagguuucacugagccaagaucaugccauugcacuccaggcugggcaagagagcaagacuccaucucaaaaaaaaaaaaaaaaaaauagggaucuagcauguccagaagcaguggcuuguguacugccaacugcucacugggcucuuauagcaaauaucagcaacucaacauagaacucuuaccucaaugagcuuaaaugcaaauucagaauccaucuccagggccagucaugguggagcucacaccuguaaucucagcacuuugggaggcuaaggcaggaggaucgcagccugggcaacauggcaaaaccucaucucuacagaaaaagagaaaaauuagccggcuggguggugcaagccuauagucccagcuacuugggagguugaggcagaaggagguuaaggcuucagugagccaugaucguaccacuacacucuagacugggcaacagagcaagacccugucucaaaaauaaacaaggaaaagaaaaaccccacaaaacucuuaaugaaccaggaugcaaauucagaauccagcuccauacaugugagaccucugugccauaccuuccuuaaggaagaacagaaaggcauagagaggugaccuaacuaucagaggacagcaugaggaggguggagucugacauguguagcccucaguaaauauuuguugaauugaauuaauagacucaaccgauggaguggguuuaaaugucaugaugcccagggcacggcagagagcagguacucagcuucgcuuugcuguuauuauuuuguuauuauauuacuggucuuuucguuaggggagugggcucuaaaguccaaacccuggaacugaauucuuuuuuuuuuauuuuuuauuuuauuuuucuaauuuuugagacagagucuuucucugucgcccaggcuagagugcaguggugaaaucucggcucacugcaagcuccgccucccagguucaagugauucuccugccucagccucucgaguaguugagauuacaggugcccaccaccaugccuggcuaauuuuuguauuuuuaguagagaugagaguucgcuguguuggccaggcuggucucgaacuccugaccucaggugauccucccgccuaggccucccaaaguauugggauugcaggccugagccaccaagcccagccugaauucuuguuucaccauuugccgccuaugcaacucuguuccuauuccuucauuuuuuuuuuuuucccuuaagagucagggucucacccucucgccuaggcuggaguguaguggcaugaucacgcucccugcauccucaaacuucugggcucaaguugauccucucaccucagccucccaaguagcugggacuacaggcaugcaccaccacacucagcuaauuuuuuuggaaauuuuuugguggaaacaagaucucacuguguugcccaggcugcucucaaacuccuaggcuuaaaugaucuuccugucucagccuccccagucacccugucccuucauugagacucucuuuccucguguauuaaauggagaaaggaaucucaucauguucaacggcaggagaaccaccuggaaguuucacaugaggaauuuuuccuggcacacaacaggcaccucaauacaugguuacgcgaucaguuaaguauuaauguuaggagacgggaaugcagagcugugcagugcauguuacugcaucacugcgggugccuugcagacauugcuaaucaacccaaugcauauuccuuuugaggccggaugugucuucagaguaguccuccaggcagcccucccaggagcaacucagccaauuggagaugcaggggagcugaccuucugugccaucuguuuuacaagaguaaaugggccaggcgugguggcuuaugccuguaauaccagcacuuugggaggccaaggcaggcaggucaucugaggucaggaguuggagaucagccuggcuaacauggcaaaacggugucucuacuaaaaauacaaaaaauucacugugcaugguggugcgcgccuguggucccagcuacuucggaggcugaggcaggagaauugcuugaacuugggagguggagguugcagugagccaagaucgugccacuacacugcagccugggugacacagcaagacucugucucaaaaaaaaaaaaaaaaaaaguagauggugaccaggugcagugacucaugccuguacucccaacacuuuggaaggcagaggcaggaggaucccuugagaccaggaguuugagaacagccugggcaacauagcaagaucccaucucuacaaaaaauaaaaaauuagcugggcaugaugaauugcacuuguaguccuagcuacuggggaggcugaggugagagaaucacuugagccugagaguucagggucagccugggcaacauagcgagacaaggcauuggccauaaugaugaaaaacagcucugcaaacagauccaggacugaaaugaauuucccuauucauacgucucugaauucacuuuugucaccuguaaaauggagaauguguucucagucuuuuaagauuguugggagaguaacugaaaauaugccucaaaguauuucccacagugccuggcacacaguagaugcucaguguaguggaaugcucauuaaaauagcaguauuaggccgggugcgguggcucaugccuguaaucccagcacuuugggaggccgaggcaguggaucacgagaucaggagaucgagaccauccuggcuaacggugaaaccccaucucuacuaaaaauacaaaaaauuagccaggcgugguggugggugccuguagucccagcuacuccagaggcugaggcaggagaauggugugaacccaggaggcggaguugcagugagcugagaucgcgccacugcacuccagccugggcgacaaagcaagacuccgucucaaaaaaauaaaauaaaauaaaauagcaguauugccccaugcaauggcacaugccuguagucauagcuacuugagaggcugagaugagaggauugcuugaguccaggaguuggaggcugcagugcacuacgauugcaccugugaauaauaacugcacuccaggcuggacaacauagagagaccccaucuuuaaauaaaagaauaauaggccaggcaugguggcucacaacugaauucuuuuuuuuuuugagacggagucucacucugucacccaggcuggugugcaaugcuggagugcaauggcacagucucaacucacugcaaccucugcuucccaagcaauucugccucagccucccuaguagcuggaauuagaggcacccaccacuacgccuggcuaauuuuuuuguauuuuuaguagagacaggguuucaccauguuggcaaggcuggucuggaacuccugaccucgugaucugccugccucggccucccaaagugcugggauuacagacgugagcaaccgugccuggcuacaacugaauccuuagcacuuugggaaacuaaggugggaggaucacuugaggccaggaguuugagaucagccugguaacauagcaagaacccaucucuacaaaaaauuaaaaaaauuagccaggcaugguggcacaugccuguagucccagcuucucaggaggcugagguguaagaaucacuucagccccggagguuuagacugaaaugagucaugaucauaccacugcaccccagucugggugacagagcgagaccccgucucuaauaauaauaauaaauaauguagguguauuaugagguacggaugauggaugugacaagccugcuuuuaauucccaugaucaugcccaugacagacguaacuaaccaauuccagaugcuuuacagcauauggcuuuagcuacuaccccaggccagugugacuauaauuuggaguuugcagcaaaauggagcagaggcucagaagcacuaaguagucuaucugaggacacacagcugggaaauguuagagcuggcacuguucuugguuggcaguggaaguuggaaaugcacacucuggaucagaaaaacucauaugcaaaucccuguuccaccauuuauaugcugcaugaucuuuggcaauuuuuaaaauaucucaguuuccucauguauuaagugggggugaagugggggaggaaaaauucucuuuuuaggauuguugugaauaagaacagaaaacuugcauguagagugcuuugcacagugccuggcacacaguaguagccaauauuugggaacaauuaagauauuggagcuugagucagggaugguugagauaauauguaccugcuggcuguuucuaguuguguggccacagcagacauugcuaaucaaucacagugaucuuuccuacugaaaacuguaugugauuucuuuuucuuuuucuuuucuuuucucuuuucuuuuuuugagagggagucucgcucugucgcccaggcuggagugcaguggugcgaucucggcucauugcaagcuccgucuccuggguucacaccauuccccugccucagccuccggaguagcugggacuacaggcgcccgccaccaugcccggcuaauuuuuuguauuuuuaguaaagacggaguuucgccguguuagccaggauggucucgaucuccugaucucgugauccacacgccucggccucccaaagugcugggauuacaggugugagccaccgcgcccugccucuuuucuuuucuuuuugagacagagucucacucugucacccaggcuggagugcaauggugugaucucggcucacugcaaucuccaccucccggauucaagugauucuccugccucagccucccaaauagcugggauuacaggugcccaccaccccaccuggcuaauuuuuguauuuuuaguagagacgggguuucaccauguuuggucaggauggucucaaacuccugaccucuggcgauccacccccccuuggucucccaaagugcugagauuacaggcgugagccaccacgccuggcuucuucuucuccuucuccuuuuccuucuccuucucguucucccucucccucuccuucuucuucuucuucuuuuucuuuuuuguuauacagugucucacuauguugcccaggcuggaguacaguggugccaucauggcucacugcaaccuccaccuccugggcucaagugauccuccugucucaccauccugaguaccugggaccacaggugcaagccaccaugacuagcuaauuuuuaaauuucuuguagagacaagaucucacuguguugcccaggcugggcuugaacuccugagcucaaccaguccucccaccucggccucccaaaguacugggauuauaggcaugagccagcacgccuugccuaaaugugguuucugaauucuucuuaauucauuccucuaggaagacacuaccaaucaguauguguguuuguuuuugagacggagucuugcucucgcccaggcuggagugcaguggugcgaucuuggcucacugcaaccuccgccuccuggguucaagcacuucuccugccucagcuuccugaguagcugggauuacaggcguccacuaccacaccuggcuaauuuuguaauuuuaguacagacaguuucgcuauguuagccaggcuggucucaaacuccugaccucagaugauccaccugccucagccucccaaagugcuggcugggauuacagccgugacccaccaugccuggcccaguucagguuuucaagugaggguaaaccuaugugccaacugugccacugaagaagauguaaggaaaugcuggcuacuugaccuucuuaugucccugacagauaaggucagucaaaucccagcacuguuugcugcugauuucugaaguggcuuuaaaauucuccucuacauagcccuucauauagcccuugccaauuguucugaauuuucagcaaagugaaacagaggcccuagcaggcauauccaaagacgcauagugaguugucagagccaguaccagccugguugacuguuacaguaagaaaauugggccagguucaguggcucaugccuguaaucccaacacuuugggaggcugaggcaugaggauugcuugaggcugugaguuugagaccagccugggcgacauagugacaccccaucucuacaaaaaaaaaauuuuuuuuuuuugagacagagucucucucugucgcccaggcuggagugcaauggcgcgaucucagcucacugcaaacuccgucucccagguucaaggaauucuccugccucagccuccugaguagcugggauuacaggcgugugccaccacgccccacuaauuuuuguauuuuuaguagagaugggguuucaccacgugggucaggcuggucucgaacuccugaacucaugauccacccgccucggccucccaaagugcugggauuacaggcaugagccacugcgccuggcucaaaaaaaaaaauuuuuuuuuuugagauggagucucacucuguugcucaggcuggaaugcaaugauguaaucucagcucacugcaaccuccaccucccugguucaagcguuucuccugccucagccuccugaguagcugagauuacaggcgcacaccaccaugcccggcuaauuuuuguauuuuuaguagagacgggauuucaccauauuggccaggcuggucucaaacucugaccucgugauccgcccaccucggccucccaaagugcugggauuacaggcaugagccacugcgucuagcccaaaaaaauuuuuaaaaauuagccaggcaugguggcgcccaccuguaguccuagcuacuugggagacugaggcaggaagaaugcuugaacccaggaguuugaggcugcagugaacuacaaucacaacacugcacuccagccuggguaacaaagcaagauccugucucuaaaaaaagaaaagaaaauuguagaguggucuucacauuccgagggucuucauuucauuuccaaugccagagcagauaggcuaugugacuucagcacguuccuuaacaucuuuaagccucagauucuccaucuaucauagcaaaguuaacuuauaccauuuaauaauuaauuauuuuguuuuauuuugagauggaguuucgcucuuguugcccaggcuggagugcaauggugggaucucagcuaccgcaacccccgccucccagguucaagcgauucuccugccucagccuccugaguagcugggauuacagacaugcgccaccacgcccggcuaauuuuuuuuuuuuuuuguauuucuaguagcaaacgggguuucuccauguuggucgggcuggucucgaacucccgaccucaggugaucugccugccucggccucccaaagugcuaggauuaugggcgugagccaccaugcccggccuuauuuauuuauuuuauuacuauuauuuuuagauggggucucgcucugucacccagccuggagugcaauggcacgagcucagcucacugcagccuccacuucccggguucaagcaauucuugugccucagccucccgaguagcugggauuacaggcgugugccaccacaccuggcuaauugugguauuuuuaguagaggcgggguuucaccauauuggccaggcuagucuugaacuccugaccuccagugauccuccugccucagccucccaaacugcugggauuacaggcuugagccacugcccccagcuuuauuuauuuauuuuugagacagggucucacucggucgcccaggcaggagugcaguggugugauuaugguuuacugcauccuugaccucccgaccucaggugaucuucccaccucagccucccaaguaucuuugcuacaggcacacaacaucacauucagcuaguuuuuaaauuuuuaguagagacaggguuucgccauguugcccaggcuggucucgagcucuugagcucaagcaauccguccaccuuggccucccaaagugcuggaauuacaggcguaagucacuguacccagccaacuucuaccauuuuagagucuuugugugaauuaaauaaacagcauguccuccucaacauauauguaaaaaaaugcuaaaccaccaaaaaauucagcaaauuaaaucaagcaauguauauaaacaaaacugcaauaugcaugaccaaguuugguuuaucccaucaagauugauuuaauauuagaaaaucaauuaacggcugggcacgguggcucacgccuguaaucccagcacuuugggaggcugaggcggguggaucaccugaggucaagaguucgagaccagugugaccaacauggagaaaccccgccucuacuaaaaauacaaaauuagccgggcaugguggcgcaugccuauacuuccagcuacucaggaggcuaaggcaggagaaucgcuugaaccugagaggcggaguuuggggggagccaagaucgcgccauugcacuccagccugggcaacaagagcgaaacuccguccccccucccgcgcaaaaaaaagaaaaucaauuaacguaauucaugacauuaauguauuaaagcuaaaaaaugggcugugugcgguggcucacgccuguaauuccaacacuaugggaggccaaagcaggaggauugcuugagcccaggaguucgagaccagccugggcaauaugccaaaaccccgucucuacuaaaaauacaaagaaaaaaaaaguagccaggcuuggaggcgcauaccuguagccccaaguacuggggaggcugacgugggaggauugcuggagccuggaaggcagagguugcagugaaccaagauugcccuacugcacuucagccuggguggcagagcgagaccuugucucaaaaauuaauuaauuaaagcuaaaaaaugguuucaauugauguaaaaaaaaagucaauaaaauucaacauccuuuuuuaaaaaagucuuaggaucuaggaauaaaagaaaauguucuuaacccgauaaaggccaucuagaaaaaaacccauagcaaagaucauguuuggcugcaaaauguuuaaagcaucucccuuaacagcaggaauaaagggccgggcgugguggcucaugccuguaaucccagcacuuuggcaggcugaagcaggcagaucacgaggucagcauuucaagaccagccuggccagccuggccaacauagugaaaccccgucucuacuaaaaacacacaaaaaaauuuggcgggcguggugguggaaaccuguagucucagcuacuuggaaggcugaggcaggagaauugcuugaaccugggaggcagagguggcagugagccaagaucgugccauugcaccccagccugggugacagagggagacucugucuuuaaaaaaaaaaaaaaaaaaucaggaauaaagaagccacuaucacacuguagccccugaaaugacaagaaaaauagauaacagguauagacugaagaugaaaaaauaaaauugucauuauuugaagguguuuuauguuauacaauaaaagcaaaagaacaaaauagcucagugggaaaacuggggguggcaaggggagaugaaggcagguaaaugacuaguaagaaacuuaugcaugaagcaaaagacauaauuagcacauuugggauaggaauuaccuuuggugggaggaggcaaauaaauauguuuagggaagggcuuaugaggcuucaaagcuacuaaaagggccaggcauaguagcucacaccuguaaucccagcacuuugggaggccaaagugggaggaucaccagagcccaagaguuugagaccggccugggccacauagugagaccccaucucuacaaauaauuuuaaaauuaaccagacaugguggcaugcgccuauuguuccagcuacuugggaggcugaggugggaggauugcuugagccuggaaggucgaggaugcagucagacuucauggcaccacugcacuccagccugggugacagagcgagacccuuuuucuaaaauaaaagcuacuaaaaauggggccagacgcggugguucacgccuguaaucccagcacauugggaggcggagguggguggauuaccugaggucaggaguucgagaccagccuggccaacgugccgaaaccccaucucuacuaaaaauauaaaaauuagcugugcauaguggcaugcaccuguaaucccagcuacucuggaggcugaggcaggagaaucgcuugaacccaagaggcggagguugcagcaagccgagaucgcaccacugcacuccagucugggugacagagcaaccaacuaacaaacaacaacaacaaaaacaaagaaagcuacuguuagauuuacuuuucugagagcgaaagcauuuauuuuauuuuauuuuuaagauggaauuucacuccuguugcccaggcuggagugcaauggcgcaaucucggcucaccacaaccuccgccucccggguucaagcaauucuccugccucagccucccgaguagcugggauuacaggcaugcgccaccacgcccggcuaauuuuguauuuuuaguagagauggaguuucuccauguuggucuggcuggucucgaacucccgaccucaggugauccgcccgccucagcuucccaaagugcugagauuaggggcgugagccacugcgcccgacgugaaagcguuuccggugugaaagcguuuuuuauuuuguaaaugcacagguugauuuuaggccucuguuugcguauauaguagucauauaagggauuucuugcaguaaaaacaucaggugcuuuguuuccccccaaugcuuauuccaauauauggaaucccaucauuauucccaucauuagaauaauaaagugaccccuccccaugacgaagccccuauaagacauggcuaauucaucaccaccaagccacucauugccgcaggccccugguguggggacugggcggugagcggaugcgaccuguuaucuccagcagauacugggggccauggagucucaggugggggggggcccggccggcccggcccugcccaacgggccacuccuugguacaaauggagccacugacgacagcaagaccaaccucaucgucaacuaccugccccagaacaugacccaggaugaguucaagagucucuucggcagcauuggcgacaucgaguccugcaaguugguucgggacaagaucacagguguggcugcuggaguugcggggaggaacagaggugguagccucagaaauacagaggugaugggggcaggugggacccuugcugaggugucucggggguaaucgaggcaggagguggucuagggaugugaggucugauggggagauggguauacccccuaggugaaggucucaggagcgauggaggcaggugggacucuagcaucgaaggugucaucuggaaacaggaagguggaaacuugguggggaggggacagucucucaggccugaggugggacacuggcaggugucaaggcugggugggaaggucaucauucugguucugcccacagggcagagccuuggcuacggguuugugaacuauucugaccccaaugaugcagacaaagccaucaacacccucaacggccucaaauuacagacgaagaccaucaagguuggugccuccuucuccaaucccccaugaccgcccaccccaacugacuguccccaacccccuacugccaccuacccgcccccaugcauccauguccacugccuuucaggacucauccccagaggggcucaaaucuccccuccaagacuuccuagcuggggugggggcaauggcuuucccucucuaaaccucaguuuccucaccugucaauggggacaguacuggcuccacgaucucuggaggcucagggagucagccaggcccuguaaggcagagugaccaggguccugugagcaguccccucccugcuuuugucauggaaaugggggugggggcccaucugccaucuggagccuaauuagggucugggagggcgggauuggggcggcccaucccccaucuuugugcaacgccccucccccaggaccucccuucucagcagcugcagcugggacccuacaagcccagguucccugggggggaaucgucauggaaaccccccucucuggguucgccuggggguguuugggcuccgcccugcaaaucugcucccggacccuggaggaagccagggucggggggguggcccaucuggcccccaguucaacaugggaacagaggugcaggaaucucuucccuuuccugaugugggggguuggggauugggguggaggagugaaguugugacccaaugggucccuucauggccaacgagacccagaagccucagggcaugaggaccccagaccccagugacauugagaugcagcguguauguguguguguauguguguauguauauguguacgcauguguguguguacgcauguguguguggugugugugcauguguguauguguguggugugugugugugugguguguguguguguaugugugugguguaugugugcgguguguauguguguggugugcgguguguaugugugugguguguguguauguguguggcguguagguguauuacguguaugugugugugguauguguaugugugugguguguauguguaugugugugguguguaugugugugguguauguguauguguguguggugugugugugucuguguggggugugugggauguguguauguguguauguguguggugugugugugguguguguauguguauguaugugugugugguguguggugugugugugguguaugugugugucuggugcguguguguggugugugugguguguguauauguguggugugugugugguguguguuuguggugugugugguguguguauguguguaugugugugugguguguguguuguguaugugugugucugguuugugugugguguguguggugcaugugugugugguguguguguggugugugugguguauguguguggugugugugaugugugugugguguauguguguggugugugugugauguguguguguguggugugugugguguauguguguggggggugugugugugauguguguaugugugugucauguauguguauguguggugugugugguguguguguggugugugugguguauguguguguguauguguguguggggugugugugugucaucuugaguugugagauacaguguuuaugauccaggugucccgugacucacuguggcucuggcugugacacaaugguugugggacacagugugcgaguggcuguggccaggcacaguggcccacgccuauaaucccagcacuuugggaggccgaggcaggaggaucacuugagcccgagaguuugagaccaaccugggcaacgugacaaaacccuguuccuaaaaaaaaaaaauuuaaauuagcugggcguggcaucuugcaccuguagucccaacuacuugggaggcugaguggggaggaucacuuaagcugaggcggcgaggcuacagugagucauguuucaccacugcacuccagccucggcaacagagcaagacccugucuaaaaaaaaaaaaaauauauauauauauauagagagagagagagagagagagagagagacagagagagacagagagagagagagggagagagagggagggagagagaggcugcugucaagugcaucuguguauuuaagacuucggguauaucccuaugugucuguaggauaagguuuuuuuuuuuugguuuuuugauuuuuugggguuuuuuuugagacagagucucccucucuugcccaggcuggauugcaauggcgcgaucucggcccacugcaaccuccgccucccaggcucaagcgauucuccugccucagccucccgaguagcugggauuacaggcacccgccaccacaccuggcuaauuuuguauuuuuaguaaagacaggguuucuccauguuggucaggauggucuugaacuccugaccucgugauccacccaccucagccucccaaagugcugggauuacaagugugagccaccgcacccggcccaggaugacgugcuuauuauuugacaggugcaugugacacugugacuccggcugugaccugauggggccucagggaugcgucuggcucuggcaggauguuugugugucaccgcgauguugugugggugugucuaccugugcccugcucugagggauugagugugauaucguguguuugugcugcgcugugauggguaugugguucuacgaccuucacuguaauucucugagacucccuccugaacguugcugagaaugugacaguggccugugucacccucuggcugguuucaucucugaggcugugcagcggggcggcacugcauggccuucugucugucccuggguguuuuugccugugugacgguguugcgcggucagucaggacugggcgcuauggcagcugcccaaaauaucuccagcugccugccgcgggccaggccccaucccagggugggguguggguggaguuugguccauccuugcccuugggaaacccaugucauggagggauggaaaaggccugugaaaaccuccucugugucucagacgguguuggaccuccaauauccacccaggaucuuacccccaaaucuaaucccucaacccaaaucugauucaucagcaaguacccucacagcuccuagccccaugggagagaaaaaaagaagagaaaacugucaaauacauugacaugauuucuuucuuucuuuuuuuuuuuuuuuuuugagacggagucucacucugucacccaggcuggaaugcaguagcgcgaucucggcucacugcaaccucugccucccagguucaagcaauucuccugccucagccucccguguagcugggacuacaggcgccagccaccaugcacggcuaaucuuuguauuuuuuuuaguagagacgggguuucagcauguuggucaggcuggucucgaacucccaaccucagaucauccaccccccucaagccucccaaagugcugggauuacaggcgugagccaccgugcccagcauggacaugauuuauuucuuaauuaauuuauuuauuuuucugagauggaaucuugcucuguuacccaggccggauuacaguggugcgcucucggcucacugcaauuccgccucucagguucaagugauucuccugccucagccuccugaguagcugggauuacaggcgcccgccaccacgcccggcuaauuuuugcauuuuuaguagagacgggguuucaccauguuggccaggguggucuccuacuccugaccucaagugaucugcccaccucggccucccaaagugcugggauuacaggcgugagccaccgugccuggccuggcugugauuuuaaaaaucauuauuauggacaugacaauggcugaugugauuuuuuuuucuggagaaccccaggugcacaaaauuauauuaaucagacccugccccccauucacucucaaacugcuuuaucuauuuuguucauuuuuaaacuaguuauuucuuuuuuuuuuuuuuuuuugagacggagucucgcucuguugcccaggcuggagugcaguggcgcgaucucggcucacugcaagcuccgccuccuggguuuacgccauucuccugccucagccucccgaguagcugggauuacaggcacccgccaccacgccuggcuaauuuuuuguauuuuuaguagagaugggguuucaccauguuagcuaggauggucuugaucuccugaccuugugauccgccugccucagccucgcaaaaugcugggauuacaggcgugcgccaccgcgcccagcuuuaauuaguuauuucuaauggaggcauacacucucacaacucacugucucaacucacugucccaaacaaaagccagaagacaaugaccccuaucuaucaagagguuaauuagaagaaacagaaaauagaggcugggcacaaaggcucacaccuguagucccagcacuuugggaggccgagggugggaggauugcuggagcccgggggggucaaggcuguggugaaccaugauugcaucacuguacuccagccugggcaacacagcaagaccccaucucaaaacaaacccacaaacaaaaaccucacuuaacaagaaaaagaaagaggaaaggaaggaagggaaggagggagggaggaaagagggagggagggagaguggaaggaaagaaggaaggaaugaaggaaggaaggaagggagggagggagggagggagggaggaaaaauagauacagcagacauaagggggagaauugcugaugaccacgccccagccucuuccccagucccuggugacaggucacccacugagcauuugagagguggacuucccuaccaugcuuccaggacauugauaaacacacaaugaaacaaggucacacaauauucccugcuuuguaaauagacuuuucugucccccauuuuacaauacucaccagucaccaccguuucugggaaauaaauauauauguccaucuuuuucucuuuuuuuuuuuagagacagggucuugcucuguagcccaggcuggagugcaguggugugaucauagcucacugcagccuuuaacuccuggguucaagugauccuccagccucagucucccgaguagcugggaccacaggugugcaccaccacacccagcuaauuuuuuuuuuuuuuuuuuuuguagagguuguggcgguggaggacgggggugagucuugcuguauuguccaggcuggucucaaacuccugggcucccuugauccuccugccuugaacuuccagagcacugggauuacagccaugagccacugcaccugacccaccauuuuuuuaaacaccugcagagaguuucguuguuggguuggacuauaauuaauaaugugauucagauaacagugcuaaaaugugucuaauuccuaguuaggagaagugcuuugagaaagaguaauaggggugguggggggaggacaaauuuagaugagagaggacagggaggauguuucaacugagacccaaagaaagaagaggaggaagagcauuccaggcagagagaacaggcaaugccagggcccugaggcugagacaugccugguguguuugggaaaaaugggggaaguucaaguugcuggaacacaguaauuggggcaggaaguagggggagaugagggcaaggaugucauggggaagaaugugcaggguuuugcgguccaaggaaaggacuuuggcuuuucugcugaggaaggugggagccauagaggguucugagcagaggggggaugcgaccuggcucagguguucacaggcgcccucuggcugccguaggggggacagacagugggggaugggagcagggggggccaggguggaggcugcugcacugguccaggugaucaguagugaaggcugggccagggugggacaguggcaguggggugaaguguguggauucuggauaaggaggaagguagagccuacaggauuuagaguggguuggaugugcaugugaagaacaggugucgagaacaaccugaaccuggggacaugagcacuuaggaggacagaguugccauuagugaguuggggcagauuggaggcgggcgggagcaggaggcacccgugcuguguaugaagugcccuugacacccccauguggggcaccuggaugcaguugccaccaggggugcagacuggggacauuugggagcugaugacuaaagaccugagugucccuggggggcccaguguagcugggaagagaaggggccagugucuuagguccacucucuauaggagugggaagaguggcugggugugguggugcaugccuguagucccagcuacuugggaggcugaggugggaggauggcuugaguccaggaguuggaggcugcagugcaguaugauugcaccugugaauaauaacugcauuuagccugggcaacacagcaagacuccgucuuucaauaaaauaaaaauaggccaggcaugguggcucacaccuauaaucccaguauuuugggaggccgagaugggagaacugcuugaggccagaaguucaauaccagccuagguaacacagugagauccuguuucuacaaaaaaaaaaauuuaaagauuagcugaggccgggggagguggcucacaccuguaaucccagcacuuugggaggcggaggcgggcggaucaugagaucaggagcucgagaccagccugaccaacaugaugaaacccugucucugcuaaaauuauaaaaauuagguaaggcgcgguggcucacgccuguaaucccagcacuuugggaggccgagaugagcggaucacaaggucaagaggucaagaccauccuggccaacauggugaaacccgucucuacuaaaaauacaaaaaaauaaaaaaaaaauuagcuaggcgugguggugggcgccuguaaucccagcuagucaggaggcugaggcaggagaauugcuugaacccgguaagcagagguugcaaugagccgagaugucgccauugcacuccagccuggcgacagagcaacacuccaucucaaaaaaaaaaaaaagaaaaaaaaaaugcuggucaggcgugguggugggcgccuguagucucagcuacuugcggggcuuaggcgguaggauugcuugagcccaagaggucgaggcuguagugagcugagaucacaccauugcauuccagccuggguaaaaaagugagauccugucuuuaaaaaaaaaaaaaggucaauguuuguugauggacugucaagcaugugauagugaugugagccggcuauucaaggaucccuuuggggucacaugucaccccagggagacauguccucccuagguggcagguccccaucacucuauacaggcaguccaaguuguuacagccacugccauguccccucucccauaucugacucagccccaccccacggugacaacucuagagauacuuauugagugacggaugggucacuucugcuaacuccgugaugguuuagacauggccucacucucuccaucugugaaaugggucucugccucaccccuguccaucugacccccucacccagguguccuaugccagacccaguucagcauccauccgggaugcuaaccuguacgucagcgggcuccccaagaccaugagccagaaagagauggagcagcucuucucccaguacggccgcaucaucacgucccgcauccugguggaccaggucacaggucaggcagucagggagggugcaccuggcgggggcgcugggcaaaggcagucaggugggaccaacguggggaaaccgaccaagaugccagggcaugaagcagggaagggagaagugggguuacacaggaggggacagggucgucgugauggacaucccugcccccuggcaggugucucucggggugugggauucauccgcuuugacaagaggauugaggccgaagaggcuaucaaaggacugaaugggcagaagccgcugggcgcagcugagcccaucacagucaaguucgcgaacaacccaagucagaagacggggcaggcgcugcucacccaccucuaccagucauccgcccggcgcuacgcaggcccccuacaccaucagacccagcguuuccggugagcccccugccagccagauggccccaggccgggugcccccaagcuugcaacccucccugaaccccauuccugccgaagggagggaugccgggagggugcgcacacaugggagccaaggagccuaucugucaggugccaaggccagccacucauauacagcaggcccucaaugugugcuggccgcgacgauuggcauucuugguguuaaaagauuuuggcgucaucuggguuccagcucugguggccccuuucucuuuugggcacguggcuguagcucugugccucaguuucccaucuguaauaacaccaaauauuucaugagucuuugcugugugcuagacacccuuauuuuucugcaacccgaugagaacagagcuuguguugucccuguuuuauggacggggacccugaggcacagagagguguugggguuugccuggcccaaacagagcagagacucaaacccaggaccuggaguccaagcucauagccacuccaaggggagacaauggaagccccuugugggcccccggguggccggggcaaguuacccacccccucaagugcugcgagaauguuggcugugguaguuacugucgccuuuguuaggaguuaucuuuccccagggaucccagcgccugggcccagaggggacccgccagccaggagggggaggauggaugaggaggccagugcaggcuggacagcgguggggcaggcgagaggcggugccugagugaccacgguuccgugccaggcagugucuagccgggcgggcggggagcaggcaggcgggggcagggcucugcugcaggccuguuggguggggguggggagggcaggccgacggugucacagcaggggggcgugacuggaagccaccucugaccaccaccucugccuccacaggcuggacaauuugcucaacauggccuacggcgucaagagguaacagugaccccgccccacuguccccaccccucaccauccaugccccugaugcaccccuccccagcucacccccagggcugcaggcuuagccuuguuugccugggucuuggaguagcauggccauugagagaugugacaucaaagccagacguggugguucucgccugugcucccaguguuucgggaggcugaggggcaaggagcacuugaggccaggaguucaagaucagccugggcaacauagugagauccuucucuacaauuuuuuuuuaaggauuagccugauacgguggugcaugccuguaguucaggcuacucaggaggcugaggcgggaggaucgcuugagccuaggaguuggaggcugcagugaacuaugauggugccacugcacuccagccugggugacagagcgagaccuuaucuccaaaaauuaaaaaauguggcugggcgcggugucucaugccuguaaucccagcuacucaggaggcugaagcaggagaaucgcuugaacauggaaggaggagguugcagugagcugaaaucgugccacugcacuccagccugggcaacaagagcgaaacuccaucucaaaaaaaaaaaaauaauuaaaaaauguaaaagaagaucucagucugagucuagugggggaggagacagagaaaugaauggugaugaaagcugugaaguagaagggguaacagaggccgggcgcgguggcucacgccuguaaucccagcacuuugggaagccgaggcaggcggaucacgaggucaggaguccaagaccagccuggccaagauggugaaaccccaucucuacuaaaaauacaaaaauuuagcugggcacgguggcaggcgccuguaaucccagcuacucgggaggcugaggcagagaacugcuugaacccaggaggcggagguugcagugagcugagaucgugccacugcacuccagccugggcgacagagugagauuccgucucaaaaagaaaaaaaaaaaagaaggggugacggagacccagcagcagagaccccccagucccaucugaggcaacauccacacaaaggcagaguggaaagggaguuccuagcagugggaaaagccugugcaaagagggccagaaggagcgaguaguuuguuccucguggucaggauugaaugguucaggcccuuggguccucccuucccagcugagggguuuaauccaagggcgggauugccagugaggaaugugaguggagccaauucuguccuuucauuaauucauucaacagacaccucccaagugcuuacuagguguuguucaggggcuggaacaaacucuugcagggaagaugaaguugaugauaauaaauauaugauuugaaaaggaaagccgggugcaguggcucacaccuguaauuucagcacuuuggaacuccaaggugguaggauugcuugagcccaggaguucgagaccagccuggcuaacgcagcgagaccccaccucuacaaaaauuuuuaaaaauuagcggggcauggcugggugcgguggcucaugccuguaaucccagcacuuugggaggucgaagcgggcggaucaccugaggucgggaguucgagaccagccugaucaacauggagaaaccccaucucuauuaaaaauacaaaauuagcugggcgugguggcaggugcuacucgggaggcugaggcaggacaaucgcuugaaccuaggaggcagagguugcagugagcugagaucaucccacugcacuccagccugggcaacagagcaagaccccgucucagaaaaaaaaaaaaaaaaauuaguggggcauaguggugcaccuguagucccagcuacuugggaagccaaggcaggaggauugcuugagccugagaguucgagaccagccuaagcaacauagugagacugugucaccacaaaucauaaaaaaaauuagcugggugugagggcgccugccuacagucccagcugcucaggaggcugaggcgggagguuugcuugagcccaggaggucaaagcugcagugagccaugauugcaccacugcacuccagccugggugacagagcgagaccgugucucuaaaaaaaaaaauugcauugcaggggucacaccauuccaaggucauggcacagucaggggucauaaaggugugaagggucacaacggggucagaagcaugcggggggucagggcagagcccgcgugacccccaaaguaguccccugucgcucaucgccagguucucgccgaucgccaucgaugguaugagcggccuggcgggcgugggccugucggggggcgcggcgggcgccggcuggugcaucuucguguacaaccugucaccggaggcagacgagagcgugcuguggcagcuguucgggccuuuuggggcagucaccaacgucaaggucauccgugauuucaccaccaacaagugcaaggguuucggcuucgugaccaugaccaacuaugacgaggcggccauggccaucgccagccugaacggcuaucgccugggcgagcgcgugcugcaggucuccuucaagaccagcaaacagcacaaggcgugagcccaccccgccugcccucccacccccuccccgggcagcagagagagagagagagaaagagagagagagagagagaaggggcccaagagagacagcacaggcagccccacggacgacgcgagggccccacgucccugcggaagccacagggugagcacucuggggugggagggucugcagggaauugggggggugcccggggaucccccgccccauccuccugcccccaccccaggcugggcuguucacucucucgucuugguuugguucauggugaagguuuuuguuucuuuuuucggcuaaaaagaaugcagagaugugcccccacccccacccucgaccacccccgaugggauggcuuggggggcuccagggggugcccucccagacccccuugcccaggccuccccagcaccuagguggggccugggguaggaggaacagguuuaaaaauccccaaaaaagcgaaccgugaggaggggugugggcacccccggcccagugcccccugguggaaugcgggggagcaggcaguggggcuggaagcagaaacaaaaugaaaaaaaaaggggggugggaggggaagaaaaacucuauuuuuguaaaaagggaaaaagaccucguggagaauuuuuacuggggauucuugaacuugaaaaaaaaaaacacaaaaaaagacaaaaaaaaaaaaagaaaauauuuuggcagguuauguuuaccaacuggggcggggguggggggggcccagggagcagggcuuaggggcuagcagcccacggggccacacagagaaacaaccacgcagacagucacaccacggggacacacggacagacgcagacggacacagcgacaugccccagacacguuaagggacugguuggccaaacucagacacguggacagggauagacagaaagagacagaagcuggggcuacguccauguggacacagaccacagaugugggcacacgaauccauccaccuguccacgugcacacgugaauguagcgauagauauuuggacaucaaauuuggacaccaggucacggagaaacacaaacaccacccaggaacacgcagacauaugcccauagcaucccacaggcccaggcaggaggucccaccccagacccugccccagacgcucccucacccucucggcccccucgcccuggcccccagguucucugcagagaucucuccuggacccccagcggucuccuuggcgcccacgaacacaggcgugcacacgcagcgcacaugcauugagacacacgauaccucguuccaccuuggcgucacggugggcuggaggcagcccccccccccacaacacuugaggccaaaggacaccccuguccccggggcucagccucccccugggccgaggccuuggcccacacagcugagggagaggcccagcccugagccucccccaccaggacugggccuccccggcagcaagaccccggcacuccccgccaggcccagggugggguggaugggcccaaaggcccagccccacacuccuuucccguccacuugucaccuaccuauccccuuucgguuuguuggguuuuucgucuuuccagauugcaguggacacagcccccgaucucgagccccggcccccggcuucugucuggacauugcaucgcccuaguuuucuuucuuuaaaaaaaaaaaauuccaacagaagccacaggccggagccccugggagcccucgcaccgcuccccaccccacucagcggccccaucggaacugagaauugcaaaacccccgacuuuagcuauaguuaaguugccuucccccgguguccccacguuuggugucuggcuauggcgcccccaucugacuguccagcucucucucccccaccccucccgguguuguuauuaaacgucuguggagcuucugcugcaaggaacaaaaaagaaaaaaaucaaaaaagcgacaaaaaaacacaaacagaagaggaaaaaaaagcaacaaaaaaagaaaacacacagaagagauuuaaaaaaaaaaaaggaaaaaaaaaaaagacauaaacuggcaccaguuaacuuucuuguacuuuuuugcugaauuuagcuucuuguaguuuuaacuuauugcuauguuaacuauuuauucuccucguugcccuguaaggacauccguguauauuucuguuacuucauccgguuugcaaguuaaaggaacgacaauguucucuuuguuucuuuaaguuuugccgagacaugguuaugccuaauuuauuuauaaaaggggaaguggaaucauuaaaguaauaauaauuauuaauaacaguaaugguagccgaguggcacgcgggggcgugugcucugcgggacaguccccacggccagcgacguccaggucaccaaugggauucuuuuugcucuugucuugagaauuuuuucaguccuauuuagcuggugaaaucccuagcuuguucuugauacacgaaccuauuuauucucgugguuuuaaguccucccugcccucucuccucuccccugcagcagggcagggaccccucuccccugcugucucuuggggcucucuccccuccgcccucugcauucgggaacacgcacguccgcgugggaagcuugcagcagggcguccgagcaauaagggcuggguuugucccccacccuggggggggccaggcuccagagagggggcaccuccccacacaccccccccccaccgaggccuaggccccugccacccccaagacugggaggggacuucuuuuucuaaaacacaaaacucagcccagccaggcccccucccuggaggccagccccuccccgcagggggccaggccggggcucccaggcgagggggacuuggggcuuccacgucccuggggggcaggggccaggccaggggggagggggcucagccccuccaccccucccuucauccuguuauuuauucggaagguuucaaaucacgacagaguccauguuggaggugauaaaaaacuguaaaaaaaaaaaaaaaaaaaaagacaaaacaaaagacaaaaaaaaaaaaaaaacccaacaagaacacuucgcguugcguuuagacuauuuauuaccgggaucacaggccuggccgcgguaacagacuuuuacauggaauuguuuaauuauuuguacuuuucaugccagaaaauaaaaguucagaaucuu

SEQ ID NO: 192029 - RNA, 22497 nt, Homo sapiens
aguuuccauucuuggucuccuuuuggcgcccuggggcagcgagagaccgugagaaauuucucggcggcgccgaagaugcgcgccacuuccggucuggcuccuaacaacgggggaggcugguaaccagggugggggggauggcggagcgggcgcuagagcccgaggcggaggcggaggcugaggcgggcgcgggcggggaggcagcagccgaggagggcgcagcgggccgaaaggcgcggggccggccgcgacucacggagucggaccgggcccggcgacggcucgagucccggaagaaguacgacgugcggcgcguguaccugggcgaggcgcacgggcccuggguggaccugcggcgccgcagcggcuggagcgacgccaagcucgccgccuaccucaucucucuggagcgcggccagcggagcggccgccacgggugagggggccuggccccgagggagggagggaggagacgcccccagaccccgccgggcuuuaccccgcccccuccgcuucuagggccagcccccggcaccugcggaccccgcccaggagccgggccggcggccugggucucguacugccuggccgggacgcgccuggcucguggccccgccucccaucguuccgacugcccaauccuagggugcacccagccccucgacccgccuucugagcgcuuggccccgcccgcuagaacucuggcggcccaauccugggacuggccccaccuccaggccuuguaacuaaccaggcccugggggggcagccccgcccccucaccggucucauccucccccgcuuaguuccccaccuggccugggacucuggacacccuggggcacucagcccugcccuucuugaaguucuggugccccaucugggacuccguauggccccauucccacaacccuagauccaacacauccgggggacccuucacaaccuggacugcacuccccuaaaccuauuucugugaagcaacucagcccagggagacucggaugaagaggaaaccccuaguuagcuuggcagguggagggcagagaggccugucuuuguaaauucucagucuugagaaggagcaguguggauggaguuuuucccuuccugccuuauauguugaugugaugauugaguuaaaauaggcaaagagcuuagaagagugccuggcagguaguggguucccuaaguauuaacuuuuacgaggaugacguuuauuccguaucacaagcagugccgcaaggaaauccuuguucugcccugguuuucagguacacauguucucauguuucucuggggggagauucugagagucaagaaucaaacagauccugcuaaguuauacccaccccuuucccaggacagcaggcuggcuuauaugcucaagagcaggacuggaaaugcugggagcgcaaagauaccugccucauggagcggacauucuggugggcagaggggauggcuuguucaaaggucugggggguuuuuuuguucguuuuucuuuucuuuucuuuuuuuuugagacagagucuugcucugucgcccaggcuggagugcaguggcacgaucuccguucacugcaagcuccgccucccggguucacgccauucuccugccucagccucccaaguagcugggacugcagccgcccgccaccacgcccggcuaauuuuuuguauuuuuaguagagacaggguuuuacucuguuagccaggauggccucgaucuccugaccucgugauccacccgccucggccucccaaagugcugggauuacaggcgugagccaccgcgcccggcccucguuuuucuuuuugagacagggucucacucucucgcccagaguggaaugcaguggcaugaucacggcuuacugcagccucaaccucguggguucaagugauccucuuaccuccgccuccugaguaguugggaccacaggugcacgucacuccaccuggcuaauuuuuguauuuuuuguagagacagagguuucccuguguugcccaggcugauuucaaacuccuaggcucaagugauucuccggccucagccucucaaagugcugggauuacagguguaagccauugugcccagcccuguuuguuuguucuugagacagggucucacuuugucacccaggccagaguacaguggcauguucauagcucacagcagccucaaccucccaggcucaagggauccuccugccucagucucccaaguagcugggacuacagaggagccaccucaccuggcuaauuuuuuaauuuuucauggagaugggggucucgccauguugcccaggcuggucacgaacuccucggcucaagggauccuccguccucagccucccgaagugcugggauuaaagucaugagccaccauaccuggcaaaaggcuuguuuacugcagaccagaaacauaaguaaauuguaucguccaugagagauaggggcuacggaaaaaacaaaagugaaaugaagagugugaguuggaaguuuaaauagggaguuaagguggucacauucagaagauagcauuucaguaaagacaugaaggaaccuaggaggagccaugcagaucucuggggaagaguugaggcagagggaauagcaaaggcaaagguccugaggcaggacccugccuauugugugccaggaacacugaagaggcuuguguggcuggacugcaaugagugagggggagaagggaagacaaggacagauuggugacagggaaggucauccagagccauggagaggacuccaguuuuuccucccagugaggugggagccuuuucuuaagugcaagauuuuguacagagaaagaagugguauggucugccuuuauuuccccugaugccccccccaccuuuuuuuuuuuugagauggagucuugcucuguuacccaggcuggaguacauuggcgcagccucagcucacugcaaccucugccucccgcguucaagcgauucuccugccucagccucccgaguagcugggauuacaggcgugcacccccaugcccggcuaauuuuuguauuuuuaguagagacgggguuucgccauguuggcuaggcuggucucgaacuccugaccucaagaggucugccugccucggccucccaaagugcugggauuacaggugugagccacugcgcccggcgggguugcagauuuaaauguaaagaugaaaccauacccgggccugggccuggccuuuuauuuccuuauuuauuuguuuauuuauuuuugagaugcagucuugcuauauugcccaggcuggucuugaacuccuggacucaagagauccucccaccucagccuccagaguagcugggacuacaagucacacacagccugguuuguauuuuagaagaaacugucucuaggauguguguggcuugaagaauggaugggguacacauugugauacaagguuggccaagaguuaacaauuguuaaagcugaugaugaguccaaggagguucaugacucuugucaacaauuaaaauaaaaaaaaggaagaccaggcaugguagcucacgccuguaaucccagcacuuugggaggccaaggcagguggaucucuugaggucaggaauuugagaccagccugaccaauaggccaaaacccugucucuacuaaaaaugcaaaaauuagccgggcaugguggcgcacgccuguagucgcagcugcuugggaggcugaggcaggagaaucacuggaacccgggagguggagguugcagugagccgagaucgcgccacuguacuccagccugggcaauagagcaagacugucucaaaaaguaaaauaaaaauaggccaggcgcgauggcucacgccuauaaucccagcacuuugggaggccaaggugagcaaaucacgaaguaaggaguucgagaccagccuggccagcauauugaaaccccgucucuacuaaaaauacaaaaauuagcugggcgugguggcacacgccuauagucccagcuacgcaggaggcugaggcaggagaaucacuugaacccaggaggcagaguuugcagugagccaagaucgugccaccgcacuccagccugggcaacagagcgaggcucuaucucaaaagaaaaaaaaaaguuacuaaagggauacuuuuagacagaaaacacaggccugaguguggcgguugcucuccuugguaagggaggugagggagaagcagcagcccggugccaguggagcacugggcaguggcagcacccaggaggccaaaggaagugucugccauguccagugcuguugggccgagugaagccgucacuggugacugugaugggagagugugugacgugauggagcaaagcucugacuggaggaguuccagugagauggaggagaggacauggagacagcgaguguagacaacugugacaaaacggggaaaugaagaaggaggcugggugcuaguggcucacaccuguaaucccagcacuuugggaggcugaagcagaaggaucucuugagcccaggaguuugagaccagcuugggcaacauggcgaaacucgaucucuacaaaaaguacaaaaguuagccgggugugguggugcaugccuguggucccagcuacucaggaggcugaggcaagaggaucgguugagcccuggaggucgaagcuucagugagcugugauggcgccacugcacuccagcuggggcaacaccacgagagccugucucaaaaagaaaaaaaaaaaaaaagauauggggaaggggcugguggggaagguggguaucaaaaugauuuuaacccaagaugggagaaaucauggcauauuuagaugcuggugggaaugacugaagacugaaaggaaauggcgggaaacagccaagccagggccugaguagccccggagcugugguccuugaugccaguggccucugcugggagucacagagaaguggcagaaguuggagaaguggacaggagagggaaggcaguuugagggagaaagcccuguguggggguuggaaaguggcgcucaccagguuacauaugaccuuguuugguccccauggugacccugugucagaagcacuacuacuauuuccacuucacagacggagacugaggcucagaggggacaagaccugcuugaggucacacaggcaguugagagcagagcugagucuugaacuugggucuggcugauacccaagacuguccccacugcaaugugacacucccagccuccagcggugaguggauggagguggcuguggacaucaggacuuggguuuggggcagggcaugguggcuuacacuuguaaucccagcacuuugggaggcugaggcaggcagaucacuugaggucaggaguucgagaccagucuggccaacauagcgaaauccugucucuacuaaaaauagaaaaauuagcugggcugauggcaggcaucuauaaucccagcuacucaggaggcugaggcagaagaaucgcuugaacccaggaggcagagguugcagugaacugagauagugcuacuccacuccaaccugggugacagagccagacuugggucuuggguugggugaaggucucuacagccaguguggugcuuugcaggggaggguggagccaugggaagggauagagucacauggaaugggaccuggaguagcagagccagaggcaggggcagagccuggggcaggaaagauggaagauccccaaggugcaguccugggaaccagacgggugugggacugagaauuguuacagggcugggcaggagucagacgggguggacaguuuugcugauaagagacacuagacuggcugucaggauguuuguggcaagagcaggucugggccacagcagggaggccagggggcccaggcuccacgaugauacugauaaucauaacgaucauuguaccauuugcuuauugaugauuaagugacagggcuguaccaugacgaagaucguuuuuuguuuguuuuuguuuguuucuuuguuuuugagacacgguuuuacucuguugcccagguuggagugcaguggugugaucauagcucacugcagccuugaccuccccaggcucaggugauccucccaccuuaaccuccugaguagcugggacuacaggugcaugccaccccgccuggguaauuucuguauuuuuuguggagaugggguuucacuguguuucccaggcuggucuccaacuucuggccucaagcgaugcacccgucuuaaccuccuaacgugcugagauuacaggaaugagccacggagccuggccuuuuuuuuuuuuuuuuuuaauuguauaaauagaggugggaucuugcuauguugcccaggcuggucuugaaccccuggcuucaagcaguccuccugccucagccucccaaagugcuagaauuacaggugugagacaccacacccagacaguacccacugucuugcuggcugugggccaagaccacucucagccucucaaguagcugggacuacaggcuugagccacugugcccuacaagauauguucccguuugauuaacucacagucaccuaaccaaggcuugacauccaguccuacucacaggccugccccgcucaggggaagaggaucacacagggcaugugucccagcagaacugugggggccaucuuggaauucugcuuccacacaaacuuuucauacccacuuuguuacuucucugcucccugacugugggacccagggcagauggccucaccccuccaagccuguuuuuccugcuccuugagguggaugaugcuagagcccccucccagggcugauggcaauuggggagagaguccaagggaggggccuggugacacaguucuggaguuggggaaagguacauagaaguucagauucuaggcugggcacgguggcucacgccuguaaucccaacacuuugggaggccgaggugggcggaucaccugaggucagaagcuugagaccaggauggccaacauggugaaaccccgucucuacuaaaaauacaaaauuagucuguaaucccagcuauucaggagucugaggcaggagaaucacuugaaccugggaggcggagguugcagugaaccgagaucgcaccacugcacuccagccuaggcaacagagacagacauugucucaaaaagaaaaaaaaguucagggcaggcguggcggcucaugccuguaauaccagcacuuugggaggcugaggugggcggaucaccugaggucaggaguucgagaccagccuggccaacauggugaaacuccgucucuacuaaacauacaaaaauuagccaggugugguggcgugcaccuguaaucccagcuacuugagaggcugaggcaggagaaucgcuggaaccugggaggcaaaggcugcaaugagucaagaucucaccacugcacucuagccugggcaacacagugagacuccaucucaaaaaguucagauuuaguuucaguguacaaugagcaguggcucuagccacuguuguuacucaugggucagacaggcccagcgcuggucccccguucacccucucugccucuuucuguugcaggaagccuugggagcagguccccaaaaagccaaagcggaagaaaaguaaguggaggcucagccugggggagguggggagaguugggagcggugggaauauggagauggaggcccagagaggccaggucgcugcccuaggcagcacaguuggaaccagcagagcccgaccucaaacccgggucugcgugucuugugucucaggcgcaguguccuuggcucccucauucucuugcucccggcaugggagucagccaggggagagccgagcagagggaacagcuuuugcagagcccuaagggcagggggagccaagcacuggugguuagaggggaggucuggagcuugcuccuccuguccugcuggccaccaguuggugagagcuugaacugucagggucugcacagcucugagcccuggagcugggggucccaggccauguccagcagggugaaggccagcugguggcagugagccccucccuucuuagguuucuccagaggcaggggugagcuaugaccuugauccugaauccucaagggaugaggagcgcauugaggagggaaagggcugggccggagaggcggcugugggugacgacucuguugcccucaugauuggagacugugagcacauucccuagacccaaacaccucuucugggccccucuucaucucccggcccacaggguaggagugggggacaugcuguccucgcacuuggcugagggaccaggaccaucacaagagucagauaccauuucccagcacucacugugugcccagccuuguucuguguccuggcgaugucuucacucccuuccuccugccuggcagcccuccgggaugggaaucccuuauucuccccagccuagaggaggcaccuggggcucagagaagccaagucacuugccuggagcuacccagcuuggaaggggcagagccaggauucaaacccaggcgguccggcuccaccaugcccgcccgcuaugcagcguucucucauccagcaaauguuccuggagcaccugcuaugaaccaggcccuuugggggcacuggggguacaggaggagcaaaacagcaguguuccugcucuugaggagcugacauucuggugggagagacagacagggcacauguaaacaaauggccacagauggcaucuagguacuaccuggagaaaacagacagcaaaguuaaggucggcuagagugacugggcagggaguggccucuuggaggggaugcauuugggggagaccugagugaaguggggagggagcaagacaguuaucuagaggaagcaggcacagccugugccaaggcccugaggcagggccacaccuagcccgcuccaggaacagcgaggaggccauguggcuggaguggagugcagucaccaagugggugagggcggggaggugacaagucacagugggccuugugggccgaagggaggacuuuggcuuuuacccugagggaguuggucuugcugugucauccaggcuggagugcaguguugcgaccuuggcucacugcauccuccaccucccaggcucaagcgauccuccuaccucagccucccaaguagcugggacaaaaggcauacaccaccaugccggccaauuuuuguauuuuuaguaaagauggguuuucgccauguuagccaggcugguuucaaacuccuggccuuaagugauccgccugccucugccucccaaagugcuaggauugcaggugugagucauugcgccuggcccaguggauucugagcagaggagggaacagacuugacucgggcauucacaggcgcccccuugcggcuguagggggugguuagggcgggagccugggaguccugggccugaggacugcgcuggucuaggcguuugaugaagaugagaacaauuaacaagcagcuaacaauuauuaugcaccuacugugcaccaggcuccacuguuuacaugacuuugccaauagaacaguccccguuaccuccagggggugccucuccucucugagccucaguuucccccuuuaaacuggguacaggccuggaugguacucaggagggccuccaaacccaugggacccauaaagccccggugguucaggcagccaugucaccaugggcugagcccugucccuuauacccacuccucggcccuguguccauagggcggcgacgcaacgugaacugccugaagaacguggugaucugguacgaggaccacaagcaccgcugcccguacgagccgcaccuggcggagcuagaccccacuuuuggccuguacaccacggccguguggcagugcgaagcuggccaccgcuacuuccaggaccugcauucgccccugaagccccucagcgacucagacccugacagugacaaagguaggucugcagggcgagggcacauagggggccgcccauuucugggggcuucuuacgagcccuaggcuagcaucacaaacagaauagcagccacaguggcucuggcucuggcucuggcacuggggcagagcagggacacgaugggccaggcugaguccuucguggccuugcccucuuugcguccuuacagagcuugaguggggaggcagucccucuuuauggagcaguuugccaaucugugcccaaggccagucccaggcagggcuggcugagggcccaggagcccuggcuuggcagcuggggcgggggcaggccugcuggggcagggcucggcccccacagcgaaacggccgccuaaaccacccaggccuuauggcuucauaggcugugaugcucuccugagcccuggcuaagcuggccgcuaccuccuuuucgauuuucucuggcucccaguugcauucucuugccuucugccuuuccaggcuucguuucuugccuucccccuccauucuguuucccuccuguuccccauuucuccucccuugagcugccucugucuccuccuuccuugaucuuucauuuucugucucaucucccucucucucuuucucuuguuuccuucuauuccccuuucuccuccucccuccccaccuucgcggucccugccucucuccuucccaucccacggggcagggacucagugagggaggcucaguuggccccggugaguggugagggggcugccggcagccucagggguucggcaauggcuggagaaggagcguagggcacacugccaggcguccugucagggcugaggguggggcggucaccagggcugagccugcgcuggcuggcaucucggagcagguggcaucccagcuggccgaggggaagccgggggcgagagguguuccgggugggcgcccccgccaacgaccgucccaccaagugucggccaggcucucagcgugcaguggccucucggcugccccaucccaugaucugcauuccgcccuccucugccuuuuacugcccccucacugugugccacuccuggcccugcccagagccaccaugaaucuuccccauggccuugucaucagccccacuuggcagucaaggaaucccaagccccaggagugaucugacuggcccauuuggugaugggucaggcugggguguggguggugcccagagcagcuuacuuacgccccaacucaacuuuuuauuauuuauuuauguauguauuuauuuaucugagacagggucucgcucuugucgcccaggcuggagugcaauggcgcgaucucggcucacugcaagccaagccucagguuccagccauucuccuuccucagccucccuaguagcugggauuacaggcaucugccaccacaccuggcuaauuuuuguauuuuuaguagacacuggguuucaccauguuggccggcuggucuugaacuccugaccucaguugauccacccaccucggccuuccaaaguucugggauuacaggcgugagccacugcacccggccuuauguuauguuauguuauguuauguuuuauguuauguuauguuauguuauguuauguuauguuauguuauguuauguuaucuuuuugagacagauucugucucugucacccaagcuggagugcaguggugcgaucuuggcucacugcaaccucugccucccagguugaagcaauucucucaccucagccucccuaguagcugggauuacaggcgugagccaccaugcccagcuaauuuuuguauuuuuaguagacguggguuuucaccacuuuggccaggcuggucucgaacucccagccucaagugauccuccugccucggccucccuaagugcugggauuacuggugugagccaccauaccuggcuuuuuauuuuuauuuauuuuuuuuaagacagggucucacgguugcccaggcuggagugcaguggugccaucauagcucacuucagccuccaauuccugggcucaagugauccucccacccuggccuccugaguagcugggaacacaggcacacaccaccacagccagcugauuuuuaaauuuuuuguagagaugggaucucacuguguugcccaggcuggucucaaacuccugggaucuaguaauccuccugccuuggccucccaaagugcugggauuacaggcauaugccaccgggccuugcccauggcuauuucuguuggugcugucauuaccugaggagaagucuggggucagccaaacuuagcaggugcugcagucagguggacccagacgcgugcucuggcccuucccuccacucauuaggacacugcgcccuccuucuggauggugccagagaguuugcccacccugcagaauacaggacaaggggaaauuauccagaaagaggggcugauccuccuuauccccaacccugcugccaccccagguccaucaacagugggcaucucacugcccugaauggcacugagauaauaauaggaaacuuacaggguacauacuuuuaaucuccuacuguccuaaacccuuauacauauuuacucauuaaagacccaaaacaaaggcugggcacgguggcucacaccuguaaucccagcacuuugggaggccgaggcagguggaucacuugagaccaggagcucaagaccagccuggccaacauggugaaaccccaucucuacuaaaaauacaaaaaugagcugggcaugguggcgcaugccuguaauccuagcuacuugggaggcugaggcaggagaaucacugaaacccaggaggcggagguugcagugagccaagaucgcaccacugcauuccagccugggcaacagagcaagacucugucuagaaaaaaaaaaaaacacucccgagggccggguacaguggcucacaccuguaaugccagcccagcacuuugggaggccaaggcagguggaucacuugaggcuagaaguucgagaccagccugggcaacauggcaaaacccggucucuacuaaaaauacaaaaaauuagccaggugugguggugugugccuguacuuccagcuacuuggcaggcagaagcaucagaaucacuugaacccgggaggcagaggcugcagugagccaagacuagggagcagagauugauucauuuauuggaacgagcccucacugugcaccacacagccuucucggcacugggggcucugcaccgggaccccgcaaccuuacggaguuuacauucuagaggggaagcggauuguaagcaggauaaaccaauaaaaauauagagugcaggcugggcacaguggcucaagccuguaaucccagugcuuugggaagccaaguuaggauugcuugaggccacggcuuagagaacagccugggcaacauagugagaccccaucucuagcaaaaaaaugaaaaaguuagcugggcaugguggugcaccucucccagugcuuuaggaggccgaagcaggaggaucgcuugaaccuaggagcucgaggcugcagugagcuaugacugugccagugcauuccagccuaggugacagagggagacacugucucaaaaaaauaaauuaauuaaaauacaggcugggcgugguggcucacgccuguaaucccagcacuuugggaggcuaaggugaguggaucacuugaggucaggaguucgcagccuguccaauauggugaaacauugucuccacuaaaaauauaaaaauuggcggggcaugguggggugugccuguaaucccagcuacucaggagacugaggcaggagaaucacuugaacuuggaagguggagguugcagugagccgagacugcaccauugcacuccagccuggguaacgagcaaaacuccaucucaaaaauaaaauaaaauauagagugcacuguaaggugguaugugcuuugggaaaaaauaaaggagggaaaaaggaacuauuugagacagaauggucaggaaauucccccugaaaaaauaccuuuaaugaaggaucugauggaggggagggaggagcccucucaggugucagacagaagaggauucaagccggccgggugcgguggcucacgucuguaaucccagcacuuugggaggccgaggugggcggaucaugaggucaggagaucgagaccauccuggcuaacacggugaaacccugucucuacuaaaaauuagcugggcgugguggcggcaccuguagucccagcuacuugggaggcugaggcaggagaauggugugaaccugggaggcagagcuugcagugagccaagaucgugccacugcacuccagccugggcgacagagcgagacuccaucucaaaaaaaaaaagaggauucaagccgagggaauggcaggugcaaaggccuugaggcaggaaccuaucuagugucuccaaggacauuaggagaggaggcgaggacaggaggugauggaacaccuccugaaacagacgcacuccagcucucgugaccuggcacagugguuuguuucccacauacaaagccuggugcuuccauccugcagacugccuuucaucccuggacccagguucuuuccuuccuauggcuccagccuccuuguggguccuggcuuacugguggggagaaaaguggagacucaaccuugggagcaccuguccacuugcauuccauuggcugggacucagccacauggccacaccuaccugcaagagaugcugggaaauguagucggugcuggugccaggaagagagggauuuagugaguagcuggccugcuucuuucacaggagguaaagaguagguucuuaggagccggggacccaaaagaagggacugcacuggcccuggcagggggccgguggggccgcaacuagcaucugcaggggaagugggagaagcguucaggcugcggguggauguauuuuggaugcagcaccaacagguuuugcugacagauuggaagugggugugagagagagagaagucaacaagagccccaggacuuuggccugagccacuggagagacugagcugccuuccgcugagucagggacacccgugagcagugcaggcuuuguagaagggaagauacagagcccaguguugcagaucugaguuugagaugccugugagacacucuuagggggccaaugagauggaagaaucuggagcucgacauggagguguaggcagaagcugcagauggaaucaccaggccauggaugguuguaguaauaagaauacauacuuggccagucgcgguggcucacaccuguaaucccagcacuuugggaggccaaggcgggcagaucaccugaggucaggaguuccagaccagccugaccaacaugaugaaaacccaucucuacuaaaaauacaaaaaaaaaaauuagccugacaugguggcgugugccuguagucccagcuacucaggaggcugaggcaggagaauuuuuuaaaccugggaggcggagguugcagugagccgagauugugccacuucacuacagcuuacacaacagagcaaggcucugucucaaaaaaacaaacaacaacaacaacagaacaacaaaaacccucuugaacagucccagauuggugaacaguuccagauugagaugcugggacggugguacccccggagagggcauggaagcccauaccauacccccguaucuugcccugugcaucucuucccuuuggcugucgcugaguugaauccuuuguaauaaagcuguaauuguagguagagccauuuucugaguucugugaguuguucuaacaaauuaucaaaccugaggauggggucauggaaaccccccauuuagagcccauuggucagacauacaggguagcccaggacuugcagcugacaucugaaguccggcggucuugugggacugagccuuuaacuuggaggauuugacgcccacuccgggaagauaaugucagauuggauugaauuauuggacauucaguuggcaucgagaaucggaggguggccuuuaaccccauuagccugggcaagccuggggguaaggugagcgcugaggagaggccccaggccaagccuuccaggccugcaagaaccaaauaaacuuggaaggagccaccaggaagggcccaggauaccacagcgugggucugggggcuaagagaggagaguguccccuggaguagggguggucagcugggucagucaucuuggaacaguuagggacaguggggauugagaagugacugcuguuuuaagcagugagagggucacagugucuagccccugaagagcccucaacaaauaccaacugcuggccgggcaugguggcucccgccuguaaucccagcacuuugggaggcugaggugggaggaucacuggagcccaggaguucaaggccacagccuggguagcauaacaagaccugaucucuacuugggaaaaucagggccacacgaggugccucaugucuguaauuccagcacuuugggaggcccgggcgggcagaucaccugaggucagaaguucgagaucagccuggccaaaauggggaaucccgucucuacuaaaaauacaaaaauuagccaggugugguugcaugcaccuguaaucccauuuacucaggaggcugaggcacaagaguugcuugaaccugggagguagagguugcagugagcccggaucgcaccacugcacuccagccugggugacagagggagacuccaucucaaaacaaaaacaaaaucgggccagaugugguggcucaugacuauaauucuagcacuuuggggagccgagguggauggaucacccaaggucaggaguuugaggcuagccuggccaacauggcaaaaccucaucucuacuaaaaacacacaaauuagccaggugugguggugcacgccuguaaucccagcuacucaggaggcugaggcaggagaaucgcuugaacccaggaggcagagguuacagugagccaagauugcaccauugcacuccagccugggugacagaacgaaacucugucucaaaaaaaaaaaagaaaaacucaggccggaugcgguggcucaugccuguaaucccagcacuuucggaggccgaggugggcggaucauaaggucaggagaucgagaccauccuggcuaacacagugaaacuccaucucuacuaaaaauacaaaaauuagcugggcgugguggcgguugccuguagucccagcuacucgggaggcugaggcaggagaauggugugaaccugggaagcggagcuugcagugagccaauauugcgccacugcacuccagccugugugacagagcgagacuccaucucaaaaaaaaaaagaaaagaaaagaaaaauucagccaggcacgguggcucaugacugucauucuaacacuuugggaggcugaggcgggcagaugacuugaggucaggaguuugagaccagccuggccaacaugaugaaaccccgucucuacuaaaaauacaaaaauuagccgggugugggccaggcgcgguggcucacaccuguaaucccagcacuuugggaggcagagguggguggaucacgaggucaggagaucgagaccauccuggugaaccccuaucucuauuaaaaauacaaaacauuagccgggcauggcggcacaugccuguagucccagcuacucgggaggcugaggugggagaauggcaugaaccugggaggcagagcuuguagugagcagagaucgcgccacugcacuccagccugggugacagagugagacuccaucucaggaaaaaaaaaaaaagccaggugugguggcgcacaccuguagucccagcuacucgggagccugaggcaggagaaucacuggaaccggggaugccaagguugcagugagcugagaucgcaccacugcacuccagccugggugacagagugagacucugucucaaaaaaauaaauaaauaaauaaauaaaauaaaauaaaaacuaaauaaacaaauaccaguggcugcagcuaucauaaccacucccuuucuucuguccccacagugggcaaugggcugguggcuggcagcucugacucauccagcucuggcucugccucugacucugaggagucuccugagggccagccggucaaggcugcggcagcggcagcggcagcgacgcccaccagcccggugggcagcagcgggcucaucacucaggagggcgugcacauucccuuugacguccaccacguggaaagccuggccgagcaggguaccccgcugugcuccaacccagcaggcaaugggccugaagcccuggagacaguggugugcgugccggugccugugcaagugggugcgggccccagcgcccucuuugagaacgugccccaggaggcccugggugaggugguggccagcugccccaugccaggcauggugcccggcucacaggugaucaucauugcgggcccugguuacgacgcucucacggccgagggcauucaccucaacauggcagcaggcagcgguguccccggcaguggacugggcgaggaggugcccugugccaugauggaggguguggcagccuacacccagacagagcccgaggguagccagccuagcaccauggacgccaccgcaguagcaggcaucgagaccaagaaaggucugggggaccugucguggccucuggccaggggugguugggccugggaggggccgggcgaggaauggcccucgaagugggcaccucggcagccuucguccccugcggacaccacccuguguccacccuguagagaaggaggaccugugcuugcuaaagaaggaggagaaggaggagccaguagccccggagcuggcaacaacggugccugagagcgcagagccugaggcagaggcggacggggaggagcuggacggcagcgacaugucagccaucaucuaugaaauccccaaggagccugagaagugggugccggggcgggcaagggugagggcgagggcuagaagcggcccgcaggcccccagccugccuggugcgggagccccgaugucauggccccuuccccuccaggaggcggcggagcaagcggucgcgggugauggaugcugacggccugcucgagauguuccacugcccauacgagggcugcagccaagucuacguggcccucagcagcuuccaggugaggccgccacccggagcagccugggccaggcccacaaggcccaggccauggcaccaccaggauguccuaccucuaguuugccccuugaaauuugacgaggugucccugaaggcaaagacagggacuugucacaccccaggaccuggcaugggaggaugcaacaacaggccuuugugccaugccaugcauugauugagcauguauuaagcacuuagugcaagccaggccugcaagcuggagccaggguuguucuaguaaguuaaagagugaaggaacaaaggaaugaaucaauuggggcugccuguuccaggcccacagaggcugauagcccucaaauccagucccaguccugccacuggccaccugugagaccuuggccaaaccacagagccuugaaccucaguuuccccaucgauuaauugggcuaacagcugggcccuucacagaguugacagauaccccaguccagagccuggcauauaguagguguucaauaaagcugcccuuggccaggugcgguggcucacaccuguaaucccagcacuuugggaggccgaggugggcggaucacgaggucaggagaucgagaccauccugguuaacacggugaaacccugucuguacuaaaaaauacagaaaaaaauaauagcagccgggcgugguggcgggcgccuguacucccagcuacucaggaggcuguggcaggagaauggugugaacccggggggguggagcuugcagugagcugagagaacaccacugcacuccagccugggcgacagagcaagacuccaucucaaaaaauaaaaaaaauaaagcuacccuuugaccccaguugugccccugggaaucucugagcugggcaaggguaccccucuucccuccuccuggggaggccagccccagccugccuuccagcugcccucaucucuccccaccucccagagccccuucugugggccuaugggacccacuucugccugucucgucuccagaaccacgucaaucuugugcaucggaaaggaaagaccaaagugugcccucauccuggcuguggcaagaaguucuauuuauccaaccaccugcggcggcacaugaucauccauucaggucaggcccugggccagcuggcagcaugagcgggggacacagggacaugggccugggagccugggccagagcuggcgggucaaagcccagugcugggucuccgggcacaggacuacaccccuaggagccuccucccuguccucaguaagcuguagcuaugugagccacagcgacaggaacuauuaccaaucaaucacaggaauuggguggggcuggccaucuucccuccuauccccgcgaccccaugccccaugaucccaagagcaggucucaugcgagacuuagggagcagcugacaccgccacugcucuuccagauuggaaccuauagcagcaccuggggccacaggcuagaccagugcccacccaagcagcagcaggaaggagagcugggcaaagaggagcagcuggcuugggacugggcuucuguuuccacuuguggcagagaugcaggucuucugcaugggcuggggacauaguggagagccauggugccuguguccagcgauagggcaugcccugagggccagagcuucugauaucacaggaggucagaaguuuggggguuuuuuuuguuuuuuuugguuuuuuuuaaugugugugugguuauuuuuugcaacagagucucacucuguugcccgggcuggaauccgaucuuggcucacugcagccucugccucccggguucaagcaauucuucugccccagccucccaaguaucugggauuacaggcgcucaccaccaugccagcuaauuuuuuuuuuuuaguagggacaggguuucgccauguuagccaggcuugucuccaacuccugaucucaggcgaucugcccaccuuggccucccuaagugcugggauuauaggugugagccaccgugcugggcagaaguuuuuuuuguuuuuguuuuuguuuucauuuugcgaaaucacccaaaguucaaauaucagggacaaggccgggcguggugguaaucccagcccuuugggaggcugaggugggcagaucaccugaggucaggaguucgagaccagccugaccaacauagagaaaccccgucucuacuaaaaauacaaaauuagcugggcaugguugguggcacaugccuguaaucccagcuacucaggaggcugaggcagaagaaucgcuugaacccgcgagaccaagguugugguugcgguaagccgagaucgggccauugcacuccagccugggcaacaagagcgaaacuccgucgcaaaauauauauauacacacacacaagacaaauucagacccauguuggcuugguagugugcacccuaugccucucagggacccaaguucgaucucaguucugcuugauggcgucugugggcaaaugcacgggaaggacguaggguuuggucggccugcaccugcaguccugggagauccaaggagacagccugaugcuccuucuagcaucagagucugcagcacaucagagacaccccauagcccaccguccucagccucgguccccaccgcccccagguguccgugaauucaccugcgagaccugcggcaaguccuucaagaggaagaaccaccuggagguacaucggcgcacccacaccggcgagaccccccugcagugagugacaggccgccccgugccgcuagaggauugggugggaggggaucccagcaggucccaggggcggcuucgccccaacgcagugucugggcccgguuccaccugcgcucggccuuguagggccccgccccgccccgcccacucugaccccgccccgucccgccacgggcucccggcaggugcgagaucuguggcuaccagugccggcagcgcgcgucgcucaacuggcacaugaagaagcacacugcggaggugcaguacaacuucacgugcgaucgcugcgggaagcgcuucgagaagcuggacagcgucaaguuccacacgcucaaaagccacccggaucacaagcccaccugacccaccugaccacugaccgccccuauuuauucguccgcucggacaccacgcccgggcuugccggggccuggacagcugcgagggccgcccggaccgcgggccggaaggaggcgcccccgccccgccccagagcugggcccccugggcagguuccccaccccgccccaccgcauccuucucggagcuggugccuggggcugcauugcuggaacugugucaagagagcagagugagauuaaagagcgagaaaggaga

SEQ ID NO: 192030 - RNA, 11560 nt, Homo sapiens
ggcaggccccuacagccaauggaacggcccuggaagagacccgggucgccuccggagcuucaaaaacaugugaggagggaagagugugcagacggaacuucagccgcugccucuguucucagcgucagugccgccacugcccccgccagagcccaccggccagcauguccucugcucacuucaaccgaggcccugccuacgggcugucagccgagguuaagaacaagguagggcuggagggccucccuggccuggcccacacguccugccaggccagagcccugagcuuggggucccuugaacccccuccugccuauccuaugugacuuggaaacugagaggggaaaagggagugauaugggauaggggcugccugucucccccugaacaucccggagcccccagcuaugguuggggcuggaaugggggggcacacagccacacauaaacagagggggucaguccauugcaaagauacccaccugaucagucuucuguuaacccuucguguucuuggggggaacaacauagggggaagacuuguugauuuuuccauaucccccggccugacaaagaaauuggggagcgcuugagugcugggguaccugggaagugacgccgugaaagugugggagauccugaagacagagggggacggugaaaggcaggaagcgggcaucagaagugcggcaggggucuccugacuguggagcuaggaagauaccuggacaccaccuucaugcuaugguuggguaaacugagguucggagaggagaggcaaauagcuggggucccagguaaagcagguacagcgcucggacccuggacucaccccccauacaccaggaugggcucagcuucucccagcuggagaacuuuaaguuuccagcccacuggaaucgccccaacaguauugccgagggaggaguuccugccccauuugacagaggggaacacugaggcucaggguggcuuuucccagggucccauggugaggaagugggggacuggguuggaaccugggucgagggaucucggggcuggaggagggggcugguggggggcggguccucgggcgagagacagaucccagcgccgcccuccucccccccagcgccggccccagagccgcgcagagccgcgcagagacgccgcgccuuauaaggcggccucggggagcccgggccacgcuauauaagggccgguuugcuuuauaaagccgggcugguggcguggggggcggcagggccagggccaggugagggggccgccccucccaccuccccccacucacccgggagaagaagaggcagcccgguccccuaggggcugggagccuggcugggcuugggcggaggguucuggagaaaugggaguggagugggggaggggggggacaguggagagagggaaaagcagggagguggggggagaggcagacagagauacugggagccugagacacccuagggacagacgggggagggcgagccaggagcgagauaagaccuagacaaggauggaggggcagggagaggagacagagccccaccacccccaccccaggcaggaaaccuggagacagagaaagaccuagagaggcagauauacaagacccaggagcccuaccccuggccagacagggacuagccaccuagagagauggggacccaagacugggccaagaaaagacagcgcuggggaagagagagacagaggagucggggggauaagagggagagagacauacagacgugcaaggggugggggcuaagacagagacaagcccccaccacuaaccagagacagagcccuggagcugaagaccugggggacacggagagacagagauguaugaccagcacuccucugcaagccagcacccagggacaccuccuuagacauccuucuucccuuccugaggugcccucucuuccaacagggggcacagagggggcagggcuagaggaagagaagccccaaguuuggccugggcgaaaaaccagggugccgggugccaccccucuagcucagaggauccagcuccccacaccccaccccucaucuacauucccuggugccaaaccucagaaugcccggaauggcccccugggcaggugccaccucagcccuggcucucagcccgccccagcccccaucccccaacuauggaucuggggcaaaauugccuuaguugggaaggacgagggagaucaggcucuaggaaguucagacaggacccagggagcccaggcugcccccaaugcauccucaccccuuucucugugcccccugcccuccccucgccccagcuggcccagaaguaugaccaccagcgggagcaggagcugagagaguggaucgagggggugacaggccgucgcaucggcaacaacuucauggacggccucaaagauggcaucauucuuugcgagugagugaggcucucgaagccgagacccugcaacaucccccaacuccaugcagccccucaacccccaaaacaaccaugauccuggaacugaguugaacacuuucuauuggauaccuuugggguggccaguaaucauugugcccauuuaacaggcacagaaaacugaggcucaggugaaaugcauugcaccaagucccacgugguuucaagggaaaugacucuagaaucuuaaccaccaugcuauauaggguaggcccaucuguggccgccagaguccccagaaagagcggucacagcuaaaaggcagcagccaacagcuguucauggcuggcuuggugaugugaggagagaugugcagcaauaauuaaaggaggcccugguuuucuuucuguuuucuuuuuguuuuuuugagauacagucuuguucuguugcccaggcugcagugcagagacacaaucucggcucacugcaaccuccgccuccaggguuuaagugauucuccugccucagccuccccaauagcugggauuacaggcacgcaccaccaugccuggcuaauuuuuguauuuuuuuaaaguagagaugggguuucaccauguuggccaggaugguuacgaacuccugaccucaauugauccaccuaccucagccucccaaagugcugggauuacaggcacgugccaccaugcccgguuaauuuuuguuuuuuuuuuuuuuuuuucaguagagauggaguuucaccauguugacuaggcuggucuugaacuccugacuucaagugauccaccugccuuggccucccaaagugcugggauugcaggcacaugccaccacgccuggcuaauuuuuguauuuuuuuuuuuuuuuuuuaguagagacaguguuucaccauguugaccgggcuggucucaaacuccugaccucaagugauccaccugccucggccucccaaauugcugggauuacaggcaugagccaccucgcccgaccuucuucuucuucuucuuuuuuuugagauggagucuuccucugucacccgggcuggagugcagugacaugaucucagcucacugcaaccucugcuuuccggguucaagugauucuugugucucagccuccugagcagcugggauuacaggugcccaccaccuugcccggauaacuuuuguauuuuuaguagagacgggauuuugccauguuggccuggcuggucucgaacuccugaccucaagugauccacccgccuuagucucacaaagugcuggcauuacaggcaugaaccacugcacccugccggcccugguuuucuccucgccucaaaaccucauugcugagggaggugaaaacccuaacagcucccaagccccaguuccacugcaaucuuuuuuuuuuuuuucagauggaaucuugcuuugugacccaggcuggagugcaguggcaugaucuuggcucacugcaagcucugccucccagguucaagcaauucuccugccucagccuccugaguagcugggauuacaggugcccgccaccacgcccagcuaauuuuuguauuuuuaguagagacgggguuucaccauguuggucaggcuggucucgaaccccugaccuugugauccacccaccucggccucccaaagugcugggauuauaggcgugagccaccgcgcccggcuccacugcaaucuuaaugcauagcagggcccuaaacccagccugcgcccgaucugcauuugagucugacccagggcagagugacugugaguggccucgggaagacuuugaaggugcagcuucaucaaguccuagaugcugggaagaaggggugugggggguguuuaccuuguuccauucccauccacuaggaacaaggaauuggcagguggggagguaggcaugcuggugucccagcucaggcagaggacugcucagacgucaaacagugcagucccagccugggcaacauagccagauuccaucucuacaaaacauuuuuguuuuaauuagcuuggcaugguggcaugcgccuguggucccagcuacucggaaggcugaggugggaggaucgcuugagcccuggaggucaaggcugcagugagcuaugaucgcgccacugcacuccagccugggcaacagugaaacccugucucaaaaaaaaaaaaacuaauguaaacgacaaguugaugggugcagcaaaccaacauggcacauguauaccuauguaucaaaccugcacguugugcauguguacccuagaacuuaaaguauaauaauaauaauaauaauaauaauaaaagagugggccgggcgcggugacucacgucuguaaucccagcacuuugggaggcugaggcaggcggaucacgaggucaggagaucaagaccauccuggcuaacacggugaaacccugucucuacuaaaaaaaauacaaaaaauuagccgggcgugguggcaggcgcuuguagucccagcuacucgggaggcugaggcaggagaauagcgugaacccgggaggcggagcuugcagugagccgagaucccaccacugcacuccagcuugggugacagagcgagacuccgucucaaaaaaaaaaaaaaaaaaaaagaccuaauguaaaugacgaguugaugggugcagcaaaccaaaauggcacauguauaccuauguaucaaaccugcacauagugcacauguaccccagaaguuaaaguauaagaaaaaaaaaaagaguguagugcagucacccacgcacuccggucauucacucauucauucauucauucauucacaaaagaagcauuuaugaguuccugcugugugccaggcucuggccuaggcacugggaacagugaacagaacagacucgacucagagcucaaggacuuuuaguccaguugaggagaucaaucauauaauugaucaaauaaucacagauuuguggucguaaguguccuggggaaaacucaagcggaagggaagaugggagggucagguauaugucugcggguggagagucugcaguuuccuagagaguggucugggaggccucucugaagaggugacauuugaacagaaccuuagaugaagugagggagggcucaggggaccugaggcaaagcagagggggccaccagugcaaaggcgugagguaggaucgugcuugggguguucaagaaacaagaaggaggcuggcgugacgagcaccaaaugauugagcagaaguggagaugaagucgcagagugaacugagagucagaugguggagggcauuuuauuucauuuauuuauuuagagacagagucuugcucuggugcccgggcuggaguacagcggugcaaucauagcucacuacagccucgacuuccuaggcucaacugauccucccaccccagccucuucagccccagccuccucaguagcuggaacuacaggcacacaucaccacgcccggugaaguuuucggguuuuuuuuuuuuuuuuuuuuguagagacacgggucucaccauguugcccaggcugaucugaaacuccuaggcucaagccauccuccugucucggcuucccaaagcacugggauuacaggugugagccacugugcccaguucuacagagggcauuuuaggcagaggacuuaggauuucauucugaaggcaaugggaggcuccuggaggauuuggaacuggacgguaacuugaacuguuuaaaaaaggccauucugggccaggggcaguggcucaugccuguaaucccagcacuuugggaggcugaggugggcauaucacuugaggucaggaguucgaaaccaaccugaccaacauggugaaaccgcgucucuacuaaaaauacacaaaauuuagcugggcaugguagcaggcaccuguaaucccaacuacuuaggaggcugaggcaggagaauugcuugaacccaggagacagagguugcagugagccgagaucccgccacugccuuccagccugagugacagagcaagacuccaucucggaaaaaaaaaaaaaaauucuggcugcuggaugaagaagggugggucuguaggggaugaaguggaaguugggagcucauuacaagaggccaggaaacagacucugguggcugagacccagguggagguggcggggagcagugggugguuuucuggacucauuaaaaggcagagccaaagaacuuuggagggacuggacaugaggcugagagaaggagaaagggggaguugggggcaaguccaagggcucuggcugagcaccuagaagggggcacugcuaggcagggaagguggagggaggggggagucuggagggggaagcugcaugucaggagucuggagcagggugaguuugauuugagacacccaggcacccauggagagagcugaaugagaugguaagaaacccaagcugcagggagaugagggaguugcuggcauauggaggcacuuaaagucaagacacugaaugaggccaggugcugucacucaugccuguaaucccagcgcuuugggaggcugaggcaggaggaucgcuugagcccaggaguucaagaccagcuugggcaauacaaauacagugaaacccccucucuaccaaaaaaaaaaaaaaaaaaaaagccaggcaugguggugcgcaccugugaucccagcuacucggaaggcugaggugggaggaucgcuggagccugggaaguugaggcugcagugagcugugauugcaccacugcucuccagccugggcgacaaagccacacccugcaucaaaaagaaaaaaaaaagaaaagaaaagaaaaaagaggcgagaucauuaaaggagugagucagagaagaggcccuugugggcuuccugcugucuacaagagaaaaggaugcugagacacgccugccagugaggcuucggagaucccagagacucggacacaccuuggauaagcaggcuuucugacugggaccugagucuagcuccuuggcaucagugucccauuugugugugugcuugggugguuuggaggggcugcagcugagagcugacugcagggagaagugacgcuaggguauggcauggccccuuguggucaucccgucacccuccuccugcugggcugggcuggagagcgggagugggggacaccuuucuuucuuuuuuuuuuuuuuuugagacggagucucgcucuguccccaagcuggaaugcagugcugcaaucucagcucacugcaaccuccgccuccuggguucaagugauugccucagccuccugaguagcugggaguacaggcaugugccaccacgccuggcuaauuuuuguauuuuuaguagagaugggguuucaccauguuggccaggauagucucgcucuccugaccucgugauccacccgccuuggccucccaaagugcugggauuacaggcgugagccaccgugcccaacccuggggggacaccuuucuuaccccuuccccacucuucucagauucaucaauaagcugcagccaggcuccgugaagaagaucaaugagucaacccaaaauuggcaccaggugagcccagacacaaucucuuccauccuugcccgcaagccccucagaccuccccuccccacccagugaccaccaccugccccccucuagcuggagaacaucggcaacuucaucaaggccaucaccaaguauggggugaagccccacgacauuuuugaggccaacgaccuguuugagaacaccaaccauacacaggugcaguccacccuccuggcuuuggccagcauggugagugugguugcaggcugggcaggggguggugggcagccugggcugggaugcagguguggccacuugugcuccugagcccagugaagguggcggagcggggggcagggaucggggagcaggugcugucaacagcguccaagggggccgggcgcggucgcucacaccuguaaucccagcacuuugggaggccaaggugagcggauugcuugaggccgggaguuugagaccagucuggccaacauggugaaaucccgucucuacuaaaaauacaaaaauuagcuggacguggugacgcaugccuguaaucccagcuacucaggaggcugaggcaggagaaucgcuugaacccgggaggcggagucugcagugagccgagaucgugccacugcccagccugggugacagagccaagacuccgucucaaaaaaaaaaaaacaaaaaacaaaaaacaguguuggccgggcacgguggcucacgccuguaaucccagcacuuugggaggccgagacagguggaucacaaggucaggagauugagaccauccuggcuaacauggugaaacccugucucuacuaaaacuacaaaacaaaauuagccgggcaugguggcaggcgcuuguagucccagcuacuagggagacugaugcaggagaauggugugaagccgggaggcggagcuugcagugagcugagaucacgccacugcacuccagccugggcaacagagcgagacucugugucaacaacaacaaaaaaacaguguccaaggggacugugcagccuggaggcccccuugucagucccugcuuucccugccccaccuaggcgaagacgaaaggaaacaaggugaacgugggagugaaguacgcagagaagcaggagcggaaauucgagccggggaagcuaagagaagggcggaacaucauugggcugcagguaccgcccuguccucacugcgcagaggucauagaggccaggagggcacccugaugucugaaggcuuuuggggacaggauauuuggcauuaacuauacuauaggccggguacugugcuuaugcucaucuuccauucacaaacucacucacucugccaacaccccagcagacaggugcuuguuaucaacauacccuuuccgcagaugagaaaacugagacccggagaagcuggcucgcuuuugcacagaucuuccagcugaugcguggcaggcuggaacuucaaugcuagaagucagucaugugauaggcccacucugggccucaguuuccagucucgaaaggaugccucaggcggggugcaguggcucacaccuguaauuccagcacuuggggaggcugaggcaggaggauugcuugaggucagguguuucagaccagccugggcaaaauagaaccccccuccaccgccaucucuacaacaaauuuaagaguuuagccaaaugcaguggugucugccuguggucccagcuacuuaggaggcugaagugggagaaucacuugagcccaggaguucaagguuacaaugauugcaucacuggacuccagccugggcgacagagugagacccugucucuaaaaaugaaaaugggcuggguaugguggcucaugccaguaauccuagcacuucgggaggccgaggcaggcggaucacuuaaagucaagaguucaaggccagccuggccaacguggugaaacccugucacuaccaaaaauacaaaaacuagccggugugguggggcacaccuguagucccagcuacucaggaggcugaggcaggagaauugcuugaacucaggaggcagagguugcagugggccaagauugugccgcugcacuccaaccugggcgacagagugagaugcuaucucaaauaaaauaaaauaaaacaaaaaaauagaauagaacaaaauaaaauauaaaaauaaacuaaaaaaugggccaggcacaguggcucaccccuguaaucccagcacuuugggagggugagguggguggaucaccugaggucaggaguucgagaccagcguggccaacauggugaaaccccauuucuacuaaaaauacaaaaaauuauccgggcauggugaugcccaccugugaucccagcuacuccggaggcugaggcaggagaauugcuugaaugugcaagauggagauuucagugagcugagaucaugucacugcacuccagccugggcaacagagcaagacuccgucucaaaaaaaaauaaauaaaauaaaauaaaaauugaaaaaaaugauaaagcggcgccucauccucucccaucagcuaugccucauggcccaugaugaggucuguaauuauuggugugauucuccuucuggcuuccuagaugggcaccaacaaguuugccagccagcagggcaugacggccuauggcacccggcgccaccucuacgaccccaagcugggcacagaccagccucuggaccaggcgaccaucagccugcagaugggcaccaacaaaggagccagccaggugagugggggcccccgggacacgccgucaaggcccaggacccuggccaccccacggccugaccacaccacccuucgcaggcuggcaugacugcgccagggaccaagcggcagaucuucgagccggggcugggcauggagcacugcgacacgcucaaugucagccugcagaugggcagcaacaagggcgccucgcagcggggcaugacgguguaugggcugccacgccaggucuacgaccccaaguacugucugacucccgaguacccagagcugggugagcccgcccacaaccaccacgcacacaacuacuacaauuccgccuagggccacaaggccuucccuguuuuccccccaagggaggcugcugcugcucuuggcuggacccagccaggcccagccgacccccucucccugcauggcauccuccagccccuguagaacucaaccucuacaggguuagaguuuggagagagcagacuggcggggggcccauuggggggaaggggacccuccgcucuguagugcuacaggguccaacauagagccggguguccccaacagcgcccaaaggacgcacugagcaacgcuauuccagcuguccccccacucccucacaaguggguacccccaggaccagaagcucccccagcaaagcccccagagcccaggcucggccugcccccaccccauucccgcagugggagcaaacugcaugcccagagacccagcggacacacgcgguuugguuugcagcgacuggcauacuauguggaugugacaguggcguuuguaaugagagcacuuucuuuuuuuucuauuucacuggagcacaauaaauggcuguaaaaucuc

SEQ ID NO: 192031 - RNA, 6194 nt, Homo sapiens
gaagucacuaucucccgggugaacggagcuuucgcagcuggagaaggugagugcuggugcggcucgugcgagugggcguugggggugggcaggacuggaaguuccucuacuccgugcguuuacgggguccuggaggaggcuccugggaccucgagcuugggggaaagccggucggggagacugacuccccccgaccccauccuuccaagcgcgacuaccgggacgccuggcuccucccggcggccgucgggaggcgaugccgaagcuuuagugagucuggaggaacagccaaccccccaccucuuggguaccagcagauucgggggaugacuccucugccauccccuuuuggcgcucuuggacuuaacguugucacaggacaggcugaggccucugcauuccuugugcaagccagaccccauucaugggauggggagacuguagucccugggcaaaaugagcuucuggggcucauccguagauuuuguuuggacuuuuuuuuuuuuuuuugagagugagucuugcugugucgccgaggcuggagugcaguggcgcgaucauagcucauugcagccucgaccuccugggcgcaagcuucccacuucagcuugccgaguagcugggacuacagacucaaggcuaauuuuuguaauuuuguagagaugaagggucucacucuguuucccaggcuggucuggaacuccuggcuucaagcgaucuucccaccugggccucccaaagugaugagauuacgggcgugacgucccaaagugauagaguuacaagcaaacugauugagugauuuauucaguaaugguuauugcugggcacgguggcucaugcuuguaacgccagcacuuugggaggccgaggcgggaguaucucuugagcccaggaguuccagaccaggcugggcaacauggugggucccugucucuacaaaaaauacaaaaauuagcugggcguggugccgcggcuaauuuauauuucagagguagaggggcagggggaggaucgcauaaggaaugugugagggaaaaagacauugaggaugaauccaagguuucugauuugauuauccggaaagauggaauugcuguuagcugagaugaggaagacuggaagagcagguugcaaugucaggggcuugguuuuggacaugauauguuuaaucuuagguggaaguuagacaucagguggagguguggcugaggcagauagaucagagucugcaguucagacucaaggcuggagaagcagguggccucaguguagaguaggcaugaagcccuaagacugggugaaaucuucauguggugaguauagccagaaaggagaggauccaacaauuaaacucaugggcuuuuugcucuguugcccaggcuggagugccucggcucacugcaaccuccgccucccagguucaagugauucuccugccucagccucccgaguagcugggauuacaggcgugcaccaccaugccuggcuaauuuuuguauuuuuaguagagaugggguuucaccauguuggucaggcuggucucgaacuccugaccucgugaucugcccaccucggccucccaaagugcugggauuacaggcgugaaccacugcacucagccuuuuuuuuuuuuuuuuuuagaugaaguuuugcucuguugcccaggcuggagugcgguggcacaaucucagcucacugaaaccuccgacucccagguucaagcgauucuccugccucagccucucuauuagcugggauuacaggcaugugccaccacgcccagcuaauuuuuguauuuuuaguagaaaugggguuucaccauguuggccaggcuggucuccaacuccuaaccucaagugaucugcccaccuuggccucccaaagugcugggauuauaaacgugagccacagcgccuggcccaaacucacgugcucucuucauuggagcaaguuggcagagaggcaggagcauaggagacuagcaggagccaccagugaggcagaggacagggagcacauggcauccugagagccacaugugcucucaggggaggaaggaccucuggaaugggaggacugccauugggauuugcaguauggagccaccaguaaccuaaguuuggaggcaaggggugcagagagaugggugggaaugcagauggcuguacacuaaaacagccugcagagaaaaggaucauagcuggaagaggaugaagaguuuuuuuuucccccuuuuuaaaugaggagagagguaauaacaagugugugagagugauccaguggagcuggaaaauuugauguugcucaaagaaaaggggaugggagccagggcagaaugaacaaauuguuuuugcaggaacuuacuuccauaguaaaggaggcaugccgaagcugggcaugguggugcacaccuguugucccagcuacugagcaggcugaggccagaggauugaggcuuuagcaagcugugaucaugccacugcacuccagccugggcaacagagcaagaccucaucucuuagauaaauaaagagggugggugaauggcugaaugaguugguccuaggagcugucuuuggauugcuucuauuuacucagugaacuggaagcaucacaguuaagaguuggggguguuggcugggcgugguggcucacgccuguaaucccagcacuuugggaggccgagacaggcggaucacgaggucaggagaucgagaccauccuggcuaacacggugaaaccccaucucuacuaaaaauacaaaaaauuagccacgcgugguagugcaugccuguacucccagcuacucgggaggcugaggcaggagaaucauuugaagccgggagguggagguugcagugggucgagaucaugccacugcacuccagccugggcggcagagcaagacuccaucucaaaaaaaaaagaaagaguuggggguauuacauaggaagugaucagcagauaaugaaugaaacuccacuguuuauucuggaagacacuggcaggcugcugaccuccccgucacaguggaacgaugcuagaaccagcagucguguguguguguguuggaggaggcgccauaggaggcucagggauggcaaacacagugcccugagcaccgugccucgcaggggaguugggcucagugguaacugcugccguuuccccacccaccugccuccuggacaucuguuccuagauaucccucugccacccaaccccaucauuuucuccaaaacccuguccuuccuauguguuagacaucagagaaugaugccaccuugucccucuagccacuauguccccgccacaaccuugggagucauccuggacuuuccuucucucgucacacucacucacucugccgccaugucuccucugucucucucacccucugccaucucuaccccaacagcccuguccuggcugugacuuugucuucauccagauuauggcucacaccgcaguuccucaaaagcacagggugacuuuguccuuucacuccuuguagcucccaggauccauccaaacacccagaacccucccaccugucccuccucucucccucaccugccaggggacggacagcugcccugagccuucacacaguguuccucuacucagaagugccuguccccacuucucugcccugcagucugucaucuggaucgaggccaucagauaaccugagugucacuccuccuggaugguacuuacauguccuuugccaagaggagcagccagaauaaaaucaccaguuccuaggcucuuaggcuccacccggcccugaacagcuggcuugucuuggagucucuugugccacccuccccaggaacaguggcuuccuuguauuggcgccagcgaugaugggccagcucugugcuaaguacuuaacuuaccauuccuggugucagccccacaagucuccucugagauagcaaccuuauuucgacuuuuuuuuuuuuuuuuuuuuugagacggagucuugcucuguugcccaggcuggagugcaauggugcgaucucggcucacugcagucuccgccucuuggguucaggugagucuccugccucagccuccugaguagcugggguuacgggugccugccacuauggccagcuaauuuuuguauuuuuaguagagaugggguuucaccguguuggucaggcuggucucgaacuccugaccucgugauccgcccgccucagccucccaaaguccugggauuacaagugugagccaccacaccuggccuuuuuuuuuucuuuuuuuuuuuuuaugcaggguuucauccuguugccuaggcuggagugcagugccuggaucauaacucuggaucaucacugaaaccugaaacuccugggcucaagcgauccucccaucucagccucccaaguagcugggacuacaggccugcaccaccaugccuggcuaauuuuuaauuuuuuuuuuuuagagaugaggccucacuauguugcccaggcugguauccagguccuggcaucaaguaauccucucaccuuagcuucccaaagugcuggcugggaucacaggugugagccaccaugccuggccuugucucuguuuuauagacgaggaaacuguggcacaaagagcuuaaauaaccugcccaggucacgcaguaagugagagagaugggguuagagccucgucucaccccuuccauccagagugggacagggaauuguccuccugcaucaggacugagggccucgucccucaagggcagaggccccgggaccacggugcaagucccagacccucuuuccggccugcuuucuagagcauugagcuggggcgcugcgugguuuccucaaaccacugacaucugccacuccccacaggcucauccaccugcagacauggggcgcagaaagucaaaacgaaagccgccucccaagaagaagaugacaggcacccucgagacccaguucaccugccccuucugcaaccacgagaaauccugugaugugaaaaugugaguggggaacagggcaagggauccagccuccccacugccucuuccccgcuguucuccauccugccccuugccucccuuggugaaggcgucaucacccacaggcccaggacgcauugcucaccagucccuucucuuggucuguuucagggaccgugcccgcaacaccggagucaucucuuguaccgugugccuagaggaauuccagacgcccauaacguguauccuuggaaaccugggcuuuuuccagaggguggggagggggcuggaguccggacccugcucaucuggcccacugugugcccuggugcagggccaaagccguccagaggaacaggugccaccuagugauuucuguggggugagaagaugcagggcaggguuccaaugccaaugaucgcccuugaccuaaguggcccagaucugucagaacccguggauguguacagugauuggauagacgccugcgaggcggccaaucaguagcgacacagaggacccgcccccugagcagccccgcguacuguggauccagcuguucgguucugguccagagacauuccagggguccaggguguggguccugggcugucacagccguguguguguguguguguguguguguguguguguguguguguguguguguagugggugugcgugugggugugggugugagugaguguggguguguguggcugcacgugucacugggguggccgugagugugugcucacagguacgcgguggugucggguuccugggccugaggggccugaacugaucucacuuggcuccgaaagccuuugcuguguucccugcagccccuggccccccagccuuggggcucuggcuccccccggcggaauugggggacuguuuccugacauccuggacaagggaagcccacuagaggcuggaacaggaccucuccagccuccucaccagcaccgugcccaucucaacuggacuucccgcucuccuucuccaccuucuagugcccguggccggggauucaaagccgccguuccccaggucccugggcugggcccugacagggagccgccccccuccccaugguaaccaggaagcccguuucauguucaguugcuuuuguagaggaagcaagggcugggauggggacagcugucaaucacaagcccuuaaauaaagcagccagcgcacaucc

SEQ ID NO: 192032 - RNA, 4118 nt, Homo sapiens
guugcugcugcagggcugggaaugggggggaccaagcacuucgcagggugacccggggagaucugugagccaguggccucagcguugaaugagagcucucucccggguccgcgcucgcagggacugaagggacuccugaauguccgcgggacgugucgcggcggcgcccagcacggaggaggcaggcagggaggugaggagcaggucagaccggccgcaggugcagggccuccugcccucccaggcugcggucccguggagggccugcagacagcugcugagacuaugagggucagaggucuguggucacgcgcgcuaucaccagcuagcugccuccugccugguuccuccugcaggaaugggagucuggggggaggggagggugugggcaggacuuccuggaaaagggaagcccguugguguuuaugugugggauggagagagggcagggggaggacggggacacacgcggagucccccacccagauguugucaaacacagcucccacaccagacacgcaacccauccuagagaugcaacccaggcacacacacauggacacacacaaaacuccauccauagggauucccacccagugccacgugagaacacaggcgugcaucgcagacaagccacacaggccucgcaggcucagcauacaugucugcagcaacaccaucagguacagagccgaggcccagguaggcaugcucagcugcacgcaggaagcaagacacacccagacacacacagguaagcccuuacucagagaaagaaggugcaggagaugugucuuggguaaucacagccacagccucucaagugugcacacacacacacacucacacugagauacacagacacacagagauaccuggacgugucaagccuacagcacaaacaggccccugcagguccacccggaggcugugugggccgaggcugcugcacacgugugcccagauccucccacccccaccccaaucccguguccugcuccagggaaguccagggcucacaugacccaaggggagggcucccgggacagcccucggagaaacugcaucauccucacuaaugauccacuuccuccucagggaauaaaggcucagggaccggcaguucuacucuagagcccaccagccucucagagccuccggugacuggccugugucucccccugggugagugcugggcaggcuagguggaaggagggugaaaugggccugcagggccaucuugguacagcucgcccucucacagaccgcgccccccuucccuaagccagcuugugcagccuugugcagcuuguguguccugagaauuagggcaccaagggguucccgcaggggcagccugcagcaagcagucucccucuaucucagggcaggcgggggucucaaggccucccugcccuugucacagcccgggccaccuaugcuugucucucuucucccagauggacauguggacggcgcugcucauccugcaagccuuguugcuacccucccuggcugauggugccaccccugcccugcgcuuuguagccgugggugacuggggagggguccccaaugccccauuccacacggcccgggaaauggccaaugccaaggagaucgcucggacugugcagauccugggugcagacuucauccugucucuaggggacaauuuuuacuucacuggugugcaagacaucaaugacaagagguuccaggucugugcccaacagaguggggcaggaggugggggcgggcaguggggagaagccgccuuaccuagugaccuuccuuuggugagggcagagggaaggugauggggcaccuuugggcgccgggagcauucagugucucccuuauccugacuuggugggaggaucggcauagccacugaccccagggaagaggccugcccuaucuguuugcuacaggagaccuuugaggacguauucucugaccgcucccuucgcaaagugcccugguacgugcuagccggaaaccaugaccaccuuggcaaugucucugcccagauugcauacucuaagaucuccaagcgcuggugagccacccucagcccugccuuccgagauccucacauagcagggacacaggggcccuguggcuugagcugacccugggacuucugcgcccaagaugugcacccacgaccucuauccccuccacaggaacuuccccagcccuuucuaccgccugcacuucaagaucccacagaccaaugugucuguggccauuuuuaugcuggacacagugacacuauguggcaacucagaugacuuccucagccagcagccugagaggccccgagacgugaagcuggcccgcacacagcuguccuggcucaagaaacagcuggcggcggccagggaggacuacgugcugguggcuggccacuaccccgugugguccauagccgagcacgggccuacccacugccuggucaagcagcuacggccacugcuggccacauacggggucacugccuaccugugcggccacgaucacaaucugcaggugagggcccuguggguggggugggagcugggugagggggguccccaucccagcugauguccacauggcugggguccuccugcuguuugagggucuccuguggccuucagaaugucuagacugucccucaaaucuugcugucuaaccaggaaaacacuccaaagccagaauaauaucuucgaauugccaauuucuuucuuucuuucuuuuuuaagcucuuuuuuuuuuuuuuuuuuggagacaagguuucauuguuuuucacccaggcuggagugcaguggugcaaucggggcuuacugcagcuucaaucucccgggcucaggugaaccucccacuucagccuccagaguagcugacacuacaggcaugggccaccacaugcagcuaauuuuugcuuuuuuuuuuuuuuuugagagggagugcaguggcacgaucucaacucacugcaaccuccgccuccuggguucaagcaauucuccugucucagccucccaaguagcugggauuacaagcaugggccaccaaaccuugcuaauuuuuauauuuuaguagagacgggguuucaccauguuggccaggcugaucucgaacuucugaccucaagugaucugcccgccucggccucccaaagugcugggauuauaggcaugagccacugcaccuggcccuugcgcauuuuuuuuguagaggcaaggucucacuauguugcccaggcuggucucaaauuccugggcucaagcaauccacccccucagccucccaaagugcugggauuacaggcaugagccaccacaccuggccaccaauuucuuacuaagugcucuaccuaugaaauaggauuaauacacuccuaaaagucaggaaauugaagccaggagggguuacauaccucaaggugacucugugguuagggccagaucgagcccuggaccuuaggcagggcucugcucaaagcugggucuccacugaccccuuguccuccauccucaguaccugcaagaugagaauggcgugggcuacgugcugaguggggcugggaauuucauggaccccucaaagcggcaccagcgcaagguccccaacggcuaucugcgcuuccacuaugggacugaagacucacuggguggcuuugccuauguggagaucagcuccaaagagaugacugucacuuacaucgaggccucgggcaagucccucuuuaagaccaggcugccgaggcgagccaggcccugaacucccaugacugcccagcucugaggcccgaucuccacuguugggugggugggcccugccgggacccugcucacaggcaggcuuuuccuccaaccuguggcgcugcagcagggcaggaaggggaaacacagcugaugaacuguggugccacaugacccuuguggcacagaugcccacguaugugaaacacacauggacaugugucccagccacaguguuaugcucuguggcuggcucaccuuugcugaguuccggggugcaaugggggagggagggagggaaagcuuccuccuaaaucaagcaucuuucuguuacugauguucaauaaaagaauaguugccaaggcugaa

SEQ ID NO: 192033 - RNA, 63969 nt, Homo sapiens
cucggcgcugaaauucaaauuugaacggcugcagaggccgaguccgucacuggaagccgagaggagaggacagcugguugugggagaguucccccgccucagacuccugguuuuuuccaggagacacacugagcugagacucacuuuucucuuccugaauuugaaccaccguuuccaucgucucguaguccgacgccuggggcgauggauccguuuacggaggugagugaguuugcgggugcagccagccaugacccaccgcucuaggcccccacccaccuuccucugucaaccucugggcgaacccccaccgggcggagggcgcgugugugcgcgcgugcgcagugugugcgggccggggucgccgcggcugcggccugcugugguugguggguuccucugagauuuuguuguuucgguccuacagauaaaacucagggaggaaggcuuugagucuguccuaaaaggcuguugcgagaggucuuucagcccccguuuuuaccaugucccucugcaguccuggcgcagcaagagugaggcgcaggccugcggaacggguccugcuggaagcagcuggaaugcccugcagggcgggguccggggccggugacucagugcggcugccgccgggaaaggcaguaggaugugugauuugcggaguucacgcagcccgcaggggagaugcuaaugaaaugacagcaaaacguuaaaauaagcaggugcuagaaaccacugcauucguucauaaaaagccaguaguuccuugagaucccauuguucagcuaacuaacgaagaaguucauacccgggacugaccauuuuaauugaaacaaugcaaguguaccgagcaaaacuaucagcucacgauuuuagagcaaagaaauaaacuuuucgguguuucuggggcauaucauuacaguacuuauuucaucuuuuguuccuuugagauugcauauggguuacaugguuauugugucgauuucucuaguuuuagcuuuuguggagaaugugcguugucacauucaggaguguuuuguugccaguuguccacucucuuuuauuccaggacaguuccucuuucuuuaggcuguugugcaaauuucaaacuguuaguuuuugaguguugcaaaguggaccuaaaacuguuuacacugauucaaaaacuuaaaugcugugaagagugguaauucuuucggggagauguaauuauaauucuauaaguuauguaugagauauuaauuacagauuucagcaauuagaguuuacuuauauucaagcaugacauaaucuauuuuucuguuucaaauucuuaaucaucuugggacaaauacaucaauuuuuuucaccuuccuuaaagguucuaauagaaaaaucuagagccuauuuuuguauuagccuuaaaauagggcuggucaugcaccaaguaucuuucacuuacacugaggucgaaaagcguguauuuauuuuaucuaaacuagaauacgauuccuuaaaacauuagcccuaugugucuuccuaaguaacagacaggaacaaagcauuuuuaaguuggcugaaaauugcacuucauuuuacuuaaaaaugucauucugaagguaguacaaaucucaacugaaagaaacuuuaccuguuuagaucguuuuaggaugugcucagaaauauguaugguuuauauuaugaaaaguuagaucacuugcaguuggaaaaacagcuuagacgucuuuuccuuaauagguaaugaaugaacuacuugaauugauuccaacucuugggugcuuaauuauagcauucauaacauuugcacagugaaaugagcuacugguacaguugucuaucaacugaaagucaguauaaaaugacucucucaaccaggguuuccucucagaaccaugguacacaggaaaauugagagacuauuuucucaauucucccaaggauaauucaaugccacccuacaaacauaggaaauaagucuaucauauuaacgccagcguauuagggcuuaauuauuuugguaacuccaguugagaaagguuacaaucaugguaaacucucuuuuccucaaacaagacuguucugcauuggucuuccucccuguggucgcugauacuguucuggcacucuuuuuuuuuuuaagacggagucucgcagugucgcccaggugacaaaaccauaaacucacuacucauaacgucaagaguuugaagcucuacucacaggugauagucaucccaguacaagaauacuacaaagaaacccagagugaaguguaccaauccagaacuuucuuuauaaaaaccuuaaaagagaaaaagcuauaauuaaaauacuucacagaagcauauuuuauuguagacgcuuuagauccuuuuaugucugcaggcugcauauaaauaaguaugcaaauaaacaugccacuaccauuuuuaguggaauuucucuuauuuuccagaauuaaaugaaguucccuggggaagagcugcuagagcauauugaaaauaauaagaaguuaauuuauauugagucuacuguguuaaagaaggcaaggaaauuaguaaaaucuccuagaaaaauuugucagagaugacuuugggguguauguggcaaaaguuguucagggacuauaagcuucaguuaccugagauucauacaugugggcuauccuacuucuugaauauguuauugcagugguuuuuuuuuuuuuuuaaugccuacacuguuugagaaaggugugauauuucaaggaauauaccuuguauuuaaaagaguuuuaaaauuccugauauacuauuauaaggaacggcuacuuacauuuauugagcuauugaguuuauauauuuaagauauauaauuucuuuuaauuuaauaaccuuugguguuuauagcuuuacuucacagauuagggaucuuuuuuuguguaucuauuuaauuuuuuuuuaaucugggaauuuuugaaucuaauguaagcaauagaacauucauauacguuugaaugacaaaaucacauucuuuuguugugaccuacugcucaugguaacugaagcuguacugacucacaaauguucuaacugaccagaauggaaugugggcauguccacgaaugaauauaauuaggcuaguguuguaucugggaagugagagauauagcaauugaaaaauuacaaauuuauuaauuuagaaaggagacauuauuucuuuuuucuuuuuucguuuuuuuuuuugagucagagucucguucucgcccagacuggagcucaauggugcgaucuuggcucggugucacuucugccucccagguucaagugauucaccugccucagccucccaaguagcugggacuacaggcaugcaccaccauaacuggcuaauuuuuguauuuuuaguagagaugggguuucaccguguuugccaagcuggucucaaauuccuagccucaagugauccgccugccuuggccucccaaagugcuggaauuacaagcaugagccacugugcccagcagagacuuucuuauaaaggcuuacagccuacaguguggccauccugacaggcugggaaacauauuuaauagcuucgggcagagacuggaaacaggcacuucaagagaggagaagcuggaacagggauuuaugccuaaaggguuagccagguauacauauucaacagguuauaggcagagcuaugaguauuuacaaagggguccugauggguggguacugaacaaacgugcaguuacaugcaucccauguucacuuugggaugaagacuuaacguggaaauacauuacaguugggcccuauaugucaaaaggugagguggggacaugaaggcauucaagugagcagccucuguaaacuggccagaaucaguucaugguugguggucuucuuacugagauagauuuauugaaaucaaucucuuguccaauuaaagcuguagcuguagcuuguggagcaggaggguuagucagugucugauggaagaugagcugcaauuguuuuaauauuuauugcuuaucucaaggucagugcuuguucagcuacuagaguaaaagaaaaacuuuggcaguuagaagauaguuuauuuuuuaaguguagggaguuugugacuuaacccuugccuggcauggccuuagguccuaguuauuuguuuacagacagggucucacucuguuacccaggcuggagugcaguagcgaucacagcucacugcagccuugaacuccugggcugaaguaauccuuuugcuucagccaccccaccccccagguagcugggacuacagaugugccccaccaugccuggcuaacuuuuguauguuuugcagagacaggaucuugcuuuguugccuaggcuugauccuguuuauaauuugauaucuuauugcuacaaagagucuucugucagucuuaugaucucuauuuaacauuaaugcucaucaguuauuguguuuaaacagcaaaaggagggguauaacaaggugcaugcggccuccuguuccaucauggcugagaacucgguuuuuaagguuucucugggguccccuucaucaagaggggaucuguucaguugguugggaggauuaguauuuuauuuuuaguucucauauuguaucauggggggaaauuaucggacauauauggauuugugaaacaauaugcuuauucuugaauuuguugaaggacuuuuauuuagcgggugaaggucuuguauuuuggaagccauuugguucauaaauuauuuuuucagugauuagagcauuucaauuuagugucacuuuuuucaaugaacuuuaaauuagaaaucauucuuaagaagaguagagagugugccuucuuucaaauuuagcucauauuucuuuuacauacucagauuuuuaaaaaauuguuacuguauuuuaaggaauuaaaaagagucaaauggaauuuaauuuuucagccugcacuaacuacuguaucugaguaugcaaggcaguaauaauaaucugcauaccuccuuuaguugugugcauuugaaagaaaaugaauuguuuuacagggucuuguguuugagcuuuacuaaaauugacuuaaaaauaggaacaucaguugauuuggaguagaaaggaguauucaugacuuuauggaauggcuaagauuucaauuuaaaaccauuuuauuauauguuaauauuuaguuaaauaaaacauaagauuauuuuguuuuucuuuccucuuaggaaguguuuuauguuuucaaaggacuaauauguuauuuaucucuugcugcuuaccaccaccccagauuuuaguggcucuauuaguuuugcugcuguaacaaguuaucacaaauuuaguggccuaaaauaacauauucauuauuuuacaguucuuuagagacagggucucacucugaaaucugaaauggauuuuacuguguuaaaaucaacaugucaguggaauuguguuucuucuggaggcuguaggggagaaucuguuuccuaacuuuucuuguuucuaaaggccaucuguauuucuuggcuuguccuguucccccaucuucaaagccaaaaaucacauuacucugaccucugcuuccauggucauauuuucccugacucugaucuuccugccucuguguuuuccaucauaaggaccuuugugauuauguugggccugaccagauaauucaggauuaucuccaucuaaagauucuuaaucacaucaguaaagucucuuuugcucuguaaggcaacauauucagagguuuaggguauuaggacaaaaaaucuuugagggaccauuauuuugccuaccauaguggcuuaaaacaauacucuuauuucucaugauucagugggucaacaauuuguauugugcucagccgggcuguucuucugcuugucucugcaguggucaugcaggaaucuucagugaucuggcagauuaucuggagcuggauggucuaagguggccuuauucauauguuugguaguugauacugaccaucaccugggccaugugucuccucuaguagacuuaaccugggcauguucacuuaguggcagagagagagagagaccccaaacuguaaaaucucuugaugccuaaaagucucacaauaucacuuguaccauauuuuauuggucaaagcagaucacaaggccagcccagauucaagggugaagaaauagauucugucuuuugaugaaagcagaaaaaauuuguggccguuaaaaaucuuauauaacuaacuuuacauauuuuauuccuucuguaauauuccuguaauaguuaugacauugggguacucauuuagugaaucuugacauaauugcuuaggauuucacuuuugaaauguguuuaacugucauccuguauggcaauuggugauuuuagaagauacugcaauuuuaugaaccuuugauuaaacuuguguuuuaacacugauauauuuauuuauguagaaacugcuggagcgaacccgugccaggcgagagaaucuucagagaaaaauggcugagaggcccacagcagcuccaaggucuaugacucaugcuaagcgagcuagacagccacuuucagaagcaaguaaccagcagccccucucugguggugaagguaaaagacuuuguggggaaaaauaacauuuacuuuuuuuuucuuuugaaggagacaagccccaaacauuucauuagcauauagaagaaccaagcucuuugggagacaaauguaacagccucugggggaaauaacagccuucuauucuauuucagaguuauuauauuaggccuagaaccuauaggguuggaacgguuucuucuaaaaaauauuuuaaauuaauugauugaacuuuauuuucuucauucugaaguuauccuuaaaaccucaagggaagaaaaauaaaggaguaggguaacauuuauacuuacaguaguguguaguuuuuuuaucccagggguggcagaacagcuggccacugaguuuggguggugucuccgguaccagcaaggcaauggaaggcacacugcccaugcuugacauuuaaugaacccuuuucacucucuauuugcugaaccaacucucuaaaguuuagguuguuaaucuccagaagugguggaauuaaacacaagcacacacacacauacacacaaacaaaaacucaccuguagucuuacucuuuccucaauccuaggauugauucccagccagcaucagacagccuccuuagucuuuuccuggaguguagaauagucuggagauaauaaucuuccuuaguacgacuguaaaauacuguaauacaacuguaaaauaaaauauagaaaaaauuacagagggcaaaaccaauguuuuuuuaaaaaaaaagaaagcagagaaguguacauggggcuagcucaguuauuuuggaagcuaaucauagaacaagaauuaguuuucauacguuuauccauuuugaagggagagugaaggaaauacauuacauauuauaugguauucagccaggaaaauaggggccugacccuaguccaggaucuucguuuucacugugagauggguuuguacuauugagugcuauguauuugaaaccaguguuaccuaaacuucuuuagguagaaguucaaaacuacauuucgauguuuagguagaaguucacauuuacuguuuuagauaauuguaaacuagaagaauucuguauuuccagaugguauugcauguuaaagcaggaacacuuucaaaaauuauuagauguguucauagaaaauagaucgauaagugaguuauaaaacauuagaaaguuucaaaaauaaaaaaaggaaaagaaaagaaaaaagagccaaguguaguggcucacgccuguaaucccaacacuuugagagacugaggugggcagauugcuugagcucagaaguuggagaccaccuugggcaacauagcaaaacccugucucuacaaaaaauacaaaaauuagcugggcaugguggcacaucuguagugccagcuacacaggaggcugaggugggaggaucgcuugagcccaggaaguugaggcuacagugagcugagauugcaccacugcauuccauccugggugacagagugaggcccuaucucaaaaaaagaaaaaaagagacauaaaaguggaguggggaaaaaauagauuagaaaguuucaugauguauauuuacuuagguugaugucaacgaggcaaucaugauuuaucccugauacuacuuuggucacugccagaacauuuguuuaggcaguugaugaaacugaccucauaugaaauguaccuucuuugaaaauauuaauuuuccaggagauauauugaaacucauaguuagaaauaauaugccuuaugguucugauagauuuuuuuuuuuuaauuuuagggcuuuuucaguuauuuuauagguguucauagaagcuugaaauaugaaauguuaaauauuuguacuggugaauuuguuugguauugaccagauaauucagucacuuuuucugucuccugucguaauccuaaaccucaagccaauugcccuucuaaccaugcuuauuaguuauuuuccaugaaagaauguuucaaaaacagaaaaccugguuucuacacuuggcucagcugugugacuuuaggcgggcaacugaauuucucuaggcuugauuuuucuuaucugaagaugaggugauuaggcuguauaauccuuaaaaucuguuagaaugcuuucuuauucuguguguaugcacuuuuuauuuacuauugucuuaacacuauauaaaguguuaugcauauauuuugaaaauaugauuuaaauaucuuuauuuuuauuuuuccauaaguuauugggguagaggugguauuugguuacaugaguaaguucuucaguggugauuugugagauuuuggugcacacaucacccgagcaguauacacugcaccauauuuguagucuuuuaucccucgccccccuuccgcucuuccccccaaguccccagaguccauugcauccuucuuaugccuuuccauccccacagcuuagcucuaaauaucuuuucauuaagguuuuuauaauauaaauugugucugcuugaaaagaucuuucauaucagauuucuaaguugcugaaagagaaugggguuuuacauacuucugguuguaacuaaaaucauuuaaaagaauagggaggggugauguuuuauuaauuuguugaguaucuacccucaaguuuuucaugugagaaauuacaaauuugaaugucuuuuuucaucguuuuuaauguagagaaaucuuguacaaaaccaucgccaucaaaaaaacgcuguucugacaacacugaaguagaaguuucuaacuuggaaaauaaacaaccaguugagucgacaucugcaaaaucuuguucuccaaguccugugucuccucaggugcagccacaagcagcagauaccaucagugauucuguugcugucccggcaucacugcugggcaugaggagagggcugaacucaagauuggaagcaacugcagccuccucaguuaaaacacguaugcaaaaacuugcagagcaacggcgccguugggauaaugaugauaugacagguaugaauuguauagaugguauggcccauacaucuguuccaauaagauucaguuugguauguugaacauuuuaucaguuaacucaugaaaaauaaaugcuuuuguuuuaucuauauguugaguauccuuugcuugcauaugguuugucuaccaguaguauaaguugguuauguuuagacugaaguagaucacgaugugguucuuggacuaguucauagaaaccugaucuuauaacuguauuaccuuaauaucugcaaugaaaaacacuugagaacaaacuauacguguuguuagcauugcugacccucagcuccauguuaaagaaauccuauuucauggauucaaaaauuaaauaaacuugagggacuaagguaugcaaugcuguucaguaggggagaaauaaaaugucaaaaaacauaaauugagcagcugcaaaguauauuauuacacacagugcuagaaaugaaugaaguggcuugauccuuaccuuucaugagccuauaaucggaaggggaaccugagaaguaaagcaacaguuaugcaacaggguuauuuaugguaugaucaauuucacuuaucgccugccuuguuacaaaaaaaaaaagcuuugagaugacuuauaaaaauaucuguauuuugaaaccagaaaaaugaagucaaggugaagagaaaauacgggaagggaaaacaaagaagugaaaaguaaagucauuuuauuaaaugcagacuguaaagucuuccuuuugcuagaggccuaugcgaagacaugaaacaguuaucaguuacaugacuaacaagcuaaaagcagaaccaucuuuggcacuaagacuugcaauuuggcaguaagagcugagagaacuuucuuucauguguccuuaaauaugacuuugugggagccgauaaaccuauaagguuucuuaaggcaggcagauguccuggcuccaagcucaguaaaagcauuucuuuuuucuuuucuuuuuuuuugagacagagucucacucuguuacccagucuggagugcagcagcacagucuuggcucauugcgacuuccgccucucagguucaagcgauucucaugccucagccucccaaguagcugggaugacaggugugugccaccaugcccagcuaauuuuuuuuguaucuuuugguagagauggaguugcaccauguuggccaggcuggucucgaacuccugaccucaagugaucacccgccuuggccucccaaguguuaggauuacaguaaugagccaccgcauccagcaguagaagcauuucuaaagugagcuagcauagugcagguagaccccacggugcuugcagacagcucaguggcuacugggccucacccaaggaagcauuccuuaggugguucucagccuggcugauuguaucagaaucacauagaccauaggauuagaauuucagaaaugugguggagcucaaagaugugcuuuugucuuauuuuuuuuaaagcucuuuagguaauucugaugcauagccagaauugagaucaagugaucugaagaauggggcuuggaugguugacagauauuuuagacuggauuaaaccagauggacuacauauauuucaggcagucuuccauacauaucaguucuuuuaacugaaauguugauaagaauuaggcagcagagaguuuaagauuauguuuucuggaagugaugauaauaaucucaagagcaaacaguauguaaaaugcuagguauugcaaauauuuuuuauucuaauauaaauuuuuuuauucuaauagcguuuaauucuuauaaucuugagauauauaccacuuuuaucuucauuuuauagaagaaggaaacuggguucauagaggcuaauaaaccuguccacaguuagccagcucaaauucaaaucccaaugguuugacuuuagagcucuuaacuccugugaccugccugaugauuuuuuuguuuuuguuuuuuugagacagagucucacugugcugcccaggcuggagugcaguggcgcaaucucggcucacugcaaccuccgccucccagguucaagcaguucuccugccucagccucccgaguggcugggauuacaggcacaugccaucacacccagcuaauuuuuguauuuuuaguagagaugagguuucaccauguuguccaagcuggucuugaacuccugaccucaggugauccgccugccgcggccucccaaagugcugggauuauagacgugagccaccucggcaggccaccugauguuuuuuggcacauagcauagucuauggugucaauuaauaccuauuuauuuuagcaguggugagguaagagguaggacucgacuccagaugcgggacuuggacacuggacaagauagagaaauaacaacaacaacaaacaaauaaauuaaaaaaaaauugaggacuagcuaaaacagggccugggggaagcagcuuuccagugacaugcccaccagugugccaugucaauucaucauugccauggcaacacccaggaguuaccaccccuuuccauggcaaugacccaaaaguuacuaucccuucccuagauauuucuacauaagcugccccuuaaugugcaugcaauuaagaguagguauaaauaugauuguaaaacugcccugaacugcuacucucugccuauggaguagcccugcucugcacagggaaucaacagagcuguaacauugccucuucaauaaagcuauuuuuuuuuuuuuuuuugagguggagucuugcuguguuucccaggcuggagugcaguggcacaaucuuggcccacugcaacuucugccuuccagguucaagcaauucuccugccucagccuccugaguagcagggauuacaggcacacgccaccacacccagcuaauuuuuuguauuuuuaguagagacaagauuucaccauguuggccaggcuggucucaaacuccugaccucaggugauccacccgccucggccucccaaaauacugggauuacaggugugagccaccguguccugccugcaccuagguuauaauacuagccuucuaacuggucuuccugcuucagaccucugcccuguccagucccuccucaauuuucacaccagcgcgauuuuucuaaaacacuugccugcuucugcuuuaaacucucccaggaccuccccaucaccuccugauuaaauuccaaucuggaccugcucuuuuucaaacguaucucucuauuuugacacauucagaauggaaaaaaaauguaacucuugcuuuucuacugcuugcuuuaaacaccagaauaggaucuacuuauacacacacucugcucauguuacuuaccucugcuuucuauacauuuuuguuuuucugacuagauuaucuccauucucugaagccaguuguccuucagaguccagcuuaaggagucucucccuccuccagaaaagccucccugaccaccacuuuaccugcaauacccuuuauauacuucuguuauuuucccuagaauaaacacuguccuaucagcagaugacaguuuuauugucauauuuuaggaaugggcuuaauaagaccucuagcucuuguaacuauacucuguggugcaugccuguaaucccagcuacuugggaggcugaggcaggagaaugucuugaacccgggaggcggagguugcagugagccgagaucgcgccauuacauuccagccugggcaacaagagcgaaacucuuucucaaaaaauauaauauaauauaauauaaucuaggugcaaagagugaaggccuguggaaaugaagaggagaagcuggauuugagagauacaggagacaaacucuaagaccuaacgacuggaugguggagggagaagggaggaagaggucagauuccuggccucagugacuggguaguuagugaugucuuuuccuaagaugaggaggaauauguucggggcaauuucaacuucacauauguuauuugggauaucugugggagagccaaauggagguauuugguaguugcaagacugugaaggauaagccaggaaggauaguagagaaugaugucacaaauagaaagggagugauauauuuuagagaugucaagaaauacaaagccugcaaaguguguacuggcaucuagugacaauggcaaaaccaacuucagggcagugguauaggcagaaggucaguugagugaguuaaguggugcgugaauauugugcagggaaagaggggcgguaguuaaagaggauguauaucaaugaggggauguuuauuuuuuuugagacagggccuugccucauugcucaggcuggagugcagugguaaugcucucagcucgcugcaaccuccuccaccucccaggcucuagcgauccucccaccucagugacccgaguagcugggacuauaggcgcaucaccaagcccagcuaaguuuugcauuuuuuguagauguugcauuuuucguagguuuugccguguugcccagguuggucuugaaguccugagcucaagcaauccacccgccuuggccucccaaaguggugggauuacaggcaugagcccaccgcuccuugccgggauguuuguuuguuuguuuguuuaugagagggagucuugcucugucaccgaggcuggagugcaguggcacgaucucggcucacugcaaccuccgccuccuggguucaagcuauuccccugccucagccucccgaauagcugaguuugcaggcgcccgucaccgugcccggcuaaucuuuguauuuuaguagagacaggguuucaccaugucacuuaggcuggucucgaacuccugaccucaaaugaucugccugccucggccucccaaagugcugggauuacaggcacgggcccuuugcaccuugccaguauguuuauuucuaaggugagagagacuugagcauccaguagucuccccacuuauccgcuggguauauguuccacgaccaccaguggaugucugaaaccucagacaguaccgaacccaauugccaucauucacaccaucuuucugugcaucuuccaccuggaaauguaaugccuuuuccaucuuaacuaagcacuuacacacacuguggccauaacuuucauaguuugagguacgacagcaaaacuccaugaauuucuuuuaucuuccucacaauuucauggaagaagauucauuuuuaccauagaucuuagcaaccucagcguauuauuuucuuuccuuauuuaguugagaacuuucaccuuuugacuucaagaaagcacuuuauggcuucucuuaggcauaucugaauugccagcaccacugcuacugcucuugugcuuuggggacaucauuagggcaaauaaaggcuacuugaacacaagcacugcauacuccaguagucgaucugauaaccaagacggcuauaaagugauuauggggcggguggcauauacaguguggauaugcuggacaaagauucauauccuggucagauggugcaagauucauaaugcuacucagaacggugugcaguuuaaaaccauauaugaauuguuuauuucuggaauuuuccauguaauauuuuuagacaacaguugacugcugauaaggaaacugggaaagugaaacugaagauagggcgugggcuacuguauggucauauaccacauauugacguuuugaucagugguggacugcauauacaaugguagucucauuauaauguauuuuuacuguacuuuuucuauauuuagauguuugcuuaccauuguguuacaguugccugcaauauucaguagaguaacaugcuguacagguuuuuagccuaggagcaacagguuuuaccacauauccuaacuauauaguaggcuacaccauuuuuguggaugugugcucugugauauacagauguacacauaacaaaaucaccucaugaugcauuucucagaauguauccccauuguuaaacaacucaugacugugcuuaugugcagacaagaguuuguagagaaggagagggcuuauuucgagcaagaucccugagaagguuuuggaggggcagaauugaaaauucagcagaaguagaagcuuuggacaggagggauuccucuuuccuugauugaauuuguggaguaggaagugcuaugaaccuuggcuucccuauauacaugcccuagggaaggccuagaaucuucgucaguuaaauaucacuauuugggauuucucuccaaaugaaguaacuaugcagaaaaacauuugguuguuuuugauuugaucuaacccuaugcuauccaauacagaagacacuagccauauguggauguuuaaguuaauuaaaaugaaauaacauguaguuuauuagcugcucuagccacauuucaagugcucauuagucacaaguggcuaaugguuacuguauugaacaaucaaacauucuguuguacagcaauggucuaauccauuuuuaaaacaaaaaguuucugugagauacauaaucuuaaauugugcaauguuauauauaccaccauuaauucauucuaaaaauauaaccuaucuuauucaugauccauugaaaaauggaaaaaauagaucuaauaguuuuuuuuuaauuucggauuuaauaucauuugauuuaaaaagauauugucaaauuuaaauaacuuggaaguuucaugcaugcuagaacuuuucacugguucuuaaaccuauuaaucucauuuaaaaauucagcauagagugauccugguauuauacguaagcauuacucuuaaacaugguuuuuaacucuuuucugaaaacauuuucagaugacauuccugaaagcucacucuucucaccaaugccaucagaggaaaaggcugcuuccccucccagaccucugcuuucaaaugccucggcaacuccaguuggcagaaggggccgucuggccaaucuugcugcaacuauuugcuccugggaagaugauguaaaucacucauuugcaaaacaaaacaguguacaagaacagccugguaccgcuuguuuauccaaauuuuccucugcaaguggagcaucugcuaggaucaauagcagcaguguuaagcaggaagcuacauucuguucccaaagggauggcgaugccucuuugaauaaagcccuauccucaagugcugaugaugcgucuuugguuaaugccucaauuuccagcucugugguaagucaguaucauuuuggucuuuggaagccuuuucuuuuuucguuaugagugguauaauacaucuguguguaugugcagguggauggguggauauauguuuuauaauagaugcauagugaguuuauauguauuuguaagauaucgguuucuuagaaagugaaaaucguuaaguuggguacccaucccaagaucaauuagcaguugacagcugaaguuauacuaauuugaugcaaauccagagucuauaauggaaugauagagccucuucuuagucauuaaggagagcacugaaaauuaaguccucuguuauaaugcuuuaaauauauauaugagaaauuuauauaaauuuaucaaauauuucugaaaagauauauaacaaaauaguagcuauaguugccuccaggaaggcaaauugccaaacagggugugauacuuucacuguauauccuuuugaaauguuugaaacuuuuacuuugugcauguguuaccucaacaguuuucaaaaaacaaucuuaaauaaaaaggaaaaauaauuucguguuucugaccauugucuuuuaguguagagcuaggcuuuagaauuagaccugcauugaaucccagcuguacuacauaauuagaaguuuggcuuuggacaaggugcuuaauauugcagggcuuuauuuuucuauguguaaaauaggaaaaaaagguuauuuggagggcuaaauaagagucauaaagcacuuagcauaguaccuggcuauguauaaguaguuaaucuauuaacuaugaaguacaugauacuauuuuguuaaauuuuuauugacuuaauuaaaauguaauuuggucuaauauaguuaaaaauuugauaaagguacuagugcaauaauaugaauaaaacuuuuuuuuuaaauaaagagugaucauacugcuaauacuucauuacccaugaguauauuaugcagacuaacccacauauuaugauuuaaaucauagcauuuuuuaaguugguuuuuuuucccaaaucuuucaaauuuguuugaucuauuagagagcaaaaucauuucauuuucauaaaucuuacauaaaggcuaucaaguaaauaggacuugaauuguuuuguuauaggacuauuuuuagauauugugaauguuguuuacccuaaguguuuucauguuucagaaagcuacuucuccagugaaaucuacuacaucuaucacugaugcuaaaaguugugagggacaaaauccugagcuacuuccaaaaacuccuauuaguccucugaaaacggggguaucgaaaccaauugugaagucaacuuuaucccagacaguuccauccaagggagaauuaaguagagaaauuugucugcaaucucaaucuaaagacaaaucuacgacaccagguuacguauuuauaaaaaauuuaguuauugcugauuauauucaggauaucuauucucagcauuuuaaauauucaauugugaaugguacagcaaugauuugccagggccaaugccugaauguuccaaaugagaccucagcuuuaguugauucaaugaauauuuauuaacguagacuagccuacuuacugguuaaaggacuuaauauguuacauuuuaacaguuuaaacaugcuuuuuccaggaugaucaugcuagauuuuuuuucuauauuuuuugauucagacaaagcauguuuaacuggaaaucacauuuuaggggcauaauggagaaacauucuuguagccaagugugcagagcagugcuucucaaucuugaguaugaaggcaccucuaauagcagagggaagugaaugugcaugcaaaugacuccacuucuaauuuuauuuauuuacuaaauugauaaaugauagaaauuuuugaaaaaauugcuguuuauugauaaauaauagauguauauauuucgggaguacauuugauaacuuaauacauuuauauaauucguaaagaucaaaucaguguaacgaggauauccaucaccuuaaauacuugucuuuaugcuagaaacauuugaauucuucucuuguagcuauuuugaaguauacaauagauuauuguaaacuauagucacccuacugaucuaucaaacacugggucuuuuuucuucugccaaacuguauauuuguacucauuaaucaaccucucuucaucccccaguuauauuuaucuguguguauauugugugugagcauuuacauauaaaacaaaauuucuuaccaucguaaacugauacuccaggaaaugccauauuuaucuuguggugauuuauaccuucuggcacacuuccacguacuguuaauugagaaacacaggacuaaaauauaugguaauugaguuuauucugaacuguauucauuuucauuggaaagacuuuuaauucuaagguuuaacuuuuugaaaauacaaccucugcagaaacuauaguucaucauaaaggggcaguaaacagaaaugagaguggggaagcgguuaugggguagguagaaaucugcaauuuccaguugagccagaaugagaauuggaaacaauagcaagauccccagauggaauaggacuaguuagucccaauuuucuaaagacuuaagcuuagauaagaggcauucuuuuuaauuguucuuggcuacuggauauacccagaaucacauuuccaggguuucagagauauuuauuuuagauacuucauuguauucuuaauggacucuaguuuggaauauggccugaaguaguaauaagugauaggugaaguccucaaauuauggccguggcucaaauucugcccuuugcuuguuuuugcaaauaaaguuuuauuggagcacagccacacccauuuacuuacauauucucugugguugcuuucauucuguaaugcagagcagaauaguugugacagaggccauauggcccacaaagcucaaaauauuuagugccuggcccuuuauaggaaaauauaugcuaaucuuugauauagauaagccuauuuuuuuauaauacaaccuuagaauccucuuaaugggagugauauaggcccaauuugcccuacuuuaaauuuacuucauacuauuucaaugagugcugugggguuuuuuguuuuguuuuguuugcuguuuuuuguuuuugagacagggucucacuuugucacccaggauggagugcagugaguggcaugaucucagcuuacugcagccucgaccucccagauucaagagauccuccugccucagcccaccaaguagcugggacuauaggcaugccacuacaagugguuaauuuuaguauuuuuuauagagaugggauuccuccauguugcccgggcuggucucgaacuccugagcucaagagauccacccgccucggccacccagaguacuaggguuacaggugugagccacugcaccccgcugaauacuauuuuaagacacuguaaagucaagguguccuuuugauaaaaugaauaauuccuaauuuuccuucugaaggaaaaaaaggcaaaauuccuuuauuuucacguuaggcuuccuaaaagcaggguaaaauaaauugacuauagauauauguaaguuguuggaaguuaccauggccagcacacuucgugaugaagguagauuuauuaauauacauacagucaauuucuaauuauuuaaauucugguuguucaguuugagaguuuucuaagcccuacugcccucuccucauucuaccuuuucaaaauuuuuuuuuuuuuuuaaauaacuaaauucuaugaguagguuuuagggcauguacuuaaauagaauaguaaacuuuuuaaaauuuugaaguauuuuuauagucuacuuugugaaugaauauuccugauagaaucaaagcauuuugaagcuguaauguaguuuagaacuuuuuccauagaaaucguaauaauuuuuuauuuugaauagccuccaaaaauguguguguuuucuguaggaggaacaggaauuaagccuuuccuggaacgcuuuggagagcguugucaagaacauagcaaagaaaguccagcucguagcacaccccacagaacccccauuauuacuccaaauacaaaggccauccaagaaagauuauucaagcaagacacaucuucaucuacuacccauuuagcacaacagcucaagcagguaugguguacugcauuuaacauuauucaucacauggucucugcauagaaccuagaaaucaaaauggguucugaugccagucuuuuugacugagauaaguagcaucuugguuuucuguaucacuaauuucagacaagauugggcacauucagggugguauggccguagacaguaucacucaucucaaauuagaaauauuguccugaauuccauguguauuaugaacuuuuuaaacugaaaacuguuuaaacuuuuuaaacaguuuaaaacugcaaacaaggaaaauuuuaguaguguuuggauguuaaacaugcuaccggcucuuguguaaaauacagcuuuugauggguuuaggaacgucaaaaagaacuagcaugucuucguggccgauuugacaagggcaauauauggagugcagaaaaaggcggaaacucaaaaagcaaacaacuagaaaccaaacagguaauguaaacaagaaauauaaaaacgaacuugguccccaaauaguugggaucuaauuuguaguucuguauuggcaaauaauucuuuacacauuuuucuuuuccaauuaacucugucacuuuucguuuauaaaucccuuaaauguguguaccaacucuugcuuuucuugugauauuuuucuauuucaguggaacucuucaccauauucauugaugaccuuaaaaucaaauuuuacaaaaauuauuuucaucauucauuugauuucagagucuacuuaauauuccacuuagauggugguucuaaaauauuucgagagucuacuuuucucaaugaugacuguauaccuuuccccagauaccaugucuuuagacuaucugggauccuuucagucaccacauaccucccacauugcucuuuauuccggucaaaguucauuaaucagccuucaacaaaaucucuacaauguaagcuguguucuguuuaauuuacaugucuacaaaguacuguguuaggauauguuuuuaagcuaauagaauuauauuuacaguggggacuaauagaaaguaaaauaacaguaaauuuaaucaguauucuuugagaaagaucuacuugauugauuuguuuuuuaucaguucacuugcuuaacaaaucacauuucccagaguucugaucucaaccuuuuuuucucaguugcucuggaacaucucuucccuguccacauaccuagauuccgauaaucacugaaaugcugaugaugcucagcuccguugugcugauaucucuccugagcucuaggugugguuggcuagcaaagccugcuaugcuuugcuguaguaucuuccccuuguagucucugucuucucuuguugguuugcucuauaccuugucaucuaaaacaaucuggaaguucuuccuugacuucuuccucuuguuuacugugucuucccuucugcuugccccuagcacacauaugcauaaacacacacgugcagugauaaguuuucuaaaucugucacccaccugccucgucuuccauauuuuccucugcuauuaccgaaguuacugcuguagcuuuguacugaacauccugcuucuagucucgcuacccuccaguccaccuuaucaguugcugccagagaaauauauauauauauauauauauuuuuuuuuuuuuuuuuugacauggaguuucacucuuauugcccaggcuggagugcaauggcacgaucuuggcuuacugcaaccuccaccucccggcuucaagcgauucuccugccucagccuccuaaguagcugggauuacaggcaugcgccaccacacuuggcuaauuuuguauuuuuaguagagauggaguuucuccauguuggucaggcuggucucgaacucgugaccucaggugauccgcccgccucagccucucaaagugcagggauuacaggugugagccaccacacccagccgagaaauauuuuuaaaagacgcauauucauguauucacuugcuuaaaaucuugaagugcuccucauagucaucaucagaaaaaaugcguaaacugcuuggcuugacauauagaaugauuccucaccuggcuccuccccacugcuccuccacagguaugcuucaguccugccaugcaggcuauuugcaguuucucaaauauacccauguuuuuauaucucucugccuuugccuucuguucucugccaggaauauuucccuggugagcuccuacuucauuaagaauaggucaaacuuuaauccccucuaggaauucuuccuuuucucaaagugucccacuuuuuuucacccaugucauccuguguauaccucaacuagaauauuuaucuuccugugaauguuguaaguuugcauuccaccacugccuaugggagucuucuccaccucuguguccuuagugccuggcucagacuaggggcucaacaaacuuguauuugaaggaagaaaugcguuugcugauccuucccaucagcauauaacaagcuauuaucugccaucugaaaaaaaaaacaacucuugcaacccauuccccuccuuuucuuugccuccaugucaugcagacucuucuacaaguuauuccuacuugcugcuuucagguuucccccuucucuuuagaauucuaucugcuuaagcuuugccaccacuccuuccacgacucaguauccuaaucacguuugucagugaucuucaccuacuaaucaauuuucaguugauuaguagcauuugacauugucgaucacucuucuguugggagcgccuucuuuacuugguugccaguguaucauauucucauggcuuucugccagugucucuagaaaguauagagcaggguucuuaaacuauuuuguacuaaauaauucccaauaaaccugugaaauuccucccagaaaguugcacauaugcauguaaacaaaauucugaacacaguaacagugcagagcacucaucuguggucuccacagacuaagcagccaaagagcuaggaggaaaauguaguugaaggcagugucuuuaaagucaaggggcucggcgugguggcucccgccuguaaucccagcacuuuaggagacugaggcagguggaucacuugaagucaggaguuugagaccaaccuggccaacauggugaaacccuaucuguacuaaaaauacaaaaaaaauuagccaggccugguggcgggugccuguaaucucagcuacucaggaggcugaggcgggagaaucucuugaaccugggagucggagguugcagugagccgagaucgcaccacugcacuccagucugggcaauggagugagacuccgucucaaaaaaaaaaaaggaaauaaagucaagggaagaaagaaaacuuucgagaaggaaggcaugguugguauuguuacguuucaaauguggguuaagccaaaucuacuggguuuugaagcaagaaguuugcuguaacguggcaagagcaguguuagugaagaggugaggguggcgugcagguggugcugugucgaggagggaacgggcaagaggagcagagccagugagugcaggcauuucuuaguuugguccuaauggaggugauaaaggagguaguggcuagaagagaugaagaaaaguaugauuuguauguguuuuguccuuucugagaccuaagucaauuugugugaugggauaaggggugauaauugaugggaugaggugagaauggaugaacuccgcacagugaagggaacagaacugaugaggacaaucuccugugugacgaaaaggaaggaggaaaguagcauguaggggugaugguagucuuagaguuaggauagcaaaaacugauggacuuucuucugaaagcuccuguuuuauucauccuuaggaaagggaaggugacaggggaaauacuguauggaggaaagaagagagagcugacucagacauaggaagaauaggggguaguauugaggcuuagaugagauaugagaccguagauuuuauaguggaaccauuugaucguuuacuuugcuuuuuguguuuuuaaaaaauuuuuauguauuuuuuaauccacucaucugcaugcuaauuacauuguuuuuacacaaccaaagcugcuucuaacuugagagacaauaaagucuggaacuagaccuggaacaagaguaccuggguuuguauacuggcucugccagucacuaacugugugcaagauacuuaacuuuuuugugucucaguucucucaucuguaaaauggagauacuaguaccuaacauagaggguuauugagaagauuaggugaggcaauagauauaaggugcuuagaaagguggcuggcacauauugagcucuguauaaguauuagcugccuuuauuuuacucuuauuugauuauuucuacuaugacuucauucauaaagucuucuuuuauuucuuugcugaaauaaucuguacaacaauauaaagucuuuaaacauacaaaauagugaauguuccucuuaaauaaccuugcuaaugaauaaaaagacucagacgagggaauguuuucuucucuucucuucuuuccuuaccuucugaucuguuuuguccuuguuuucucuugcucuuacccuccggguaacugauaauuaaauggaauccugauguguaggagcugucaccagauguuauagguguggguugagauaagugacauagggguggguguuuuucccuuuguguggcuuucacuuuguuuuuuuauuguuauuuuauuuuauuuuauuuuauuuuauucuaccaaauacccagacuucaaggagaggcuuucacuuugauuggcuuaucuaaaacugagcccugauaugaauuuucauucuuucuugccaccuccucuccaaaaaaauuuuuacauacugagaauuaccaagaaugugaacuagcacugaggguuugucguguucugaacaaggcugggccuauucacauacacuaucucuuugguucuaaggaaacuuauacagaauaauauuuaauaauaaucuuguuucauuuaauaacauagaaagauaaaauauauaguuuugagaaauaaaauuuacuuuucauucgcuuuuugcaggaaacucacugucagagcacuccccucaaaaaacaccaagguguuucaaaaacucagucacuuccaguaacagaaaaggugaccgaaaaccagauaccagccaaaaauucuaguacagaaccuaaaggucaguguuuccagauuguucaugguuaguauguagaaacucaaaugauguuuguguguugauuuuguauucuguaacuuugcuggauuuguuuguucuaacguuuuuuggggggaaucuuuaggguuuucuuucuuuuuucacuuuucuuugagauggauucuugcccuguugcccaugcuggagugcaauggugugaucucuuggcucacugcaacccucaccucccggguucaaacgauuuuccugccucagccucccgaguagcugggauuacaggcgccugccaccaugcccagcuaauuuuuguauuuuuaguagagaugggguuucaccauguuggccaagcuguucucaaacuccugaccucgugaucugcuugccuuggccucccaaaguacugggauuacaggggucagccacugcgcccagcccaggguuuucuacauguaagauccugugaucugugaauagagauaauuuuacuccuuuucuaauucaggugccuuuuauuuucuuauauaauugcucuggcuaggacuuucaaugcuguguugaauagaagucauuaaaacaggcaucuuugucuuguuccucaucuuaaaggaaaagcuuuuaauccuucacuguugaguguaauguuagcugagggcuuuucauauauggccuuuguuacguuguguaccuuccuucuauuccuaguuuuugaguaauuuuauuggcacuuuguuuuuaaaguaaaaaacaaauugcagaguagugguauguaugguaugaucacaaaacaaaacaaaaugauauguaaauaugcacaccuugggggaaacuggaaaaacaaacaauaaccugguaauauugcugucccauuucucucucggugggggaaaaguuaaugcauuuaugccuaguguuccauuauuggaacgcuaagcuuaugggaguuacuuauguccuccugcucaagguugucaccaagaacugauuuuucacaaaauaaauuugcaaccuccagcauaaauggguuaagagaggacagguguucagggagggguguuucuauacauuucuggguuuggauauuuuaaaacgaauacauaguuuuauaaucagaaaaaaaaaacacacacaagauuccauaauuagaaaauuauagguucuuauauauauuaauauggucuuucuuaaacauuuuuagguuucacugaaugcgaaaugacgaaaucuagcccuuugaaaauaacauuguuuuuagaagaggacaaauccuuaaaaguaacaucagacccaaagguugagcagaaaauugguugguuuuuauucuuuauuuauuauuaacuuugcacauacuauaggaaauaauauauugauagaagcacauauucaaauugagaguaucucugcuuuuuaaauuaaaucagaauacacuguagcuucuaccaagaugugguacuguuaacaguuacugcuagcucacaggcaccugugaaagugugguuaagacccucacugacuuugacagggauaggaaaguugcugcccucccacgcucuguacugguagagggguguuucagggaaaaacucucugggauuauguuuuccucuguuuucauaccaccacaacaaucaucaacacagaagacuuuugugaccaguucaauucaauucaauucugacacuagcuacauggaaguagugucagaucccacagguuggggacucaguccccaagacugccuccucuccuucagauaccaguugcaagugcaaguccaggccucucaaacuuccuuuuuuuuuuuuuuuuuuuuuuugagacagucucacucugucgcccagacuagagugcaguggcacgaucuuggcucacugcaaccuccaccucccagguucaagcgauucuucugccucagccuccugaguagcugggacuacaggcgcugcccccacacccagcuaauuuuuguauuuuuaguagagaggggguuucaccauauuggccaggcuggucuggaacuccugaccucgugaucugccugccuuggccucccaaagugcugggauuacaggcgugagccaccauaccuggcccagggcucucaaacuucuaaccgaccagcuucaagcugagguuucugugacccccucuuuagcuuggauuaauuggcucacagaacucugggaaauacuuacguuuacugcuuuauuuuaaaggauaugggugagguauacggaaaggggcauggagcuuccauugccuucccuggggcgccacccuccaggaaccuccacguguucaguuauccagaagcucccugaacccaguucucuuggguuucaguggaagcuucauaaagucagcauucccucccccaggguaugaggcuggauccucucuggugaggggugaggugggugugggggucgucuuaagaaccacaaugagaaagauaggagaagauuagaguccugccguggggcaggugaaaggauggcaggagaguucuguuuccugugaggccuaaugcacccaacauuauaacgaaagacaguaacuagggauacagcaguuaugagcuaggaacuguggacgaaaaccaguauauaucauaauaccacaagguguuagcagccccugaagguuauuaucgaacccugcccuaagugacauuaauauuuuccuauuauugacugcugugugaaaggguagcucucaacgauagaaaaagucauuugagagaauauuuuuugaaagucugaagucuuuggcuauuauucuacauuugaguucuuaaugcuuuuacuuaaacccaagguauugaaucaguuuugauagacccaauauucauuucuuuuucuuuuucuuuuuucuuuuuuuuuuuugucucagacagaguuucacucuugucccccaggcuagagcgcaauggcacaaucugggcucacugcaaccucugccuccuggguucaagugauucuccugccucagccuccugaguagcugggauuacaggcaccuaucaccacgccuggcuaauuuuuuuuguauuuuuaguagagacugggcuuugccauguuggccagacuugucuugaacuccugaccucaguugaucugcccaccuuggccucccaaagugcugggauuaccaauauucauuucuuagaaaguguuauugaagcugaagauuuucuugguuucauuuauuaguaguauuuucuuauuuuucuuuuuaggaggugcuuuuuuuuaaggcauuuuuuccuauuuaguaagaauaugaauauuaaauuuucuuuguuaugccuuuaauucuuaaauaucugagucacaguguccaccuauugaaauauuuuucagaagugauacgugaaauugagaugaguguggaugaugaugauaucaauaguucgaaaguaauuaaugaccucuucagugauguccuagaggaaggugaacuagauauggagaagagccaagaggagauggaucaagcauuagcagaaagcagcgaagaacaggaagaugcacugaauaucuccucaaugucuuuacuugcaccauuggcacaaacaguuggugugguaaguccagagguaagaaaaggcuaacuaaacaggcccaggacauaaguaaacuaaguaguauucguaucuccccuuucuuuuguugacagauggacauuuggcucaguagccaagggaauuuugcagaccuguugucuguucucuuaaaagaaaccuuaaaacucuugagugguuuccuuuugaccuuagaugaaauccaaagaguaacauggcuuaaaaggccaggcauuugggcucagcuuuugacucugccauuugcugacuguuuauuggucagguuauuuaagcucucuaugccaccauuuccucuuauguuaaacgagguuauuaauaauaccuauauaguggaguugaugugaacauuguuguauuaguauaucgguaguuagcuccaaacacauguaacuaacauuuaguuacagcuaacugcuguuauuagcuuucacccucaauugaauaacugcagcucuggggauugauucaacuagaauuuuuuuuuugaaguauaaguuucagcugucuuuguaguuuuauuuauucuuuuauguguuaggaacuuaguuugcuuuguuuuuaugaugaaucaaucagcuuacuggauuuuuuucuuaauauuaauggagaauucauugauuuucacagaauaaaaugaauuaucauuuaggaucaauguuaauaucugaugcguuuucccacagaguuuaguguccacaccuagacuggaauugaaagacaccagcagaagugaugaaaguccaaaaccaggaaaauuccaaagaacucgugucccucgagcugaaucuggugauagccuugguucugaagaucgugaucuucuuuacagguaagaacauuucuggaaggcauucacucacuaagggucaugguuuagauugacauaagucguguuauaauuuguaauuauaauguuauuaauaacucaucuguauaaaaguuuggaauaacuuuuguuagccucucuuucaccaaaugagaguuccauucuguugugaaauguucugcugacauguucaauaucagugucaaauucugcugauauguucaauaaaggauagugcucaguguguugcuggauuucuaauagaguguaacuuaccucuugaagcauugaugcauauagaucucaaagauucaaagaaacagaacguccaucaauaaagcaggugauuguucggaaggaagauguuacuucaaaacuggaugaaaaaaauaaugccuuuccuugucaaguuaauaucaaacagaaaaugcagguauguacuuuuguggaaaggggcuuuggaauguuucuugcacuaggcugugagcucugugaggacaaagggcccagccuuacuuaucucugaacccugaguggccagaauagugucugaugcauagaagcucaguaaaucacauuugaauucaguuuauuuuuggaaagguacucuuuuugaaaacuuggaaacucauuugauauugcugaaauauuuauuuuuaaacaaguuuuucauaaauauccuuaaaguauaacuauuaauuggauaaugauguagugggaaauuuguuaugcucuucaagguuuuuucaugcuaaggaagcuuuuuuuuuuugagacagcauuuugcucuuuguugcccaaguuagauuguaauggcgcaaucuuggcugacugcaaccucugccucccggguucaagcaauucuccugccucagccucccaaguagcugagauuacaggcaugcaccaccacaccuggcuaauuuuuauauuuuuaguagagaugggguuucacuauguuggucaggcuagucucaaacucuugaacucaggugacccacccaccucagccucccaaagugcuaggauuacaggcaugagccaccaugccuggcuuuuaaaaaaaauauuuuaauuauaaaaaaaaauagagauggagucucacuauguuuucuaggcugaucucacacuccugggcucaaaugauucuugugccuuggacucccaaagugcugggauuacgggugugagccaccaugccuggcccuaaggaagcauauuaaaaaaaaacaguguaauuguaauuuaaauaaaaugaaucagauacuuucuaaauuucuacguuguuggauguaaccccaauuuuaacuuuaauaaguaugaauuggaaguuuuuucauaaggaauaauauuuauagcuuaauuauuguaacaugcuaaauguuuuuggugcauagucgagaaacuugagcagugaaacuaacauuuugacuuucaucuggaaauucuagaaacuauccaaucaaguuaguuagaauuaaaauuuaaagugaaaaugaugauuuaaaauguguauauuuuuucuccucucauugguuuuccuaggaacucaauaacgaaauaaauaugcaacagacagugaucuaucaagcuagccaggcucuuaacugcuguguugaugaagaacauggaaaagggucccuagaagaagcugaagcagaaagacuucuucuaauugcaaguaagugugaugcaccugaaagaguuccaacaaauuucuaaccagggaaaacucauuuugauauuuagaaaucuuuaaguuuagagaaagggcuuuuccuagucaucuguuccaguggaucuauuuuuuguucuuguuuuuauaagguuuaagaacucuauguaaaacaaauuguaguuugcaugaaagguagaagcaaccgaaaggcauuugaagaaaugcaguugugcagauugaaugaaugaauggaugaaugaaugaaucucuauauauacacauguacacauacauucucucucucucucucucucucucccuuccuucccuuaucaauaaauagcuaaaacaacuucugugaauuuugcugugugcguauauguggugaugauggggcauuuugggguggacagaugauaccacacaugaaaacuagccgaaaguugauguauuaaauuauaaggacuugguaaaugagcaaccaagguuuuccccaaccaccuaccauguuuuauaaagauaguguuacugauuucgucuucgcuguuacguacaguuuccauaucaguacacuuuuuugaauuugcucucauuagaaacaguuacgauuuuaauauuuggaauauugcguuguuuuacauagcugggaagagaacacuuuugauugaugaauugaauaaauugaagaacgaaggaccucagaggaagaauaaggcuaguccccaaagugaauuuaugccauccaaaggaucaguuacuuugucagaaauccgcuugccucuaaaagcagauuuugucugcaguacgguucagaaaccagguaugguggugauuuuucuagauuguguguuaaauuaugaaccucaccuagauugaauuguacagaauagaaacaaguaaaucaugcauaacaaugcaaaguuuguaucuuuggccuuuagguccuuuuauugagauauaauaaaaauaagaaaacuucagauauauauagggauaccaaucuacacaauaauggacauugcucuuacugaaaguuugaauauaaaguuuuauuaaauguuggauaugguuuuuaaaguuccuuuuaaaauuuuauuuguguggaacacaaauuuuuuuguguguguucuggaauaccaaagaaauaaaggaauacugaacugauuuauacacaauuuauuuuaaaaaauuucuuuuugaggggaaggagggcuagacauaggugagaagcaaauuucaggcauagggaaaguaaauggagguugugaaagguuugagcacuuuuguaggaauaagguaauuuagguucuaauucuugauguuaucugauuuugauggggugugggcagaaauuuauugguaauuuaguaugcgucuggagguacgugguuauuaaugacaaauggugaagaaauaguuuauguuuuuauuaucauuuaucucugaguaacuuuuauagaaauacaguauuuuaauuucaguuuugaaauaacaaaccauaauuuacccuuuugagauauguacuauuaguuaagaauuaagggucacuagguaaaauucaaaaucagcagaaauugagaaauguggagugaaauuauuucaauuuacauaacagggagagaccuugaugaugcuuauuucaggauuauacugccuacuuaagucuuauuuagcuuuuugugucuggaaaguugauuuuaguaauuuuaaaaauaaauuguauauaaaucaguucaauauuccuuuauuucuuugguauuccagaaugcugauuagcuaaaucugauuuugcuugugcuuacuauguaauaugauuacuucuuacagaugcagcaaauuacuauuacuuaauuauacuaaaagcaggagcugaaaauaugguagccacaccauuagcaaguacuucaaacucucuuaacggugaugcucugacauucacuacuacauuuacucuguaaguaaaucaggcuuuugaugauucgaaugcauuuuucuuuuuguagaguugauacagucuaaagcauucagguggcauuuauaaucuuugaaacgccuuaugcacauucuuuuuauauugacaaauaacccaucuuucaauuuguugcuuuaacucauauguuucuauccuuccuuuuguugaauagcaccuuuuuuccacaugacuguagguauuacauauuuugaaaugauauauacauuaaaccuggaccauagauuuuuaacauaugccuuaaaucucauaauguacuuaacauucagucuuaaugaaaauacguuuauauuuagugaaacauuuauuuuuaaauaagagucaaagugcaguuugaaaaauaauuacuacuuuuauuauugaagauugugaguuguaaaacacggaggaaaauauuuuggacuugcauuauagggaaaaaauagacuucuuaacaauuuuuauugacuuuaaagucauaguggauuccuuuacuuagagucuuguaagaguauuuguagcaucauuuuuaauggugugauugagguuuucucucaagguuuuacuuaaugcuuuauuuuuccaggcaagauguauccaaugacuuugaaauaaauauugaaguuuacagcuugguaagcugauaaagccuucuaaaauaaugaagaguauauuuuucuuaacaauaucagauuauaaauuaauuaugcuuuggguuugugcguaggugcaaaagaaagaucccucaggccuugauaagaagaaaaaaacauccaaguccaaggugagaauuaaagaaacccaguaaaaauauuuucaucagaaguaauagauaucaucauaccaguuuuaauuuauguacaacuuuuaaugauuaggaaguuuuuggaucaguuucauguuccaauuuguaguuacuauguuaaauagguaugaauacugaaaauaaacugugagugaucaugauugucaguauaaguuccugauacacucgggcuagauaauucuauuuucucuacauuuacuuggcaacuuuuauaacugcuuaaaacuuuucucaagacuuuucccugagcccucuucucucuguguucucuauaccaguacuuaauaauuauguggucacuuugcaggcauaagguugcuuuccagccuucccagucuguguucuuuucuuaagucaucauuuuaaaaacuuuuuuuuuuuagcucuaacaaaaaaggacuaacaguauaagaaagccuuaaucagggacucaaguguaauguuuucauauuuaagaauuaauuacucaaggacucauguguaauguauucauauuuaagaacucauucuuuuuuuuuuuuuuuuuuugagacggagucucgcucuguugcccagacuggagugcaguggcgugaucucagcccacugcaaccuccaccucccagguucaagcgauucuccugccucagccuccugugaagcugggacuacaggugugugccaccacaucugacuaauuuuuuguauuuuuagcagagaggggguuucaccauguuagcaaggguggucucaaucucuugaccucaugauccgcccgccucagccucccaaagugaugggauuacaggcgugagccacugcucccggcuaagaauuaauuauuuucuauguaggaauuucucaagguuggauaguuuuacuuucugagacauaauguuuaauaagaaauauauauaguaagcuaucuuuucuuuuaggcuauuacuccaaagcgacuccucacaucuauaaccacaguaaguagaauuuuugagaaauugagcuuccuugagaaaucuucaucuuacccauacaguuuuaaauugguuaaccauuucugaaccuugagcacuguggaaaauuuuaacauguacuaauggggggauaucccuguaauuuauguaggaaaaguguuuucugaaauguauuucuuauuguguuaaaagagaugagugauucauauuuaaaucuuuguauuaaauaagggaaauaacuuauguuucuucuucacaccuuuuuuuuuuuuuuuagaaaagcaacauucauucuucaggugaguguaucuugaacuauuugaaacuuuagaauaagguaaggaauuaagcacuugcauauuuacauauauauaggccaucuugauuugugaauguuuaccuugaucuccuuuggaauaauauuuucuaugugaguuucuuaguaacaggauuacuggccagaguaggaugcaguuugguugcaccuuuguuagguaccaccauagaggcaccagucaucauguuauucagcucuagcagcagguggcauuacucuuuacuucaacuucuauuguucuauagauuuguuuugugcuuuccauacugcagauuuuacuucuuuuagcuuuacugaucauaacuggcguuguaucaugucagaaaugcaucuuucuaguucacugggaacuggaaugcuguuaagccaggaaaggccuucuuuagaaugacuuuaggccuaucuuuuuccaaaaggaauuaggauggagcugguuucacucacuuccuuuaggcuauuggucucuuucuucucuguggugcaagagaguuacuaagagaccuguacagagauaguuucugcugcugauuuugucacccugcauuauaacuagcacugaagucuuuuccauguuuuuuaucgggaaguugcuuuuuaugcauacauuuuuaggucuauaucuuuaaaaacacauccaucccaauuauuaaggagugcuuguaccucuuucauuaggaaauaaguugauuuuuccccccacauuuaaagaugaaggaaaaugaggcaguuuuuuuuucucuguggcagcuuaauuuucuucuacugggauggggugaggaauuguuacuuauacuuaacaaaagucauucugaacuaaacuuaauuuccucguucuucacagucauggccaguccaggaggucuuagugcugugcgaaccagcaacuucgcccuuguuggaucuuacacauuaucauugucuucaguaggaaauacuaaguuuguucuggacaagguaauccaacuuuauuucuaagggugugguguuuuuuuuuuaaucuuagaaaaauuagcucaauggaaaugccacaaugcuuuuagguauuugaaaucuucgacugaaaacauauguucuuagaauugcacauuuuugcuagguaugaguguaccuaaauguuuuuuuuuuuuuuugucuuggaaguaugucucccuuuuaauaguuagaacuucaguggaugcuugcuuauucuaaguaucacuucugacuaaagaaguauuacuuccugcauuuagauguuaaguuuauaauuuuaaaacauaauaucuugccuauuuccauuucuuugugguuuuuuuuguuuuuuuguuuuuuuguuuuugagacagggucucacucugucaccuagguuggagugcauggcucacugaagccucagccucgcgggcucccaccuuagccuuccaaguagcugggacuacaggcacgugaugccacgccuggcuaauuuuuacuauuguuuuguagagaugggguuucaucguguuggcuaggcuggucucgaacuccugggcucuggccaucugucugccuuggccucccaaagugcugggauuauaggugugagccaccuugcccggccagccuauuugaaccuauauuuugaaaugaacaauauuuuaugaauuuaguuuugacaagacagugaaagguagauuaaccucuuagaaaaguacuuacgaaucuaagagauuuccuucucauacuucccuuucauauuagaagcuucaaaaaucagaucuguguuaacaucacuauugagucuuuuuuucaccaagacuauuuuaaggaguaagacaacuagaggcaaauuuuauuucuuggguugacuucuauauaauacagugauaauuuauauuaucaugugagauuucuguagugcgaauauagagaugaagaaguguaaaaauuagaagcccugguuucuaguauuuacccuuagugauuuacucuuuaacauugagcaaagucaccucaucucucuagggucuuguuuuccaguacagaaauauuaguuuagccugaaacaaucuaaaauucuaugaaaugcuuucuuuuaguugauggacaaaaagcagacuguauuugaaguuuugauuacuauuaaugcaugaauguguuuuaacaaguuaauuuuaaaaauuuuuguaacuuuuuauuuaguaauucagcuacuuuaaccaguugagugauccugggucuuuuuuucucugucucuuauuuugucuguuuuagauaaauuaugauguaagagagcgagagcuacugggcuauuuguuccaggaaaagguugccauuauuuucuuugcuugaaauuaaugagcuuaaaaaucaauccuuaauuuuugaucuacauauauuuguuuuacuaacuaucuuuuuguuuacuuugaauaauuaaggacauuauguacauuauucuaucaugagacucuuauagaugggugucuuuuucuccacucucaauacuuuaaaaccuucuuugaaaguuuucuauuuuuucaaugcauguuugguguuugggucuuuuuccauauucuuucuucucucuuauaguucauuauaauccuauauucacaucaauauugauuuuucuagguacaauuagaauaccaauuaguaacuauauuuaaaacuaaaaauuauucaauauuuuugaccuguauacuggaagagcuauuggugauguuuuaaauaaaagcagauuuuuuuuuuuuuuuuuuuugagacggaguuuugcucugucacccaggcuggagugcaguggcgugaucguggcucacugcaaccucugccuccuggguucaagcgauucuccugccucagcgucccaaguagcugggacuacaggugcaugcaaccacaucuggcuaguuuuuguauuuuuaguagaggcaggguuucaccauauuggccaggcuggucucgugcuccugaccucaagugaucagcccuccuuggccucccaaagugcugggauuacaggugugaacacugugccuggccaaaaguagaaaauuuuuauggucuuaauuggcuaauagguauauugcuagauagaugacccuuugcuuguuaauuuugaaauuauaauacauuuagcacugaaauuauacugaauauaauaauauauuuuggaagacuuuuuaaaguuuuuuuuuuguuuugagauagagucucacucugucacccaagcuggagugcaguggcacgaucucggcucacuacagccuccaucucccagguucaagcaauucucaugccucagccuccugaguagcugggauuacaggcgugcaccaccaugcccagauaauuuuuguauuuuuaguagagacaggguuucaccauguuacccaggcuagucuugaacucccaaccucaggcgaucugcucgccuuggucucacaaagugcugggauuacaggagugagccacugcgcccaucuaaagauuuuuaauauuuuuguaaaggucaguuacaaacauucucuugguuaaagagaugcuaauuaacaaaaugcuggaugguauuuuuuauuuuauuuuaaauucuuaaaauaggauuugcaaauuagauaaccauaagaauugggauuuuacgaacuguguuuuuuacucaguauugucacauagccaguuucuacauauguaagagauuucauuaaucucuaaaaugaaagagauuucaaugacauaucuuaaauauagacuguucuuuuaaaaacuuuuuuuggcugccauuuugaaucaaaaugucacauuuacaaauuaaaauuaaauuauauucccauucacuuaacuccuuugaauuuauaacuuaaauagccaaccacaugauugagugcaaaaucaaaccacucaguuuaauuuguugugucuuuuacucuugagacuccuucucagucagauacaguacgauuuagaaguaaaaucuggaacaaauuuugugcuuuucugagugaggaggggaagcaaauauuuguuccaauugccuggguuugauguaggagaauaucuaaaauaguuaaguuugaauggucuugaaguuggugggaaaaauuuaaggccuucuacacucauguaauaauccuauuuaauugucacugaaagaguauacaugucuuuccugccuugucagauacugucaguacaacgcagucuugguuuauuuuacuggugccuugaccaguaauacaacaaucacagagguuaucugugagguccuuccagaguggaauuucuguugagguuaauccaguugguuugcucugcggauuuaggacaccacugucaguggauuuccauuuuauuugaggcuauucagaucugauuuaaagccuggcauccuggaauuuaaauuacaaaucuuagugagucagacuuucaaacccuuucuuugaauagggaauccaaaacagucauaguuuuauuauacuauuauagauaaagggagaaggaugucccaaaguuccucuucugacuuaaaggaaccucauagguauuuauaccuuuuaggaaauagaaaugucaauuuaaauauuauuagagcaaacaauuuugaaguaaaacaaccaauuaggauuauacaguuuugggauugaagaaaaugguuaggcauucugguaugcccugaacuauccaguuuauaccuguuggccuuguguaauuauuaauggugccccuuucacccucaaaaauaucccagcauauaacacauuacacagucucccugguuguagguuauauuuuacagcucuuaacauaaucuuugaaguguggaugucuuaaaagacuccuuuguuaaacacaaaacagaauaggaucauacauuuucacacaagucucccuccacacucaacuagggggagggguaguaaacuugacguuuuugugaauauuuucaauuuacuucuuuaucaggacaagcuucuaaccaaaaauauugucuacuuuuccucagcuacagaguaagagggcacauuuucuucucauuguucugauuuuuguuaucaguagcaugcucugugcuaaacaauggaauucuguuaaauaccauugagaggaaagagccuaaggaacuuaaaacucacuguaaggaaaagcaaaaagggaauuuuuacaaaauaggaugaugaggcauaugauguuuugguucugcauuguggaucgguuucaaauuugggcaguuggagguucaucucaugaaauuagucuacugaaauuuauacuuuuugucuuagaauucccccuuuaaguuaucuuugcuauguuagagggucaaaucauuggaaacuaauuauacuaaaaacucaaauuuagacuuaacuaagauuaauccaguugggaugccauucuuuuucccugggcaauagaaaugacagacacuuccaucuuccuuucuaucuugacucagaagucaauguuacuuuagauaucugucuaucuaucuaucuaucauauauauauguguguauauauguguguguuuguguguguguguguguguguguguguguguguguguauauauauauauauauauaauauauauauauauauuaccauuuuauucuugauuucagggacaaaucauugauggaaccaauccaggccuuguauaaccaaaagacuagcaguuggcguuuaucuuuucccuucaaggcuuggguguuagcagcuuuauagauaagggcaguucugaucauaaacccacuuaccuuuacacaaaacaggaguuagccuaucccuucugccuuaaauucugguucucacuuccuugcuaauaaaugucccuuguggcuuucuuuuuucccccccagaauagggcacuuuuaucugaauuaaaaauuuguucagguugggcacuguagcucauaccuacaaucccaacacuuugggaggccaaagugggaggaucguuuaaagccagaaguucaauaccagccugagcaacauagaugaugaaaacaguuuuuuuucaucaaagaauaaaaaaauauuagcuggguguggugguacacaccuguagcccuagcuauucagaaggcugagaugggggaauugcuugagcccagaaguucagaaguucaaggcugcagugagcuaugaucacgccacugcacuucagccugagugacagagugagaccuuguuuuggaaaacaauaacaaaaaacaaacuuguucaggcagauauccuuuuucuucacugauuuucuuaauggugucugggaacucaucuccugucucauuugguagaagcugcuucuucuguuguaucuugacauuuuuaaagccucuuucuaaaauuaucaaaccauccuuugcuggcauuaaauauucaaguugaagauccuucaccuuccuuuaauccuauauuagagucuauaggugugucuuucuuauagcaauccugcacucacauaaaaacuguauuuucaauauaagaucaaaauguauuucacaaaaaaugcaucuuuauauuuguuuacauuucuccugacugaauggugccauguacagucuguguaaguuauagaaaacguuugccaacucguagucuaccauuuuguuauuuguuuucuauuuguuucgucuguucuuuacugcuuuguuuucccuuuccugccuucuucuggauuaauugaguauuuugguaauccuuuuuaaucuccucuuuuggauuuuuuagcuauacuuaccuguuuuuguuuuuguuuuuuaaggcguugguaggaaauaauguaugcauccuuaccuuauuaaagucuauuuugaaauacuguuacacugcuucauguaacuuacaauaugaaccucacaacaguauaguucauuuucccaucccaguauauuuuacuucuuuguuauaaaccacacaaugcacuguuguuacuuuuucuuuaaucaguuuuuuucuuuuuuaagagauggggucuugcuauguuuuccaggcuggccgugaacuccugggcucaagccauccaccugccuugccucccaaaaugcugggguuacaguugugaacuacugugcccagccucuugaaucaauuuuuaaaagaaacuuuuauauuuuuauaaacugguccuuauauuuaccauuucugguguucuuccuucuuguagauugagaauuccaucugaagucauuguccugucaagaagaacugucuuuauuauuucuuguaauauaguucugcuggaaaugaaaucucuagguuuuguuuguccagaaauauuuuuauauugccuuaauuucugaaggauauugucacugggacugcuaaauugacagguuuuuaucuuuucaauucuuuaaaguuguuaauuuauuguuuauggcuuuaauuguuucuaauaagaagucagccagccaucauucuuuucuguuuuuuuauuuugcauuuuuaacgguuugauuuuaaugugccuacguguaguuuucuuuguauuuauccuguuugguuucacugagcuuuaugaucuguaauuaguuguuuuauaagucuuagcaaauacucagccauugucucuuaaaguuauuucuucugcccugcucucuccuuucugaaacuccaguuaauguagacuauugacuauuuuucuacaggucugugacauucuuuuugguuuucauuuaauucuuuuuuucuuugugcuucauuuuugaugguuucuauuuaucaguucuucaaguucaccuguuuuuuucuugaugugaucuaggcuuugaagccuagccaaugcauuuuuaaauucagacuuuuuuuuaguucugaaauuuucauuuggauuuuuuuuaugguuucaauuucucugcugaaguucuccauuuucucacuaauuuuucuccaucuuuucaucuaaauauuuuaauguuguauaaauguuuuuguuuucuaauucuaacguuuagaucaucuguggaucugcuauugacaggauuuuuuuccccuugauaagcuccguguuuuccuacuuuuucacaugucuuguaauuuuuuaacuguaggccagauauuauauuauaaaagaacaguagagacugaaauagguaauaccuuguucuuuugucuuucagacaguauagauuagggacuggucucuuauguaaucagaaacagcugaaauuaggcuauggauagauuugguucaaguuuuguuuuaaaugcuuugagaaugguuucaggccccacuuuugagcagaacuuugagaucuaaguacugcacgucuacaagauuucucucugcuuuuuagacaugucuucaaccaucacuucucagcaaaauuccuguuggggagaauuggcagguagggagagcuagcucugccucugcuucuugagaugccugucuaccucagccugggcucaaccauugaaggcucaacugguuucuccuuuucccugcaaaauuuguugcuuauggcaagguugcuccucugcuaaguugcuaagaauauuuucuuacauguuuagguuccuuuucuuuaaaaauacuucuuuuuggccaggcacaguggcucaugccuguaaucccagcacuuugggaggccgaggcggcuggaucacuugaggucaggagcucaagaccugccuggucaacaugaugaaaccccaucucuauuaaaaauacaaaaauuagccagguguaguggugcaugccuguaaccccaggauuacaggagaggcugaggcacgagaauugcuugaaccugggaggcggagguugcagugagccaagauugugccacugcagccuggguaacagaaugagacucugucucaaaaacaaaacaaaacaaaacacuuguuuuuguuguguaaauggacaugcaugaaaaaucaccuauagcaacagaaagcguaucauugguuuccuggagaugggaauacauggaggcaggauuaugggagggagcuuuagagggugauggaaauguucauuauuaugauuguggucaagguuucauggguuauaauauacauauaucaaaauucaucaaacccuacacuuuaaauauguucaauuuauuguacucaauauaguuguaaaaagauuauguucaguuaauuauagacaccuuaaguguagcauucagugaguuuuaacaaaugaauacaccuauauaaccaaaaccuagucaagauaagggacauuuccaucacucccaucuagucaaucccagccacuacaggcaaccauucuucucaucucuguuuucacccuagauucguuuugcuuguucuugagcuucauuuauuguuuuuauuuuuuauuuuuaucuuuuaaaaaagaaaauagagaugguggggggggggucucaguauguugcccaggcuggucuugaacuccugggcucaagcgauccucuugccucagccucucaaaguucagggauuacacaugugagccgccauaccugggcuugaacuucauuuaaguggaaucaaagaauguguacucuuuugaaucuaauuucuuuugcucagcgugauguuuuuaagauuuauccauggccgggcgcgguggcucacgccuguaaucccagcacuuugggaggccgaggcgggcggaucacgaggucaggagaucgagaccauccuggcuaacacggugaaaccccgucucuacuaaaaauacaaaaaauuagccgggcgugguagcgggcgccuguagucccagcuacucgggaggcugaggcaggagaauggcgugaaccugggaggcggagcuugcagugagccgagaucgcgccacugcacuccagccugggcgacagagcgagacuccgucucaaaaaaaaaaaaaaaaaaaaaaaaaaaaaagauuuauccaugcugcuguuuauguuaguaguucauuguuuucaaaaaauaauguauugaaaugaaauucauguaaccaaaguaacaauuuuaagguaaacuauucaguggcauuuaguacauucacaauguuguucaaaauaccucugucuaauucgaaauauuuuuaugucucuaaaaguaaaaagucuuacucauuaagcagucuuugcccaucuucccucccccgagccccugacaaccaucaaucugcauuugguuucuauggacauaucuauucuguauauuucauauaaaugggaucaucauacaauauguaacuuuuuaugucuggcuuauuucccuuaguguaauguuucggaaguacauccaugauguagcauguauuagaacuucauuucuuuuuauggcugaauaauauucuauuauauguauauacagcauuucauuuaucuguucauucauugauagauauuugggcuguuuccgcauuuugccuauugugaauagagcugcuuugaacaugugugugcaugauuugaguaccuguuuucaguucuuuuguacguauacauaggauauacauaggagcagaauugugggaucaugugauaauuauuuuuaggaacugcuaaacucuuuuucaaagcaucuagaccauuugauauuucuaccauuaauguggguucccauuuuccuacaucuuuuccauuguuuauuuucuguucguuuuauuuuuaaauuauaaccauccuagugggugugaagugguuccucauuguagguuugauuugaacuucccuaaugacuguugauguuaaaugucuuuucaugugcucauuggaagacaaaauguguaucuuugaagaaaugucuauucaaguccuuugccaaauuuucaguuugguuugucugaguuguuuuaguuggguugucuuuuuguuacugaguuguaagaguuuucuuuguauauucuggauauuaucagauauauaauugacaaauauuucaaaccauuccauagacugucuuuucacuuucuugauaaagugcuuugaugugcaaaggucuauaauuuuuuuuauuaugguaaauaauacaugguauuuaucuuuugaagaaauuuuuaaguauacagugaauuauugugaacuauaagcauuauguuauauagcagaucuauagaauuuucuucauuuugcaugacugaaauucuguacucguggaacugcagcuccucauauucuccuccccacucccuggcagccaccacuguaguuucugcuucuaugagguuggcuacuuuaaagauuucauauguugcuuuucagccuuuuggauaaggucaaauguagauacuucaugauaaguggagucguguaguguuugucuuucucugacuagcuuauuucauuuagcauaauguccucaaaguuuguucauguuguagcauaugacaggaucuccuuuuucuaugcuaaagaauuuuucauuguauguauguaccgcauuuuuuuggccucuucauuuauugaugggcacuuagauuauuuccaucucuuagcuauugugaauaaugcugcaaugaacgugagagugcagauagcacuucaagaacccauuucaauccuuuugauaaauaccuggaagugggauugcuggguuauaugguaguuuuauuuuuucauuuuuuuuuuguggaaccucuguaguaaugaaagguuuuuaauucuggugaagucuaauuuaucuauuuuuuccucauguugcuugugccuuugguaucauaucugaaaauccauugcuaaauccaugaucacaaagcuuuaccucuauguuuucuuucuaagaguuuuauuuuauuuuauuuuauuuuaaaaauuuuuuuuugagaguuucacucuugcugcccaggcuggagugcaauggcacaaucuuggcacacugcaaccucugccucuguguucaagugauucuccugccucagccucccgaguagcugggauuacaggcaugugccaccaugcuggcuaauuuuuguauuuuuaguacagaugggauuucaccauguugaaggugaaaucccuucaaggccaggcugaucuugaacuccuaaccucaggugauucacccgccucagccucccaaagugcugggauuacaggcgugagccaccgcgcccagccuuucuaagaguuuuauaauuuuagcucucauacuuaggauauuauccauuuggguuuaauuuuuauaaaugguaugaggugaagguccaccaucacucuugguggguguggauaucuaauuuucucugcaccauuuuuugaaaaggcugcucuuccgcuuuaaauggucuuggcauccuuggcaaaaaucaguuggccauaagauguauggcuuuaugucuggucucucaauuccauuucuuuuguccauaugucuguucuuaugccagcaccacacugguguuuuugauuuuguuucuuugagacaagguuuuggucuuuugcccaggccagagugcaguggcaugaucauagcucacugcaaccuuaaacuuuuggacucaagugauccuccugccucagccuuccaaguagcugguacuacagacaucugccaccacaccuggcuaauuuuuucauguuuaauagagacgaggucucgcuauguuacccaggcuggucaugagcuccuggguucgagugauccucacuccuuggccuuccaaaguucugggauuacaggcgugaacuaccauguccagccagcccacacugcuuugauuaccaaaguuuugcguuacguuuugaaauugggaaauaugauuccuucaacuuuguucuuaauuuucaagauugauuugguuguuuggggucucuugcaauuacauaugaauucaaggacuggcuuuuccauaucugcaguuuauuguucuuuauugcugggugguauuguguggugugaauuuacagguugguuuaucagucucuuauugaguauauucuccuguugauggagaauagauaaacccaaauauugucgucuguuuucuuucucacauuaacuugagacuuagggcuuuugguuuugucaagcuuuaccuuaaaugaauuuauucuucaaaaguauuuguugguaaggaaccaauggcuuuuuggccaugucuuuuauacuccaacuuuagaaaaugcucuguuuucaaguuguaauagucucuguucaugauuuauacaugauuuaucaagaaaaaucacacuuugaaccuguuuugcaaauaauuuaccuguuuucuuugcagguccccuuuuuaucuucuuuggaaggucauauuuauuuaaaaauaaaaugucaagugaauuccaguguugaagaaagagguuuucuaguaaguaacaucacuuagucuuuaacuuccuuuuuuccauuuugugaaauacagacuuguuucccauaggaaugaaauccuuugugauuaaguaauaaguugguucaguaaagauuuguuuuauguccuuuauaugccaaucacugugcugccauuggaauguaaaagaccacaaaaaauaauuccucugcucaugaguuuuuaguuuagaagagagaaauacaaacgaacagacaagcacaauauaauacucuaauaggagaaaacagggugcaucggugucaauuggugggacaccaggucuugacuguguguggggugggauaaagggaacugcugagagaaguaauuucuaaacugaguaaguuaaucugagagaaagaugagaagugcuccagauagggggagaauguacaguggcuugaagggcccuucuuugucacuccuacccaaagaaaagaagaaugacacaugcagacaguggaagguauuucaggauagcuagagcuuagaguuugagggcaugcaugugauugguggguggggaaugaggaggaaagugugguuaggggaaauggggcaagaguucaagggccuuuuaaagaauuuggacuuuauccuagagucagcgaguuacucuuacaggauuuuaagcagaggaaauuauccaacuugggauugagaaaaucauucugaccaauguggaaagcagauuggagaaugacaacccgaagaagacuagucaguucccaccaaugugggaaauuuuaaugaguuaaguuuuacgugauuugaauuuuagaugccuggaaacaugugugaaaguucuggguuuggagcucaagacagacauuuaguagagguaaagauguggauaucugcagcauggggaagcccagggcaagugagggaagcagagccaacucacuggaggagugccagcauugaaaggacggauggaaggagggaagccucagaggagacugcagggagagaaacggagaaucuagcaucaugguugucaauagaagagaacauugaaaggagggagugguugaguuagaucagauucuguuaggacuguuggacuuauuauugggugaucauucuggcgcaggugagggcagaugcuagacugcaaauggguccagagugagugggagaugaggaaugagcacaggagcuuggaaacucuuggaaacacuuuggcagugaaggaguaaggagagaagaguguugugcuugcagagguauguagggugaaaggaggauuuugucaacauuuuguuaagaugggagagacguaagcggcuuuaaauguagauggguagcuucuaauagggccaaagagauugaagauagaggccauggaggaccugaucuagggcuuaugggguaauucauagagcaaggucaugagaaugggaagaauuaagcccaagccacaauucacaggauuuauuugauacagaauuuacaguuuucucauuaucagaggaggaaaguauguguguagaaugcauagaagauugugaguaugguacaagaaguagagaaaauccacuugcuuugguguucucugugaagcaagaacuugaaugaugcaagggauguuacaagucaguuuguaacugcugucaaagguucagaaagaagagcuagauauuaaggaaagcccgguggucuaaguaacuguagccaacuucccaaggauugggaauugcuacuuauuaacaguauuuuuuccuuccuuauuagguuuuaucacauauaaauccagcagguggcacuagauagucuuggaagaguguaaauuucugacuugaaggcaguauuugccuaaugaccuuuucuuuucauguaaacauuuuuauauuuuauuguugaugccuuuagcaauggauaggcucuguuaagauagcugguccauuugcauauaacgucucaccuaauuaguuuuuuagaugggcucuuaacgagcuuguuagaucucuucaaguuuacucugucuugaauccuguagcccauucuucucacauucacacuuacaaaaauguaguaagaaagagcucuggauuccccgacauaacuucuguccucugccuaaacauugcauuuuaauugccucuacccccuauaaaaaauuagagguaguaauggaaauguaagcuccucagcucagcuuccuuuccugaugugccagggcugcccuggaggagggcgacuccaaccaaagagacagguaagugguucugacagggugccgggcuagcucugccuccacugaggagcagcaagaggcaggcgcucuggauuggcagccagaagguucaauuuuuguggucugugugaugucacuuaauuuccuuggcccucuguuuccucagcuauagaaaugaaaaggccguccuuuucuuauuccucucugauuauaguaugaugucauaauagcugguguuaaucuuguuuaucaaaaguuaccuugucuguuuauuaccuuuaugauguaaaaggugaacguuaacacaggagggagcuggugagugauuuguguuaacuuucaugcuugagauugaaauaacgacauuccuuucuuucuuccuuggggagcuguaagcaguguugccuagaaaaaggcugcuuugggaggaaaauggaaggauuaggggaggaggaaaaaggugaggcaggagagcauaugguuggagcaagccaauuaaucugaggugucaaucuagcuugguaacauuugcucccacacgucauggccagaaauuagacucuugauucaagccaccuuuugggaaauuuacauaaaacagugaauugagaagaguguauauccuauugucauaggguuggaguaaggacuaguugagauaauuuaaaaauacuuagaggaguaguugagauaauuuaaagauaugcuuagaaugguuccucacagcaacaaccaaguaauacuaguuuauucuuagcuucucaacaaucagagaaguaaaguuggaauaugaagguaaucuaaaaucaaacgcaaagaugccuuuggaucaucuguaucagagggcagcacagcagcccucacugacuguuuuuauagucuuugauuggaacauaggcugaucugcuuacuuagcaucugugacugcuucugugccacagcagcugagcugaguagcuguggcagggaccguauggcccaaagucuaaaauauuuacucucuggcccuuauagaaaagguuucccugaucuacagcauuguuauguuuuuaccuugcuuuguucuuuaacacagaaguucccagaugaauguuguuuuuuuuaauuuuuauuuauuuauauuuuuauauauuuuuuugagacggagucucacucugucacccaggcuggaaugcagugacgugaucuuggcucacuguaagcuccaucucccggguucacgccauucuccugccucagccuccugaguagcugagacuacagaugcucaccgccacgccuggcuaauuuuuguauuuuuaguagagaugggauuucacuguguuagccaggacggucucgaucuccugaccucgugauccgcccgccucggccucccaaagugcugggauuacaggugugagccacugcgccuggccuuuuuguuuguuguuuuuuuuuuuaaauuaaaagugagggcuucuauauagauuagggcucuguuaugacuauaacuaaaaaauagugggggaaaaacucuuagcuucuacuuacccuguuuaaguggaagugcuuccguggaacaaaaccagauguuauuaguugccuauucuggagcccuguuucuauccagcacuacugccuugccuaccuuuagcauauagcuagcaucccuaaggacaaacgccugauggcagggaggcaccacuucaagcgugucucacggcccagcagugggcuuggaguuuugauguuuaucaugguuauugaccaaggcuuaugaucauaaguuaacucuuuucuaauccuguuagaaaacuugaucuccugaauaaagauuaaaugccagucuugcauauuaagauagguuuaacuuaauauguuaucauuaauuuuuuaaaauauauaagguaugguaauuuuguauuauuaauucuccaacacuugaggcauuucuguuguuuaaggagcauuugauuagggacacuauacuuuuuaaaagucuuaaaguagguagagguauuuaauuuaggguugauaucugaauguuuuuaaaugcuuguagaugauguugaaguaaauuucugauaugaauaaucagugauuuuuauuauuaagauaaaagacaugauaaaaaaacauacaaauagguuuugagauaugaaauaugucaacauacuacaguuaguguacagaaucagcauuucauuguuaggacauuuuccucaacuuucuaaagccagcauuucaacugacuuuuccagaccauauuugaagauguuagugguuuuggugccuggcaucgaagaugguguguucuuucuggaaacuguauaucuuauuggacuuauccagaugaugagaaacgcaagguaauuuauauaguacuguuuaguggugaaagcccugauugacuuucguguaguguucaugcaaauguucccucuggcccccaucacucacccaaauuaauaacccuuuuuguguacucacuaagccauuaaaaauguucuuguuggccaggcgcaguggcuuacgccuauaaucccagcacuuugggaggccaaggcgggcagaucaccugaggucaggaguucgagaccagccuggccaacauggcgaaauccugucucugcuaaaaauacaaaaauuagcugggugugguggcaggugccuguaaucccagcuacucaggaggcugaggcaggagaaucucuuggauccaggagaccaagguugcagugagccgagaucacgccacggcacuccagccugagcgacagagcaagacuccaucucaaaaaaaaaaaaaaaauguuuuuguuguaggugugugugugugugugugauaauccuuuaaaauuuuuauauccuauccauucccuaugauuugaccacucuuaaaauaccuuaacauguauauuuuuccuucuuuucuacuggauguuuaauuauauuuuuuguugacauuugaaguuggaaauguuuuaaauuuaauuuuuuaucuuguuaguuaggguaaaacaguaauggaaacccacccacaggaacagugguuuguauuuuguuucuaaaauuuaauaauaggauuuuguguaauauaucauguuuuuaaagaaguuaauaucauugcccaaguaacauuauuuauuauccccaaacuggaaaauagaaauaagcagaauuaaaaaggaaaaucauccauaauagacauagcuauuguucauauuuugguuagauauguuuucaaacuuuuaaaauguauaauauauaauaauuauucauuuaugaaucuuuuuaaaaggaaaagcaugcuuuuuauaaucugauuuuuuacuugauaaaauauucuaacaucuuucagcaucaguaaagauaagucuaaugcuguguuggauagcuauguguguuacacuguagucauuacaauuauuaauauuuuaaaaauuugugaaauguuugagacauccaaaagggcguaaaauaauuucaucaaccucuguguuauuauuccaguugaagcuccccauguaauucucucucccgcagagauaacuucuacccuaaaauuguuuauuguucccaugcacuuauuuaaauuuuuauuauacagauugaauaucccuuauucauaauccuugggauuuagaggcguuucagauuugggauucuuuuuuuuuuuuuuuuuuuuuuuuuuucagauuuuggaauauuugcauuauacgugccaauuaauuaucuccuaauccaaaaauucaaaaucugagaugcuccaaugagcauuuccuuugagcaucauguugacucucaaaaaguuuuggauuuuggagcauuucagauuucaagauuuucagauuuuggauguuuaaccuguacauguauauaaacaauauauguugcugcaauugcauguuuuuaaacauuauacagauaauaacauauuguauguauuauucugcaacuugccuuuuuugggucaguaugguuugugaaauuugucuggggugguauguguagcuuuagauuguccccucuucucuguauaguauacuuuuguaagagcacauuacaauuuauccauucuccuguuuagagacccuuagauuauuucuaaauuguuguauacagacaaugcugcugugauucacuuucuucucauuuuguuuugguuuguaccuuuuacagcccacaugcaggaagauuuaguuucuuguacacauggaugagaguucuuuuuugaauguuaccuaguagcagaauugcuggguuguaggguuugcacaucuacaacuugauuuugucaaaugagucucaaaagugguuguacgauuuuccauucccaccaggaguauuugaaaguucucagcuuuucauauucccaccaauacaucauaugucagccuuuuaaacuuccaucaguaugauagaugugaaauauacucuuauuuaaaaaaauuuuguaucuucuugauuacuagacuaaguaucuuuucuaagcauaagaguguguauggccauuuauauuuucucucguaugaacugauugucucuauauuauucauuuuaauauuuuuugaugcauugcaauuauauuucccuagucuuaggccuggcguaucuuuuaauuuaucuuuauagugucuuuucaugcacagacuuuucuaauguuaagguaaucagaccugcuagucuauugcuuugugcuuuuuagggucuaauuuaagaaacuauccuuauccuggagucaaagauuucuuuuauaccucuuucuaaaguuauagaguuuuauacuucacauuuaauuucccuagaauugauuuuuuuuuucaucugaauaaccaauugggccagcaucauugaaugguuuguucuuuccccacuguguuaggccauucuugcauugcuaugaagaaauacccaagacuggguaauuuuuaaauuggcuccugauucugcaggcuguacuggaagcaugaugcuggcaucugcuuagcuucuggggaggccucagggcgcuuuuacucacagcaaaagaugaagugggagcagguacaucacaugguaaaagcaggagcgagcgagcgagcaagugagcaaggggaggugccaaacauuuuuaaacaaucaguucaugcgagaacucauucacuauugugaggacagcaccaaggggauuucuugagaaauccgccugcaugauccagucaccucccaguaggccccaccuccaacacuggggauuacaauucaacaugagaucugggugaagacaaauaucaaaacuguaucauucacugauccacaaugccauuucucauguguaucaagaugucauuauauguguagguuuauuuuuaggcucacgguucuguuuccuuuggucuguuucccuaucccaaucucaaugaccguagcuuuaaaauaaaucuuaaugucugcuaaggccagucuccuaacuuauggaguaauguauaguaguucccccuuauccuuaguggacgcguuccaagaccgccagugaaugcaugaaaccauagauaaguaccagacccacuugccaucagucauaacacguuucuguugaugucuuacacccacaaauuuaaugccuuuuguauuuuaauuaagcacuuaccauuuacuguggugguaacuuuugcaguuggagaugugacaacgaaacuagcaugaauuucuuuuucuuuccucacaauuucauggauagaagauuuauucuuacuguagaucuugacaaccucagcauacgauuuuuuuucucuccuuauuaaguugaagacuuucaccuuuucacuuaaaggaagcacuuuaugguuugucuuugcauaucuacucuugcacuuuggggaccuuauuaagucagauaggggcuacuugaacacaagcacugcauacuacagcaguugaucuuuuuuuuuuuuuuuuuuuuuuucugagacggagucucgcucugucgcccaggcuggagugcagucgcgggaucucggcucacugcaagcaccgccucccggguucacgccauucuccugccuuagccucccgaguagcugggacuacaggugcccgccaccauucccggcuaauuuuuuguauuuuuuuaguagagacgggguuucaccguguuagccaggauggucuugaucucaguugauccuauaacucagaacgcuacuaagugacuacugagcagguagcagguaaggcguggauacgcuggacaaagggaggauccacaugccaggugcgauggcaggagauuacaucaugcugcuuagaauggcaugcaguuuaaaacuuacgaauaguuuguuucuagaauuuuucuuuuaauauuuuucaacuaugguggacuguggguaauugaagcuauggaaagugaaaccauggauaaguggggggcuacuguaugacuauucuugguccuugcuuuuuccauacacugcugcacacacacacacccccugccaucaccucauggaaauauauauacauauauguuucacuuuuuucuuuucuuuuuuuuugagacagggucucgcucuguugcccaggcuggagugcaguggcacgaucucggcucacugcaaccuuugccuccugggcucaagcgauucucugccucagccucccgaguagcugggacuacaggcaagcgccaccacgcacggcuaguuuuuguauuuucaguagagaugggguuucaccauguuggccaggcuggucucaaacuacugagcucaaagguauccgccugccuccaccuccugaaguguugauauuacaggcaugagucacugcacccagcccuguuuugcauuuuacaguugaaaauguucaaauguacacaaagcaaaaauaguauaaugaacuuucagcuuaauuaauuauucguuuucagguuucauuuaucuccccacaacacacaugcauuuuuguuuuguuuuguugcuuugcuaggguguuuuaaagcaaauaccagaauuuauauucugucauuucuagguugcaggucuuaaguguuggcaaaugccccaagggaagucaggguuucagacuagcuuacuauucuucauucucccuugcucauugauuuuggccuuugaaggauuuuucuacuuucuugucaauuuaauuaucuagcauuuggcggcuuauauaaugggaggauuuucagacuauuuaauguaucauauuugcuggaaacaauaccaugauuuauuuaaauaguccccuauuacugucauugaauuuguuuggaauuuuuugcuauuaugaaaaaacagugacuacacauauuagaaucugugugugcauauuuauauauuugcuucggauaaauuuaggugaaacuguaggaucagaaaaugcucauuguuaaugguuuuugauuacuguuaucagguugccuacgaguaauagaucauauuauacuuucaccagugaugcauaagaaacuguauuacucacucccuaaccaaucaacagagguuguuacuguuuuuuccagacuuagccaaucuaagguuuuaaauugguauguucuauuuuuauuuuuaaaaauucuaauagaguugacacacuuauuggcuguuggcucaugugugccuauauguguuucuuuucccauuuucaggaccauuuggucucgugaauguuuuccuccacuuugacucguaucauaggaauucauggcugccaacaauccagggcaguugucugcccuuaucuuucauagauauauaaagaaauauuuacacaugaaauccaaugucuagguuuccuuuuauagaaaggggagaaguggguaaguuguagauaaaaggcacuugaguguguuucucauuguuauagcugguuuugguaccuggggcucauuauacuguuguuuguauuuuuuauuugaaguucaccauaauaaagagcuuuauaggauaguuggcaagagcuaccaguugauauuuuuggguuuuauuuuuaugucuagcuaggaacaauaauaaauguuaaauauguuucucuaagcccaguguaacuaaauuuuaacuuuuaaauaauagcuuuuuaauauuuaauuuguaccaacuuaaaugcugcuuaaugcuuacugacuuaaauagucuuauuuucuacuaauuucucuuaauuuguuuuuaaagaaucccauaggaaggauaaaucuggcuaauuguaccagucgucagauagaaccagccaacagagaauuuugugcaagacgcaacacuuuugaauuaauuacuguccgaccacaaagagaagaugaccgagagacucuugucagccaaugcagggacacacucuguguuaccaaguauguauuggccuauaaauauuucuaucaacuaagcaauugauugcccacuauguacuuaccacuaugagaaauaucacagaugguccuugacguugaaaagggcacagccuuagugagaaaacaaaacacacacaaagcaguaagugaaccaucuauaauaacuaaauuaauguaguuaaggaaaguauaauacucagguuguaucuuagcuaauguuuuccaguaugcucacaguggaggcauuuucauggcaguuagauaauaaucuuuggguuaaguuuaaagauuucaugcguaguugaggagucaagcauuauucaaagagacuuuacacaucccuuccuuccauucccagaauacccucguguaaucagaugacucacagaaacaaucucauucuauucugcaaauuucuggauggagauuaacagaauaaaacuuuugggagugccccuuuuuuaauuaacccugaucucaaguguaagauacgaaggcuuauugcuaggauucuaagauagguuucuuugcuuggaugccuaagagaagcuugaagaccaacuucaguguacagaguugucauuagggacaaaaguuagaauuugauaagauguuugguaauuaggcuguugcuggauauugcagauggggggagauugguaggacuagcuuuaugaguuucuaaugugaaaauauuagaaagcuacagccaggagacacaauacuaaaauagaacaaaguugcccagagacugccgauuuguuuuaaaauagcuagauagaggacucauuugauggaaauuuuugaugucuagauuacuuccagauuuauucauuuuaacucaauuauuucaggggccuucuaugcagugguggaaucagacagggcaggacaggcaaaauggauuucuaaucauuuuguuugauagcgacguguccauggucacggucaguggaggaaccaaccaaagugcaguauccaaauaguuccugaccacagcggcccacuucagccauuuugaauaucacuuacauuuuuuuguauaaccuuauuuuuuacugguugcguaaacucucuuagacuucuccguagaccuuccccugugauaaaaauagcagauuacauguugcuuuaauuacucuguaccucauguacuuguagucuuucucacuauaaaauuauaacuuggauggguacccuucgcccaagcauaugagaguaguacauucucaauucagucuuggcugagucuucagcuuugcuuggugaccuaaaauuuauuuuacuuuuuugauggugagaauauaaacauucugcaguucugcauucuccuuugccucacugauguguuuccuuacggggccuugggccuuuuggacuuaggccuuuuacuugaauuuaauguaccucauuuucauuucuacuaacuaagcuuguugucaaugcuaaagauuuuucuucugaucucuacugcauacuucaaaauagagacuacacauugaaaccagaauguuuuaucacauggggaggcaguaguuacaguggagcuuugaagucaacggacuuaaguuuaaauccugacucaucaaauguaaccauggcaggucacuuaacuuugcuggcccucugaaaucuuuugugucaaaaaggaaaaauaaccuccacagugacuagagauuuuuuuuauuuuuauuagccucuugaaccagaauagguucacagagacuucagacaacagagaugaaugaguaaacacacuuagcacaguuuccaguacauggaaugagcuuaacaagugguggcuauuauaagugcaguauuuucuucauugacuaccagaaggugguaaacuucacuuauucauguuuacaccauuucuaguaccaauggggagaacuuaaaaaguuguagaaugagugcaauauaaaaaccuaauggcuggcuguucucuggaagcauguucuggcuaugagguagggaauccccccuuccuuacucuggccugccccaucaacuaguuauuuagucaacuuguagcuaaauauggaugaaaggaaaauauuccuaauauggacagagagguuaggauagacaaagucuuaggaucuuuugauaguuuauuuuaaaaucauguucuacuaauauaguaggacaaaucuaaugggacacagugcaaacuaauauuaccuguagagccaggugaagguccaugggucugugauugcagcuuuuggagaaccugacucugaagguuauauugggagugcccauauucagggagugccuauaaucaggccuuaggugcucuugcagagaaguugcccacacucaguggguguccuauaccaucagguuacccaggccgcacacuaccuguauaaaacaccuguuggaaacaccauccuuuaccaaguguaauuaguguaaguuagcaucaauuaaccaaacuggggauaauuuuccucuguuuuauuuggagaugcaccucacuaaguggcuguggauuagcauccauaaaaggugguuaaagguaauucauuuacugguuuauuuagucauuuuuuucccuagcaagaguacauggggguauggaauggagggagaagaauucugaccucuuugguuguuuguuccuguaggaacuggcugucugcagauacuaaagaagagcgggaucucuggaugcaaaaacucaaucaaguucuuguugauauucgccucuggcaaccugaugcuugcuacaaaccuauuggaaagccuuaaaccgggaaauuuccaugcuaucuagagguuuuugaugucaucuuaagaaacacacuuaagagcaucagauuuacugauugcauuuuaugcuuuaaguacgaaaggguuugugccaauauucacuacguauuaugcaguauuuauaucuuuuguauguaaaacuuuaacugauuucugucauucaucaaugaguagaaguaaauacauuauaguugauuuugcuaaaucuuaauuuaaaagccucauuuuccuagaaaucuaauuauucaguuauucaugacaauauuuuuuuaaaaguaagaaauucugaguugucuucuuggagcuguaggucuugaagcagcaacgucuuucagggguuggagacagaaacccauucuccaaucucaguaguuuuuucgaaaggcugugaucauuuauugaucgugauaugacuuguuacuaggguacugaaaaaaaugucuaaggccuuuacagaaacauuuuuaguaaugaggaugagaacuuuuucaaauagcaaauauauauuggcuuaaagcaugaggcugucuucagaaaagugauguggacauaggaggcaaugugugagacuuggggguucaauauuuuauauagaagaguuaauaagcacaugguuuacauuuacucagcuacuauauaugcaguguggugcacauuuucacagaauucuggcuucauuaagaucauuauuuuugcugcguagcuuacagacuuagcauauuaguuuuuucuacuccuacaaguguaaauugaaaaaucuuuauauuaaaaaaguaaacuguuaugaagcugcuauguacuaauaauacuuugcuugccaaaguguuuggguuuuguuguuguuuguuuguuuguuuguuuuugguucaugaacaacagugucuagaaacccauuuugaaaguggaaaauuauuaagucaccuaucaccuuuaaacgccuuuuuuuaaaauuauaaaauauuguaaagcagggucucaacuuuuaaauacacuuugaacuucuucucugaauuauuaaaguucuuuaugaccucauuuauaaacacuaaauucugucaccuccugucauuuuauuuuuuauucauucaaauguauuuuuucuugugcauauuauaaaaauauauuuuaugagcucuuacucaaauaaauaccuguaaaugucuaaaggaa

SEQ ID NO: 192034 - RNA, 14593 nt, Homo sapiens
ggcgcugcgggggcugacaugucgucccggccugggcgcgaggacgugggggcugcgggcgcgcggcggccgcgugagccgccggagcaggagcugcagcgacgucgggagcagaagcggcggcgacacgacgcgcagcagcugcagcagcucaagcaccuggaguccuugugagucccgagcugccguccgcgcgcggccagucuucugaagccaggggcccggggcgcgggacgccgcggugggcgcuaggccggguccuccgagcccccgcgagcaggcaggggggcugggcccggcaggagccuggugcgggcgaccgaugucgggcgccgcggucaaggacuugaaguccauccuccuggcggggcguucagggagccaacugccgcucggcaccaagcagaaucugacuugggaggcccugcgcuucccuagcuccaggggguuccaggagaguccaaaugacccgggagagugugguguaaagaagauucaaauguaggggaaggaaauaugguuucccucuacccuucuaaguucuuaagcugggccacaaauuaaauugucauaagacagauuaacaggagaaaaacuuuuaauuauguacccgugcacuagagggccacaaaagugggagacaaagaagggccagggaauaggggcgugggccuuuuggggcgugguggagaccuuuuggaagggugaugggggaaauguauggugaauaaagguugcuuuguuaucccgaugaggcgcucaggcgauaaaaguugcccccaagcagcugucuuccugauacagauacauuuacuacagaaaauuuccuuuauagguguaaauuucuguuuacaacaggcgagucgaaaaauaauaagaacaaaaggaaaaaaagcagucauacuuuauuuuaggcaguugagggguagcugaauaaguuauccuguguuguuugguucuguuacuuauagcucaaagucaucaauaugccaggguggcauguuuggggauggugcauucuugucuuuugcagucauuuaucaggguggcguuuccuaaauucuaacacagaccucgaguggaaaguucaggcagcaacucuuucaguucuuguccgugauucuauaauuagcugcauaaaacaaccuuuucuaaguguggcauucacucaguuauucaagaauucguuucuguuuuagccacuucuaguuaccugugcuaaguagguguuaaguauagccuaacgcugccuccuugaauauuuuaaguuuagccuaaaaguuucucuguacuuagugaacuguaaccuaaguagauguguaaacagacuguaaccuacuguuauaaguaccugagucucagacaaucacagcagcugauuuucaggccgucacagguggucagccuuugaaacccuguucaaagaaggcaaacgccaggcuguauggaauccagcuauuucucuaccucauuugcuuuucuguacaucacuuuccuuuuccuguccauaaauguuaucccaccagguggcagccugagaauugcucuggaccuauucugguuaugggggugcccucuuugaaaacaguucuuugcucaaguagaguuuaauuugucuacuuuuaaaaaacauaauucauauaagaaaaguuccucaaagaauuaaaauccuuuuuauaauuaaccuucugggagguuugaugugagauaaauuccuauguugggaccuggccugcucuuuuuccaguguggcccgcucugaacgacuuuuccccuuagcagggcaggggaugcaggauagagacccugcauugugggcauccauguuacagggcaguccuggcccuuucaagucacuguguggcgcucuuggucucccagggaagucagguguucaaagaucuuccccuagcguaagcaucagaaugccuggcccugcccagcccucaauauauuuagcuauagaaugcuagaggaugguuaauuccacuuauuuguagcucagagagcuuuuucacagaugagagagauuauaaccuacuuuuacagaugaaaaaauggaggaacagugguuaagucaugugaucaagcauacauugaccaguuaguuaaccagcaaaucuagagcugaacccaggugucugauugacuggugggauuuuuccaguuucugagauuuaaaacugaaugagccguugagacauuugcuuuggccaguucagaaucuuguuugagcuuuaaauuguauuuauaccacaguaauauguaguuuuaaaauucaaauaguacuaaaagugcuaccaaaaaauagcaauaggcugcccaacuccucaguaaccacucauauucccugugucccucuucccccucccaaaccaggcuucucuguguaaacuuuuagguuuuacuucugggauuuaacuguuugguuuuuguuuuuuuuuuuugagauggagucucgcucugucacccaggcuggagugcaguggugcaaucuuggcucacugcagccuccacuuccuggguucaagcgauucuccugucucugccucccaaguaccugggacuacaggugugcaucaccaugcccagcuaauuuuuauauuuuuaguagagauggggcuucaccauguuggccaggauggucucgaucucuugacauaguggucugcccaccucagccucccaaagugcugggauuauaggcgugagccgcugcgcccaccaacuguauauuccuaaauuguauauuuauacuguuuacaucaauucaacaucuuagacauaccucuuaacuucuugucacaguaaggauuuaguucuuuaccuacccuucuuguuuccaaucuuccaguauaguuccaucauagcaauuuuugcuaaacgaaugcuuaguauuaacauuauuauaacuaggcugggcucuguggcucacgccuauaaucccagcauuuugggagguagaggugggaagaucgcuugaggccagaaguucuagaccagccugggcagcauuuauagaccuuaucucugcaagaaagaaggaaaaaagaaauuaaccaggcauggugguacaugccugugguuccagcuacuugggaggcugaagugggaagaucugcuugagccugggagguugaggcugcaguaagccauggcugcacuccaggacuccagccugggcaacagagugauauccugucucaaaaacaaacaaacaaaaaaaaaacagcaauauaacuaugaauuauuacucacuuugagccagguaguguacucugauuuauuuugcuuucuauacuauuguuaacuuuuaaguaguuaauaagagccuuuguuuuucacuuacuuaauuuucuacugcuguuuuucccccaaugucuccaaaaucugaguaccauaaaggugaaaagguaucuuuccuuaccuaucauaggagucacagcagauacuccuauaacaaaaaauaggucaacaagaaaaaagcauaacaaauguauuuaaucaaaguuuuaugugacaugggaacguugacaaaggaagacccagagacccagaggaaacuauuuuuaugcuuaguuuggaugaagaauguauagcaguguagaaauaugauuagacaaaaaaggguauaauacaguggucauagggaaaauccagcaagcccugucuauucagauuuuucaggccucucuguguacgauuacuuccucccagauauggggcaggacccuuucuggaaugagggguccugaucuaucaaacaagguaggucagcucauguuuuuauggccaccucugacacagaaaggcaaggaaauguuaggguaauauuuguaggaguuuauuauuauuauuuuaaauauuuuuuuaaaaguuccacugagauuuuaucuucuuuaaaaaaaaaauuaaaguuauuuguagggcuucuggcuugcuuugugggagacuuguucuaguuuuuauggcccacuuguggaaaagaggaauucuggccucucugacugcuuuggggaagaaagaagggcaggagacaggagggcaagagaaggucagagagcaacugucuucugaggccuucucuaaucucauuuaguucaaaguacucagcaugccaaagcaccauacuuugggguaucauuuucugagccccaauaguacuuuuuccacacauaacuacauaucagguagucaguucauuuuuuaccuagacucuucaaucuguuguccuucaguacacugguuacuuuuuagaccugguccagcagugguccuagggcauccuuucccacucuccuaucuugcaucucauuccuggauuccaugucuuccucuuuauaaguuuacucucacauuuuaccaaagccaauucugcaacuuccuaugaaagagugcauuggagguaaaguuuuugacaccuugcauaucugaagaugucuuuauucuauccuaaaacuugguacauaauuugacuagguauaaaauuacaggucaaaaaucauuuuggggcugggcaugcuggcucacaccuguaaucccaacacuuugggaggccaaggcaggagaaucauuugaagccaagaguucaagaccagccugggcaacaaugugagacccugucucuacaaaaaauuuaaaaauuagccaggcacaaugauauggaccuguagucccagcuacuccagaggcugaggcaggaggaaaauaguaacaacaauuuucacucaguuuuggcgauaguacaucacuaucuucuagcuuccaaaacugcuaaggaguuugaugccauucugagucccuuucuuuuauaaguuaccuguucaaguucaccucacccuuaaacguuaagaaacuauucuuuauugcugccauccugaaguuucaugauaauguuagucuuuuccaauugacuuuuuuuuuuuuaacuuuuauuuuagguuuagggguaccuguguagguuuguuauacagguaaacucaugucauggggauuuguuguacagauuauuucaucacccagguacaaagccuaguacccaagaguuauuuuuucugaugcucacccuccgccugcccuccacccucaagugggccccaguguguguuguuccccaguuugugcaguugacucuuuuuuucuugacaugucaugaaugcauuaacuacauauauaaauuuaugucuuauuuccucuccccaauuuuguuuuuuccuucuguugauuuucuguugcucuaucucuucugucuuuguauuuucauuguacuuuguagauguaucuuuuucucuacuaaacauauuuguuauauuucuaaaucaaaaagcuuuuucucauucugcaaguuguuuuuuauauuauccuguucuuguuucauaagugaaauaucuucacucaucuaugaggauacucacucguuuuucuuuuuuguugucuuuuguucccuacauugccucuauuucuuguuugcuuuuuauuuugauugcugucuuacauuuaguaauuuuuuuuucucuaauaucuggguauucuugaaucucaaccauauuuuguuuuguuuuguguuuuuuagagacaagcucucguucugucacccaggcuggagcacaguggcacgauuauaacucacuacagccucgacuuccugggcucaagugauccccccugaaucagccuacagaguagcugggacugcaggugcacaccaugacaccuagcuaguuuuuuuacacuuuuuuuuuuagagauggaaucuuacuauguugcccaggcuggucgcgaacuccuggcuucaaggaauccucucacuuaagccucccaaagugcugggauuacaggcaugagccgcugcucuggccucaacucauuuaagaguaggcgcuauacagcucuugucaagggcagcugugugugggagagaaaaaagagagaagguguuguuuguugaucagauagcuucaugauagggcgcucaugcugcaggguacccuuuuuaucaagagacuuccaaaugucaguaguuggagauuuuuuucuggggcuccuaaguuccucuagagaagggucuugaguccucugccugggggccagggaucucugccuggcugccaguguugcugaauuggagaggcuaacccugcagccuccuucaaguguugggcaggcagccuccuggcuauaggaaggaagccucaucuucugaaaaguguuacuucuuccaccccaggaaauccauugcuauuuccacuuucccaaauuuguugaaaacuuccucugauguugccuccuuuugggauaucuuuauggccuuuuuauuuuuucacugucauuuuuaaagcaucuggggaaggagauagauaagcauguuggucaguuggccauguuaaaugggaagccccacagugcucuuuuauaaauugaauucaaaucuuuucaucccugaugugauggagucuccugagucuccaccacaguuuucccucggugacccugccugccaggccccugagggcauccgaggcuuccaccugcuccaacacucucugucacuuaauagcuccugggcugccaggcauaacagaguggaccuucuggguguauguggcaguuucaccucugccacgcagccccuuggaugcagcugcaggaacaauuguguggaauggaguacacuugcauuagggacucuucucaaagaaaacccaucucaacagucaacagaaagaguaauuugaaacacuuaacaaaagauuucuuacucuguacacacuugagaagacagcgugucucagacauaacuggucuucuuccuacucagagaaaguuaguacagucugaaugacuaaguaaggcuuuucagauggcacaaaauaaugcaucucaaucaacuuuuuuuuaucuugagaauuaacugcagcuggacacgguggaucauguauacaaucccaguacuuugggaggccaagacaggaggauugcuugaacccaggaguucaaggcugcagugagcugugaucacgccacugcacuccagcuugggugacagugacugcaaagauaaaugcauaccucuuaacugucacacuguagaaccuaaacugugcgugaacauacuucaguuuucuaaucuguauuuaguaguuaaauacuacuuucagaaauauauuuuugaguauacuacauuaaugaauuguucagccccgggaaacaacaugaaccacccuucuuuaaacuugugaaaccacuuguaaaauggacuuugggaaugccauugcugauaauauuauauuuccaaaugugcaauugcaucacacucauuuucaucuuggcaagaacaguuacuuuuuuuugagaauuuggaucucaauucgauuggccauauauuuuuuguauaaugcuuguggcucaaaaggauucauuuauuggauuuuuggauuuauagacuuuacugucaagcuccuucuagucucuaugcauaagguauagcauuaauguuucuaaugaauggcuacagauaaacuaucaucuucacaaguugugcagauuuccauuguuuuugcuccauuaggccuaugucaugccacagcuuuuuguuagaaauauuuuaagcaccuacuuugggaaaacacuguaccacacuuacaaagcuaauccuguuaauacacaguuguuuacuauuuaaucuugagggaacagaucugggauuaguaguauuucucauccauuguccaucaaguugcuuucucccacaucuuauagaaggggagaaugaauuuuuuuuuuuuuuuuuaagacagagucucacucugucucccaggcuggagugcaauggugcgaucucagcucacugcaacuucugccucccagguucaagcaauucuucugccucagccuccugaguagcugggauuacaggcacccgccaccacgcccagcuaauuuuuguauuuuuaguagagacgggguuucaccauguuggccaagcuagucucgaauuccugaccucaagugaucugcccgccucagccucccaaagugcugggauuacaggcgcgagccaccacgccuggccaaaugaaaauuuuuucacuuuucccuuugucuauucuugacucccuuuuccaauauucauugucuucuaaagggucccuuaaacuaugcauaagacgagaguccgaaugaagaaaacauuaaaucauuaaguguuucucuauguugcagccauucugaaguauuaaaauaagagagccaggugucauggugccaugguacacaacuguagucccagcuacucaggaggcugaggugggaggauugcuugaggccagggguuugagaccagccuaggcaacacgacaagacccugucucaaaaaaaaaaaaaauacuucccuaaagguuuaaagggucaagggacagaccugagcuaaaaauauuugcauauuacucuuuugggaggagguacaaauugcuuuaggagccugagaguugcucuuugagugcacaaacaccucgccuucagaauuuccuucccaucuugcugccugucccaucuggagacuugcgugcucagcauucugggucuccucuggguucagucccuggauggaaauaaggaaggccuggccagucuuagauggcaggugccgcucagcacagggaggagaagcauucugcucuucucaggugauugcuugucugcaaaccagugauaaaagcuuauuguugcuaaaaucucugauuaaaaauccuauagccccuuuuuugcaguaacuugauguguuauguuuacauuaacaugguugauaagguuuuguuuuuuguuuuccaguuacgaaaaaccuccuccugggcuuaucaagguuagugugaaguuuguacucuugguuauuccacaagacauacuuguagacucaguaacuuguuaugaaaaauaauugcaugauguuaaaucuccuuuuaccaaaagccuguuucuuuuccugcagaugaaugaggggucauaauuuuuaguuuugucacaagccucugccuuugcagaaauuucaucagccauguuucccuucccugaagaaccagugcaggcccacguggauuccuuggccaugccccucuucucucuugcuggggauggcaucucuaagcuccuuuuccuugucggccucacccggcucagccccucgguccauccucugcugguuucuugagcucagcagcucagagagcaguaaacucugaggagaucugacagcuauccagucccgcucccugguacaggcaucccuccugcagcucccuggccaaggugccagggugugugugcacgagggagacuuagaguggcaggccacggccaagaaaacuugcuguuucauaacucucagcgaagaaauauucuuuaaaaacaugagucuauuguaaauuuaauauucauagaaacuugaaaaaaauccaaaaguuugaaaacacauuaauuguaaaugcaguuauugagugguaaaaauguacaucagagauauagcaugugugugacuguaaaacaugacagggccuucaggguauaauaaacuauucuagcauaacaggccauuucuauuauuccaggaagccugguuuacuuuaauucuauauuuugagguagugaaacuuuuuuuuuuuaaucucagaaucuuauuuggagcuccccagucauugcuauauaaggacagauuuuucugcuucaccaguaacuuuucucuaagaacagcuacauuguuuuugguauaguucuucugguacauuuguuuccuguuuuuucaaucagguguaacuugucuuuuuuucuaguuuugagggguaacuaagaugauguuggcaccggaagcccaggaaaaagccaggcaaggguggcuccaaggggagcaggagagaaucccagcgcucuugccaugcuguuuauaccuguucccuuuuuuaggaagaugagacuaagccagaagauugcauaccagauguaccaggcaaugaacacgccagggaauuucuggcucaugcaccaacuaaaggacuuuggaugccacuggggaaagaagucaaaguuaugcagugugagugugggagaguuucccuaauccaugcaacuuacaugccucaauuuacaaagaguguuuacuucuuuuauuuaacuuguucucaucacagcccucuuacagccaaggcacguucuccaucuucuagauaaggaagcauccaccccaccccccaccaccgugccaugugaagaagaaagagggcugucaucuuaagccaggaagaaagcucucaccacaaacccaccuugcugggacccugaucucagauuuccaaccuacagaaugaaugagaaaaccaguuucuguuguuuaggccacccagaauacggcauuuuguuaugucagcccgagcugacuaagacaccaucuuucugcagguccccuuagccucucucccguguuggaucacccauuuuccugugucuugagucuucuuuauuaucauauucucuccuuaugguguaacaaauccuauggcuguuaccuucaaaauggguuuauagaagauaaaaauguuaagaccuuuacuuuucuggaaucgucuuuaacagauuuuuaacuaccaggauauugaauucuaauuuaaaaaucaguuuccuugagaauuuugaugggaaugcuucauugccuugauuauuuguuaaaagcaaagacaacgugccucagaguucaguaucuaucgguuuuucuucuuuggguggguuauauuuucccagagaaggcucccacguggagggaaagccauacuaugaguguucugggagccgaguggagggagucuggaaauguguccaucugcuuuucauucauucgugugacccuuuguggcuauugcagcagcuuccuucagaccuaccugaugucucccuggucucccuggccagagacccucuguuuuaccuuuuccacacauuaaacaaccuucuaccagggucaggaaaacagggucucacucugucacccgggcuggagugcaguggugugaucacaacuuacugcagccucaaccucccagaaucaggugaucucacaucagccucugagauagcugggacuacaggcaugcgccaccaggcuuagcuaauuuuuuuguacuuuuguagagauaggguuucaccauguugccuaagcuagucucgaacuccuggccucaagcgaucuacccgccucugccucccaaagugcuaggauuacagguaggagccacugugcccagccaccauuaauauucuaagagaacuugugauuuuauuuacuuaaaagugagaguuuugaacagacucaaccugagaaagaagcuuuuauagugucuaaaauaguaaaugagaagcagagauacuuuaugaaaacauuuacucugaaaaauauacugaaacacacuuuaaaaaaaauguaccuuuugggccgggcgugguggcucacgccuguaaucccagcacuuugggaggcugaggcgggcggaucaccugaggucaggaguugaagaccagccugggcaacauggcaaaaccccaucucugcuaaaaauacaaaaauuagcuggguguggugguacgcaccuguaaucccagcuacccaggaggcugaaauagaagaauaucuugaacccaggaggcagagguugcagugagcugagaucacgccacugcacuccagccugagcgacagagcaggacuccaucucaaaaaaaaaaauucaccuuuugaaguaauucuccauuggauugcuucauaaauacuuggugauagaauauuauuccuaaagguauaagacuaaaggaugcuuggggaagcaauuaguuuaccucuguuucugggaucuuacauggcuuguccauaauuauauuuuguuuuagaauuagaguuuaaugaagaaaaacuugaauauauucugcugauucuuuaucuugaguaggugaaacuguuaucuuacagaaauauuucucuuuucguuuuuagguuggcguugcaaacgcuauggucaccgaacgggugacaaagaaugcccuuucuuuaucaaaggcaaccaaaaguuagagcaguucagagugguaaguaaaguccaagagugucaauuuacauuuaucagagauagugaaaaucagugaagcagaaagucaccagugaacuugaauggucacauaaaauacauucccagaagcccuuugaccaaagugugugcuguuaacuacaugcuuauuaaauuacauuuguaugacaaauuagcucuuuuacaaaaaaaaggaauucuuauuaaagugaucuuuguuuguaacuuggaacagugauuuuuuuucugaaacagacauuguuaucuauucaaccgcacuuuuuaaaauuuacuguguaaaaaagucauguuucaugacugaaaucagggauuuaauuucccggucuuuaaagaguacaugucuuuaaacuguaagauuaaaguguccguauauuuuuucuuuagaugacaguuauucccuguauuuuucuuuguuuuugagguggcaguguuauagcucugugauugcuccugcagagcagggcuaccccaaagacagugugcugagaguagccauuuccuguauuuuucuaauuggaaaauccauuuuuuagccuuaaugaguuuucagugaugugaccuagaacauguugaacaugcagcuacaucaaacaguaaaaaaaaaaauaaacugguuuucauaacauaggcauuucauuguauuuaacuugugauccaugaagccuaaccaaaccuuaaccuucucugacccuuaaggcacaugaagaucccauguaugacaucauacgagacaauaaacgacaugaaaaggacguaaggugaggucguccugaugauaacaauauccccuuaaaguuuuaaaauuauauaaaguuggagaaaaccacucuaguguuagaggaauggugcaguaaacaugguacuucaauugugaaaauauguggagugcaggagucauggcugaaaaggccaguguuggggaaugagcaggccagccuccuccuccuuggguuaacuuaaagccaugggcuugguccagcucucuggccacugcaguugauguuggcaacccauguugugcugucuacuuguacaguauaauugauauuuucaugugauucaguuuaucuucuccagagucuuuagggaugugagcuuuuguuaaaaauuauacuuaggccaggcucaguggcucacaccuguaauccuaacacuuugggaggccgaggccagcggaucgcugaaguccaggcguuugagaccagccugggccauacagcaaaaccccaucuuuacaaaaaaauauaaaaaguagccaaguauggcagcacgcaccuguaguuccagccacucgggaggaugaggugggaggaucuacuugaccccaguagguugaggcugcaguaagccaugauugcaccacugcacuccagccuaggugacagaggaagacccugucucuaaaaaaaaaagaaaaaaauuagacaugauuagagagagguggaaaaaauuggaggguuuguuuuuucaaauugguggcauuauaacuguuaaagauguagauuaagaaauugagcaguaggggaaugguuuaguaaaguaugcgucuguuagaaauuacaauuguaaggacuguggaaacaugcagaaaugucuaggacaauaaaaagaauacaaaguggcuuguacacugguuucagucacguaaaguaggcauucagguggagaagaaugagaaaacagguaaaaauaaaaauacugucuuugugacaugguuauucaucauccuauacugcuuuugaaugacauauuuaucuaagcaacuguuguaaguuaaagcuaaaacucacuguucuuugaucaauuuugaauguuuaggauacagcaguuaaaacaguuacuggaggauucuaccucagaugaagauaggagcagcuccaguuccucugaagguaaagagaaacacaagaaaaagaagaagaaagaaaagcauaagaaaaggaagaaagaaaagaaaaagaagaaaaaacggaagcacaaaucuuccaagucaaaugaggguucugacucagagugacaaggaugugacuuguucaacauucucuucucaaacacugaccaaggaacagaggaagaugcagucagagaaagcagcaggauagagacgccgagagaggaguauaugugggucacagcagugagcucccacccgccuugcagugaagaugugaccccaggagagggagugucuccuuccaggugcuagcucuggacagcagcugauuuuaggcaggaaaguuucuucaucguuguccucccugcuggucacaugaguuuacgauuccuuugaagugucucccacaggguggcaggacugggagaaucucugaggcgugucuuccaggcccucccacagcuugugcccuccacaguguggacucaggucccauagacaucaggcuggagucuucucuguuguugagaauaauaaaagcucauuauuuauuuuuuaa
